United States Patent 7,868,149 (PLANT GENOME SEQUENCE AND USES THEREOF) - sequence listing, part 111

SEQ ID NO: 60643 - DNA, 9115 bp, Oryza sativa
  unsure (1)..(9115): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatctattttagcaacatggggcaaaagtcaataagccatttctatcagttgtcagttgaattcgtccccatagcgacgatcaagtcttcttttttttaaaaaaaaaaaaaaaaactgaatcgacggtcaagtcttgtaagctcattcgtgcaaatatcatatgtcattgtaacaatcatcagttaagctgaaccggtcccaagaacctgacgcaggcttttcaaattattaaacggtgatttgaacaactttgccaatttcactctttcgttttctatgcacacgctttttaaactattacagtgtttttttttttttgcaaaaagtttctatagaaaagttgtttttaaaaaatcatactaatctattttttaagttttttttaagctaattctcaactaatcatacgcttataaggtatcccgttttccgtgcgaagggaattaattcccaatacaaggaaacgaacacaaccgaggctaagataagtaggaagtcttttacccttttgttatctaatatgttacagaaaaatttaagagttcagacgtccacagcaacaaatgcagagtggaaaactgaagaaagaaaaaaccattgctccgaagacagttcatacaagtaaaagtgaaattaagcctcttcactggtaaatactcgaacaacaagattgagtgagccgatgagtttcagggttcgttcttcagcagccaatgtggtttgtcaaatttaagcgtttgtcttcaaattcctatgtctgaggataccgagaacaagaatttatagaagcttcagaccaccggtgacatcatcgaccatgtcagctggccctgctcaattaaaacagtacgacaaatattagatagcacaaatcactgaaaactgtggtacacagtgatttgaatgtagcttaccaagaatagccatgactgttcttgaatctacaggaagcagagatgggaacataattaatccaacagcagatattaaacagatgctaaattgaataaagtaaagcctgaagaactcacttggtgcgatctgtgttcttccagcatcaatagttatgtgtgttgggatattcaaagactttgctcttccctgcaccaaaagaaattttaattaaacataacagaaaaaatgcaagcattaacaacgttttatactattatggaattgaaaggtaacatattagctatataaaagatctcgttgaatgcagaatataaatattatgatgcataagtgtcaagtgttgggtttcaagaagcgcggtgatttttcttttttcacagccaatgtttcagagtgagttttccaatcgaaatttcaagttgttttaaccaattgttcgttgatactactaatgctctagtccacttctaatgccatgagaatttcctttttatttattaatatgcacaatttgacaggtaaaaggggaatattttctgtttctgttcatctgcaggtattatactattccaactcacaaattacctttatagatgtagtaaaaataaaaataactttcaacaataatgagtcaacaggcaacagaaaagggtatttacttgtaaaacaagcatatcttcctcgctttcaattttcacgaccaccttaacttgaccacacctctcccacctagcaaagatagtaaattagtttccttcctgttgttatcatgcaatgacaatcgaattgcttacatatgaacatgaacatgtggaagaaacttcaaacataattggaaatgttaaaaaaaataccttcttaatgattttggagctctctgttggagttttttaaacagacccaacgttgcatggctgagatgacagaataagagataatcactgacatttgcaagataaaaagaaatatgcacaggagaaaagttataaagcatgacaacactccaatgctgaaggtaaagattaaatgcaggagctggacatgaagataagcaatttgtttgtgccaattcatttattccataacgacaagtgtatagtacaactgtataagaggcaaatttagttatggtaggatatataacaagttctctaaatcacaaggtcaacgtgccagtcccaaaaatatgagttctacctcttgtagcctcagataacaatatgatcacaaaatttcccccttcaaaaaatgggaaactctattcgaaaggattcttcctattttaacattggtttcaactttcacattcagacacacaatacactaatagcctatcactatgtgctaattagtgagctcagttcatcagtaaaataaactctactcaactgtcgaaacgaagatacagataaactgagaagtattcacctgcattgcgcggcaatcttccccttccccatcttcaaatcattcctcacaaccagcacctgccaccaccacagcaacagccaacggaatcagacatctcactctctgcgcacatcaaagaaacaaatccagcagaaaagtagaaggggattttgagccaaatttccagtaccatcttgaaatcctctataatctcagcgagattctcgacctccagggggctagccgcggtccgtgccttggccctctcggcctccttcgccgagtcggacttggtcaccacgttgcgcgcccagaacagcagccggagcccggcgcgcttgggcgcccgcttcgccgcccggctgcggccggagttttcgtcatcatcatcttcttccgaatcctcctcggaatcctcgtccgaggtctccccggaagcgggggaggcagcgacgacctggcgggggaagcggctgagggcgaggaagtagccgagggcgaagcagcccgcggcgccagctatagcggtggcggctcccgggatggcggccgccgtgggaagggagaggacggaggccgaggcgcccatcggaggatcgccggcgccggtggcggcggcggcggcggcgcaaggcggggaggggttggggttggggatgcgcgatactaccgcgtgggggtttcgggaggaggcggtgatttaggtggaggggatgattctgacaggtgggcccaacggctcagcgaatgaacggtacgtgcgtccctggaccgtccgatgggggattggcgtctgggatctcgcgaatcgaggcgcgacacgtggcaggtcgcgccgtgggccccactaagccacgtgtaccgcctgtacgggctacagcccggcctataaaggccagggattcgaactagcataacccggcggaataagttcactttgggtccctctatttgtcgccgagtccgattttcgtcccttgaccgtaaaaccgggtatgacccgtcccccaacttacaaaaaccggataaacgtggtccctcggcggttttgaaggcggttttggatgacgtggcgcatacgtggtttgtttgactaggtctccgtcgcacgtggcattgacgtggcgcttacgtggcaattatatctcggaaaaataataaaaagcgtggccccacatgtcagctgcatataaaaaattatttaaaaatggtggggcccatgtgggcccacatgtcagctacacaacaaaaaccccacgtgggccccacatgtcattccctatctcctctcggctctctctcatcttccccatcgtcgccacaacacgcgccaagatgtcgtcgccatccatcgccgccgcctccatcgccgcgcgcaaagaggagggagcggcgcggcggctgtggccacaagaggaagggacggcggagcggcgcgaagccggcggagagggaggcggaggcggagacggcggcacgcgaaggaggagtcggcggcggcgggtccgaagtcgtgcagctccggccgccgctccctcctctcccgtcggccgccacgggccgctcctctgccatcggccgccgcgccacgctttgcccgaggcccgccgcagctgcttcctcggatccaaggctgcctcattctgagcgtcctcgctgccgagatccaagggcgccgccactgcttccccggacgacctcgactcccgcgggctctccgccgccgctccgaccgccgtcgtgccgccgttgtcccgccagcttcgcgcgccgccgctccggccgccgtcgtgccgccgttgcccccgccggcttcgcgcgccgccgctccgaccgctgtcgtgccgccgctggccaccgctccgtccacgtggggaaaagagaagtaggatagggaagaggagggagagccgagagggagagggaatgtggggcccacgtgggccccaccatattttttttatagctaacatgtgggcccacgggggccaccattttaaaattattttttatgtgtagctgacatgtggacccacgatttttattatttttcaaagatataattgcgacgtaagcgccacgtcaatgccacgtgggacagagacctagtcaaacctgccacgtaggcgccacatcagccaaaaccgctatccaaaccgccttaggactttatgtgcccggttttcgtaagttgggggacgggttatacccggttttggggttcagggacgaaaatcggactgggcgacaaatagagggacctaagtgaacttgttcctaacccggcctataaacgtggcatgggcctacatttttgcgaattgcataggcccattcgccccgtgctcgcttcaagattcgtgcagcttacgttgcagcgccgatgcatactgctacctccgttcaaaattaattccatttcacctatcccacacgaaccaatacaaaatcaaaagtagaatactcaaaattagaatgatgtgactgaaaagttgtgtgtgacaggttgatatgatgaaaaagtactgaaatttggatctaaactttggatctaaacacagccattgttagtcaattaagaatcttgaagatcatgctgaaataaagaaaatgtttatattttaggatagaggaggtatttttttatatattaatttttttagaccgacggaattcgtgcagagacagctgcgacatcaaatccatcgatcggtacctacggtacgtaacgtgcccgtcccatcccatcccatccctcgatggatggacggatatactccctcggtcaacaaaaaaaaaaaagaccaacgtttgaccgtccgtcttatttgaaaaaattatgaaaaaaattaaaaagacaaataacgcacaaaattttaatcatgttttatcatctaacaacaatgaaaatatgaattataaaaaaaattatataagatggacagtcaaagttggacacggaaaccagggttcacctttttttagatggagggagcacggagtatgcaacgacgcaatcgcgcgcgagtccgtctgtttttctctagcggtacgtgcaatgtcgattcggacggttggtaatgtcgattacagtagccacgattaattaacccatgtcccatgtgcgcaggtgccggaagcccggaatccatcgagttctcgaaaggtccctgtactagctactccctctctccattaatacagaggattatgctccctaagtttatccagaaatttaagggattccgagataagaagtaaagcagcaatcagaaattgagtacccccatccattcccatcagaaaaggtatatagtgaaaagtacatgtagtactactctgcatgcagctcctttgaatcctatcttagttcatttctatgggccccttcgaatcgtaggacggagaaaacatacgaataggaaaaacgtaggattttaataggaatgtaaatgtataacagaggattgtaaaacgcaggaaaaacacaggaatgaccgtttgattgaaccaaggaaaaacttagaaattagatgagagagatagactcaaaggaaagttaccaagaggttgaagctcttgctaaatttcctccaaaatctctataggattgtccattctataggaatttcaaaggattggatataattcgatcttttgtttcaaagggcttcataggaaaatttcctataagattgaaatcctccaaaattcctatgtttttcctccaattcaaaggggccctaaatatgtattttatactacctctgttttttaatagatgacgccgttgattttttctcacatgtttgaccattcgtcttattcaaaaaatttacgtaattataatttattttgttatgagttgttttatcactcatagtactttaagtgtgatttatatcttatacatttgcataaaatttttgaataagacgaatggtgaaatatgtgagaaaaagtcaacggcgtcatctattaaaaaacggagggagaacgcttcattcagtttgctaataagttcattttcacactatcacatgctcctccatcccaaaaaagtatataggttgggttttttttttatagagggagtactctgtagcttagatttagcattccgtactcttccttaatttgaactatatttggcataatactctatattcctggacggagggtgtattagtatagaatattcatatcataaggttgtcttcgttctctcactttctcaacttctactatcttgtttccgtacgtatactttccaaaccgctaaatggagtgtttctttttaaattttctataggaaattgttttttaaaaatcatattaatctatttaaaagtttttttaagttaatacttaattaattatgtgctaataggttatctcattttttcatgcgtgagacatgaattaccaacgtccaggttcacccatcctatgtcgatttgatttttggtcaaaatcaaactactccaagtttaatcacgtttgagagaaaaatagtaacatattgaacacaagacaaatatatatactataaaatataatcaattatagatttaataaaattaatttggtgtagatagtagtattagtatatttatctattgtattgaataagagtatatttgtctatcaacttgaaatagtttaatggacgatggagtagctaggtggtagagctagcggtaactggttgatttgattggtacggatgttacgtgtacatgtactccgtacgcaggtatacgtatggactacgtacctgctgtcacgccctgaagttttccccctttgcttgctttaaaaattggctaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaattttaatcccaggaaaatcctttcttctttttctttttcctttttcctcctttttcctcttcttgggccgtcggcccagtccacccgtcgcccgcgctcggcctccccttgtgggccggcccgttccctttccccctctctccgggacgctgacaggtggggcccacctgtcaggtcgtccccttcctccagccgaccgcgctcggccggcaaccgccgctcccacgccgccgcctcctccgctctttccgcgcccacgccgcgccgctcccgcgtcctccccacgtcgccgcctcttcccccgcatctcccggcccgcgcgcgcgctcgagagggcgggattcgagttcgaatcccacccctctttctctctctcctccccacgtcgccggctaaatcgggagggttcccggccacgtcctcccctccctcgcccattaaatcactctcccgagctccctctctcgtttcccccatttcccgtcccctcccgtgcctcctaccgagctcgcgccgcttgttgctagcgccgccgcttgccgtcgccttcggccgcgcgccactgccgctagggtcgccgccgcgccaacccgccaccgccgttagcttcgccgccgcgagagctacctcggccgccgctcggttgccgccaatcgtcgccgaaacgccgcttctctcgcacgccggtgagctctccatttccacccaactccggccggccgctctagtggccgtggtcatcctccccttcccctaacccggtcatcgcctttcccaggttgtgctcgaccccgtccgccgttgtcggaagcgccggccgccgctcgtctcttcccacgccggtcgccgccatcgcctcggtgaggaatcccctttcctccttcctttcctctcccccgtgagcgccgccgccctccgcgcgtgcgccgtcgtcttcggctgccgccgccgccttcgcgcctgacggagctcgtggctcctcaccgggagaccgcgcaggcccccctttgccggttcggccgggggcttagggtgagatctcaagctctctctgtatgtggaaagatcgcttgctcggaagaaacgcgagacacggcggcgatctatacaggttcgggccgctgctcagcgtaataccctactcctgtgtttttgtggatttgtgtatggacaagttacaaaggattaactccctttcccctcagccttccaaaagggaaaaagtccccctctgaatgggcaaggtcctccttttatatctcaaggggataccacatgcacctttctctttccaaactggactgttcttttctctttaatgggcggagatcggtacggtttccatccgggagcccttctgatgggacaacccacacctacccccacctcccccgaagacagagatgacg

SEQ ID NO: 60644 - DNA, 10570 bp, Oryza sativa
gaccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaacccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcaccgagaaaaggatttgctcccttcctttcgccattgttcctcttgccttcgccgcctgagctctaactctttctctgctacgccctactttcgccacacgcgctcgttctcaatcatctcttcctccaccgccatggcacggggctctgctctgcacgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggtgcgcctgggagtacactgggcctgaagactacatgcggacccaccagggagccagatgggattgggctcccgaggacttcaagatcgtggtccaaagggtgctgaatcttagctccgtggaggcgtctcgcattcctcaggtgatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagctttttcttactcattttgttcgtcttctggttttttcttctgcttcagtgatgtcccgtcgcattcctcccgccaccccaagtccggccagtccgaggccgaagatcctacggccgcggaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctaaggcaacagctgctgctggcgcgtcaactgggcccaccccttcgggcaaccctcaggcgacagcctccggggaggctcgcgacgaggccgcgggcacatcgcttgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcaacgcccaagtggaggccctgcgcgcggaacgagcggagctcgaggccgcatgggcacgtgttgaggaggggcggcgctcggtggacgccatggtggaggtgggccgtaaagctcaccgccgtcacgtctcggaggttgaagcccggaaggcggcgctgacggagatcgctcgtgaggtggaggaggagcggccggccgccctcatctctaccaccgcgatggtcgaggcgcaagacaccctccgccttcagcatgcaagctgggaggcggagctgaagaaaaagctcgacgccgcccaaggggtccttgactccgccgctgcccgagagcggcgggtgacggagactgaagcggcgtctcggcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtccgcgctccgcctccgcgaggatgcactcgctgagcgggagcgagctctcgaggaggccgaggccacgacgcaacggctggcggacagcctgtccctccgcgaggcagcgcaggaggagcaggcgcgccgcaatctggaatgcgtccgcgccgagagagccgcactggagcagcgggctgccgacctcgaggcgcgggaaaaagagctggacgcaagggcgcgcgtcggtggggcggctgcgggcgaaagcgacttagccgctcgcctcgcggctgccgaacacaccgtcgctgacatgcagcgcgcactagattcctccatcggggaggccgaggccctccgcttggcgggcgagatggggcccgacatgctttgggactcggtctcccgcatggatcgcgccggtcggcaagcgggcctctggaagggccagacgaggatgcgccccatcaatctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccaatttctctccctggatggcgctggaggagttccctcccgggaccgaggacgacgcgcgcgcgcgcgtccgggatgccgccgaccacatcgtcaacggcttcgagggctcggcccctcggctcgcgttcgcccccaactccgacgaggagggcaacaccagcagtgcagacgatggtggtgacgaggtcgtcgactcgggcgcgtcggaatgagcccccgagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgatttcagctgaccgaaccgaacccccgagggcaaggttgagtacgagtgaccttattttaagtcaagattcttcaaaaggaaagaacagcacagacacaacctttaggaaattgaaactgcttttattgaaatgttgaaaaaagagaaataagaatgtaatgcatgtgtggtagcccccggtcaaccctgcacacccgaggggggtgcggggttggcctgagccaaaacctgacacccgacccccccctcctcaggggtagaagcgacgaaggtgttcgatgttccatgggttaggcagctccgtgccgtcgcccgtggccagccgtaccgagcccggccggggaacaccgatcactcgatacggaccctcccacattggtgagagtttgctcaatccagcacgcgtttggacgcggcgtaggacgaggtcgtcgacgcagagtggtcgggcccggacgtggcgctgatggtagcgccgcaagctctgctggtagcgcgcggctcggagagccgcgcgccgccttcgctcttctaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaagatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctgagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccttctgggtacatgccgaagttctatcccatcgaaatggcgctccatacgccgcacttggcgtacgtaggcgtccatctgtgggtcagagctccggtactccttacagacctggttaacgactagctgggagtcacctaataccaagaggcggcggatccccagtccagctgccactctgagtccggcaaggagtccctcgtactctgccatattgttagtcgctcgaaagtcgagacggaccaagtatctgaggacgtcccctgtcggggaggtcaacgtgacccccgcaccggcaccctggagagacagagaaccgtcgaactgcatcacccagtgggtggtgcgaggcagctgaaaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgtgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcattcttcgtccaagtggcctctcggggcgcactcgccttctgtgccgatgtcctcggggtcggaggatgacaggagcggccttcccacagtggcctcggggccgtcctgggggtcgggggctcctggcgtcgtcggacaagcgggcaaagggcctactccggtcgtcaggggcctcaggcctccgttcggctcgggggcctcttctccctgctttctcccgggtcgagtcagcacagggttagcctcggggccaaagggcgttaggtgcggccttcccgcagtggcctcggggccctcctgagggtcgggggcacccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgaggagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaagcacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggacgacttcacggatgaatccggcctccagaagtctcgccacctcctcgcggatgaaggcttgacgttccggggcctgccgccgcactttctgccggaccggccttgcgcccggccgcacggcaagacggtgctcaatcacctccctggggaccccgggcatatccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcacagcagcgaggtggtccgcacgctgctccatgcaagcgagcgcgactttaaggtcgccacggacagagatggggccaccggggcccgacatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcgaaagtgagggcaacctccgaccaccgcgcccggcgcgtcgcctcatgagtaggggccgcggccagaagctctcgcctcatggccttaaaactccggcgagaaacgtgagcacacgctcccccgtcgacagtggcaatggtggccccgggttcctggaaacctaggtcatcatcaccgtcatcaatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataagtgccttgaaagatcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatactcctcggtgatggtgggccggaaccttgggggccaacggacattccgaagactcgccacaaaggctctacagccaacaccaccaaccgggggcacggagggctggtcctcacgtccatgtggaggtgacactctggacgaggaggcgccctccgttgtgtcacgccctgaagttttcccccgtttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataatttttaccaattaaaaatcaccaaagtgaaatttttaatcccaggaaaatcctttcttctttttcttttttctttttcctcctttttcctcttcttgggccgtcggcccagtccaccccgtctccccgcgctcggcctttcccttgtgggccggcccgtt

SEQ ID NO: 60645 - DNA, 11316 bp, Oryza sativa
ttcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaagtggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcctaatcctgcctgatcagacgaaagattttcaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatctttactcaacctgatttgaatctcagacagcgaagatggttggagctgatcaaggattatgatatgggaatacattatcatcccggcaaggctaatgtggttgcagatgccttgagcaggaagagctactgcaatgttgcatgagtagagcaactatgttgtgaggttcaacgcgacttggaacatctgaaccttggtatagttgagcacggattcgtggctgccctagaggcacagcccacactggtggagcaggttcgcatagctcaagcaagtgatcctgaaatagcagagcttaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagaaaagttctggtgggtcagcatgagaagggaaatagctgagttcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggtaagaaattagcagaactctatctggcaagaattatgtgtttacatggtgtacctaagaagatcgtgtctgatcgaggaagccaatttacttcaaagttctggcaggaattacaagaagaattgggaacccggttgaatttcagcaccgcttaccatccacaaacagatggccagaccgagcgagtcaatcaaatactagaggatatgttgagagcatgtgcgcttgactttggtggagcatgggacaaaagcttaccgtatgctgagttctcgtacaacaacagttaccaagctagtttgcagatggcaccgtttgaagcactgtatggacggaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagggagctcgttttccaagtaggggattatgtgtatctccgtgtcactccgctcaggggagtacatcgcttccaaaccaaaggaaagttggcaccacgctttgtgggaccatatcggattttggaacgtagaggtgaagttgcttaccagctcgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataatttttaccaattaaaaatcaccaaagtgcaatttttaatcccaggaaaatcctttcttctttttcttttttctttttcctcctttttcctcttcttgggccgtcggcccagtccaccccgtctccccgcgctcggcctttcccttgtgggccggcccgttctccttcccctctctccgggacgctgacaggtggggcccacctgtcaggtcgtccccttcctccagccacccgcctccgacggcaaccgccgccgaatccgccacgtcgccgcctcctccgctcttcccgcgcccacgccgcgccgctcccgcgtccccctcccacgtcgccgcctctcccccgcgtctcccgccctcgcgcgcctcgcaaatgggcgggattcgaatttgaatcccacccctctctctctcccccaccttcccacgtcgccggcgcaataggatgggttcccggccacgtccgcctccccctccgcctataaatcgttccccgcgtcttcctctctcgttttttcgcactcgccgcgctctcccgtgccgtctaccgccctcgcgccgtcgcacccgagctccgccgctggccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttctcctagggtgtcgccgccgcccgtccgtgcctccgcgtcgccggtcatcgccgctcgtctctttccacgccggtcgccgccatcgcctcggtgaggaatcccttttcctccttcctttcctctcccccgtgagcgccgccgccctccgcgcgtgcgccgtcatcttcggctgccgccgccgccttcgcgccggccgccgccgtctccccgcgccgccggtcaccgccggcggtcgtgcgccgtcgtcgcctcgccatggccggccggcttgagccgtgccgagcatgccgccgcccactccctcccccttgagccactgcccgtggggcccacatgccggcgcctccctctcctttccccttagtgccgctgaccagtggggcccacctgtcggcgcagccgccccctcccttccgctgacgtcagccctgggactattgcgcaataaatatattaaggcttttcttttatagaaataaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccgcagtttctcgaagacgttgctgtgatctcatcagtgcgagagcaaggcaagtcatacattgcaattgatcatattgtacccaatttacaaatgtcccgcatttctattaaatattgcattgttttacaatgtaatgtgggatgggtcctattcctcagccacatattggttaccttatgccattgataacttggggatcaaaatgactagatgttggcctaggaaatgcttagccatgcttagctcaactagcacacaaaaagggatcacattattacatagactttgtctattggcatagctttagattggtgccaccgcaatggtgttagttaattaaaatacattgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatctcttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacacgttgcacggggagtacgccggccgttacgccggcgctcgatgttgaggcgggcatccggctccccatgctgatcctcccgagtcgaaggcgtcgacgagggagtggcagccgaatgacgtgcagccgccgccgctcgccgcgccctccgtcttgatgacacggaaccggtggtggcggcgccggaggtcttggtggtggcggaccgtccaccagcacccaggcgctgctgggccgtcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttctcctgtatcacccgcgaccggtgatgctgcggatttatcaaccctctcgagcgcctccccctgcttaggactttggtgtggaggaggtgggggagtacgagctcgacggcgtgggtttggctccccgtcgtcgccgctcacactcggagagaggtcgtgcacctttgcttgctcggccattaggctgatcaagaaaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagatcgcttgctcggaagaaacgcgagacacgtcggcgatctatacaggttcgggccgctgctcagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcactgtactgcgttgcatgcagcgtgacacgcttgaccagactgcaattaatgctgttaggtgagcacagctgtgctcacttatcccatatatgtggcgcagacttccttaaagggtcggggtgcctcggccctcggggccggggcaagcgcaacccgacccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagcgccggccgccgccgtctccccgcgccgccggtcaccgccggcggtcgtgcgccgtcgtcgcctcgccatggccggccggcttgagccgtgccaagccaacagccacgcccctctcccgccctgtgccgctgcccggtggggcccaccagccggtggaccacccctcccttttagccgccaccagtggggcccacatgccgacgccccctccctctccccttgtgccgctgccagtggggcccgcttgccagccgccccctctccctcccttagtgccgctgaccagtggggcccgcctgtcggcgccaccccctcccctcgctgacgtcagccctgggacttactgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccgcagtttctcgaagacgttgctgaggtctcatcagttcgagagcaaggcaagtcatgcaatacgtttgatcatattgtacccaatttacaaatatcccgcatttctattaaatgttgcattcttttacaatatcatgtgggatgggtcctattactcagccatttattgtttaccatatgccattgataacctgggtatcaaaatgattagatgttggtttaggaaatgcttagccatgcttagttcaactagcacacaaatggggatcacctttttacatagactttgtctattggcatagctttagattggtgccaccgcaatggtgtgagttaattaaaatacactgaatggtgggctgtgggtgcatggttttgctggtcgcacccatggcggttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggtgtagcgttggacagtgattggttaatattgattaattactacaactgttttactgccttcaactactgtttttaaatgctagctttatgcaaaagaacctctagcctcctttggttatatcctgcatcatacctcctcttccggtatgatttgctgagtacagtgggtagtactcagtcttgctctctttttcccccacaccagagctggagatcttcctagttggagctgttttgtcaaagttggtttcgtcgctgccgtcaaggattgcctgtggagtggagtcgcccgctgctgaagtcaagcttcccggtttagctcgcttttatttttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacacctgctgactcgggtagctagctagtcgtagtatgcagtacttataagggcatctgtagttgagttcggcgagaaccatccacggaaacaaagttaattttggttcgggtgctacttcctccgttcaaaaaaaagtcaacctagtactaggctgtgacatatcctggtacaataaatttagacacagagtatgttcaaattcattatactagtatgtgtcatgtcgtagtacgaggttaagttttttagaacggagggagtacaacgctagcatcgatttatcgggcccatctagaatcagccgtaatctttcctccctcgcacaaactagcgaagaaacatttttctaaacggcaaaatcgactatgcgttaggttcgagatgtttttacctcacgcgacttttttttttgttgagaattacacagtacaacgcagacactcacaacgcacgcgcactcacccctatgaacacacgcacgcaaaccctacccctatgagcatcttcgaagactgggccggcaaattctggagagattgacgaagtcaccacaggcgcctcgctgtcgacgggtacgtcgcctaccactgaaagcacaacgccgttaaatcctggaaaattcgcacccatggggagtcgaacccaggaccagtggcggatccagcatgggagcggcggggtctcgagcccctactactggcgtgaagactatgagagaccccacgaagaccccactaaaattttttaccataagtagatgggagggaggactgtaactttatctagtttgctcagaccccactactatttatttctagatccgccactgcccaggacctcaggtgctactgaggctcttgtaaccactaggctacaggccctttcgcacgtgacgatttaacccaacgctgcagatgctctaagctaggagtacgtagctggtagatttaggttgagaccacagcacaaatgcggctcgagacgaggacgtttcacagatcgatggtgggatggatggatgggatgcctacgatcgagtggtcgggattcgatctctatctccctatcctatgtatccttcctaatacgcgcgtgatggatgctcgcggtgctagcattcatgaatcatgaatggtcgatgttccgagttcgtgtacgttggccatgtgttaagcatgaggagtgtacagcattagctagttatatgggtagctggtgtgtagtctttgcgtgggagccactccactacaattgatttattttctatagggataagaaagttgccaagtgatcgaccggtggtagaacctactcaccctggtttatgtttatagacttgacacgggtgctgtttacggttaaatatttttataatggtaggtagcatatcatcgacagcaaaaaccttgatgctttatgactatgatagatgaatgcccgatccagtctgtcacagcctcacaggtactcgtaacaaagaaaagactaaccacgagaagctaatagctatctagtatgtctctggaaaaagaaaactaaccatgagaaggtaatgcctatctagtccgactcgggacaattagtattgctcgggtcatatcccaatatactctccagcttctaagctagttttgagtttggacaaagagaccgtttcagatgacaaatataaaccactcatgagaaaaaaggatatcaaaatctcaacccaatacaagccacatcgagtcgttatctgctctcgaagctagccaccaacttcattgccgaggctaggtggtttttccacctcatattgtgtactcaatgcatctcggatcaatacatataaagaagacgtgaggctagcaattatctgttctggagggttgaattcaaaattatagctttaaattatcaggtcctatccatcacataatttaaaagctaattttgaattgtgcggattgattatccttttgcgacaaaattataccgtaccttctcactaagattatgcaagttttgttttcccttgtgctacacattttctttttaacgaacatttttt

SEQ ID NO: 60646 - DNA, 3135 bp, Oryza sativa
atgcaaaagaacctctagcctcctttggttatatcctgcatcatacctcctcttccggtatgactgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatctcttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctccgaacccctttttcatctgcatatgcctttttgcacctggaattgttttgggaaaatttggagttttgcctctttggtttgcgggaaaaatcttggtcgttcattcggatcggatttttttttttttaaaaaaaatgagctcagcctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgctccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctaccccctcagatggagacaaggaatggttcacgcgactccaacaacgccagtggcagcgaagagccgatcaatggagcacgtgccaacggtgcatctgacaacagtccgtccccaccgcccgagaacccaacaattgctcaggtgttggacaatcagactcggatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatacaacgagcaggagaaggttgcttttgctacacaccagctacaaggtcccgcttctatttggtgggacaactacatggtgacccgtccaactggggcagaagttacttggacagagttttgtcatagtttcaataaagcacaggttcccgagggaattgtggcacaaaagaagagagagttccgttccctgcaacaaggaaccagaacagttatagagtatttgcatgagttcaaccgcctcgcgcactacgcccctgaggacgtgcgtaccgatgccgagaggcaggagaagtttctgtctggtcttgatgatgaattgaccaaccagttggtctctagagattatgaggactttgagaagcttgtggacaaggctatccgtcaagaggagcagtgtaacaaaatgaaccgtaagaggaaggcagcccagttcaggactccccaggggaagtgtcagaagcctcgtttcacgatgggacatcacggtggaccttccaccatgattatccggcagcaccgtccctaccacccgggtaacttcaacaagaaccaccatagtgacagtcacaacaatagtaagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgttaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggagaagaaagacaaaaccaagaggatgtgcgttgactaccgcgcactcaatgagg

SEQ ID NO: 60647 - DNA, 1145 bp, Oryza sativa
tcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttacctcttacgctccaggaatggatcagtcagaacatcaccaccggctcgcctcgaccgccgctgactggtgtttccgcctgcacggctggcctattatgccgccgttgttgggcgtctacgtcttcaccgaccggcttgccttcgccgccgccgactggtgtttccgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctcgcctttatgccgccgttgttgggcgtctacgtcttcaccgaccggcttgccttcgccgccgccgactggtggttccgcctgcacggctggcctttatgccgccgttgttgggcgtctacgtcttcaccgaccggccgcctcgtccgccgccgactggtgcttccgcctgcacggctggcctattatgccgccgttgttaggcgtctacgtcttcaccgaccggcttgccttcgtcgccgccgactggtatcctcgcctgcacggctggcctattatgccgccgttgttgggcgcctacgtcttcaccgaccggcttgccttcgtcgccgccgactggtgtcctcgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgtccgccgccgactggtgcttccgcctgcacggctggcctattatgccgccgttgttgggcgcctacgtcttcaccgaccggcttgccttcgtcgcgccgaccgatgtcctcgc

SEQ ID NO: 60648 - DNA, 750 bp, Oryza sativa
gtatttttgttaatgtttcatcaattgaagactatctgatttagtcaataggtttttcttatgatgatctcttattgctactcagtacttgtaactgatttctactttaccaaaattgcagggattggtcttcctattcagcatgctaggaataacacctttagctgagcgcttgggttatgcaactgagtgagttagtgaactctagacctatttttttctgaccttatttcgtttaacctaaactactgttctacaggcagctcgcaatatacactggtccaacaggtatgcatttttatttttatgatttataacctattacaaaatggagaaccagtgaacaataacagacattttcttttaataccgattgcagttggggggcttctaaatgctacgttcggaaatgcaactgaaatgatcatagcaatatatgctttgaaaaatggaatgatccgagtagttcaacaatcattgcttggttccatattatcaaatatgttgttggttatgggctgtgctttctttgctggcggtattgttcatcggaacaaggaccaagtcttcagcaaggtaattttgatgcaacatgttgtgcgtcctttccactcaaaagttcctgatatgaaatcaatttttatttactacaggcaactgcagttgttaactcaggtttactgttgatggctgtcatgggactaatgtttcctgctgtccttcacttcacgcattcagaagtgaggcaag

SEQ ID NO: 60649 - DNA, 31410 bp, Oryza sativa
tgcaggtttgttttcccaaatcttcatttctgtttactttggatttgagatggccctagtaactttatctgttatttatgcttgctcaggaaagattagctctaaaacaatctggagttgaactgggcaattcagttctcttctttggatgcaggaaccgtaatatggtatgcatcaaaagatagttcatgagatacatattatgatcatgttgctcttactggacctcatctgaatgaccaacctgcaggactacatatatgaagacgagttgcaaaacttcattcaggagggtgcactttctgagctgattgttgccttctctcgtgaaggaccagccaaagaatacgtgcagcataagatgacagagaaggttagttcgatacacgctccacatttctaccgcactatgctgcttttcttgaacttctatacagaatttccccacacatggctatactcaatgaggttttctgctgatatcaggccacagaaatttggaacatcgtctcacaaggtggttacatatatgtgtgcggtgatgccaagggtatggcaagagacgtacacagagctcttcatacaattgttcaagagcaggtagacagagagacactttgtctcatcaatatctttattatttatcgattgagagatgtcgaattagtcatgtattttcctgctcctaacacttacattttgcaccttgtttcagggatctttggatagctccaaaaccgagagctatgtaaagagcctacagatggacggcaggtacctccgtgacgtatggtgacaccatcagaattatcagaaatagctcgctctagctttgtagaagtgaaggtgtcaagagtcggatttgcctgtaaggccatggtgcatgccaatccaatcgtgagtttttcagaacgaagcgtgccgttgcttagaaaattggagttaaaagtcggtgtaattctttgacatctaacatggttccgatatttattattattatatggatgattgaaagaataagtacctgttgtagatttgtagaacctgaaagttggccctgtcccttcagtttgtagtaagagggatacatcatacagtatgagacaatcagattatatcgtgtatacattgaaagaacaccaagccaattttgcatctggtttatgaattaaaacatatgctttaagtagctaccactgttgttttgccatcctgaattattggaatggattatttgctctactcttcaaaaattatattttcttaaaagctttctcctaccatattgctaagatccactttgtttagcttatttgtttaaatatttattttctataagcaagtagataattagtcgcaataatttgtgcctctttcctttgtgcttgtctacgtcagcacggccaaaacatacatgcccacttgtctccgtgatttttcgtcagagatagcatagcagcttggtcgttttcgccgatcagatttcgcgaaaaccaccaacttgatcagtgtcacccacacgcaccgtcactgagatcttgtccatttggttgaaaaaatcactgcaaaatgctgagaaaattgaacagaataactgcaaccgacaacacagtcatgatgctctgatggtgaggcatcggatctactgctccacaaatccacaaaactaagaccctgtttagatgggactaaacttttaattccctatcacatcgaatgtttggatactaagtaaaaatattaaacgtagactattaataaagctcatccataatcttagactaattcgcgagacgaatctattgagcctaattaatccatgattagcctatgtgatgctacagtaaacattctctaattataaattaattaggcttaaaaaatttgtctcgcaaattagttttcatttatgtaattagttttgtaagtagtctatatttaatactttaaattagtgtctaaatatagagactaaagttaaatccctggatccaaacacgacctaactcaagtcctgagataggatagtacagtcagtctcgatttgatagggacacctttgtctcaatcacttcaatatcaaaacaaaatgcatcgtttttttctcttgataataacaaatatgcattgctatggctagtgacttggtagtgcataggaaaatgtagcatttgctgactatgcatggtgacactccgagaagttagctgcaatatggaggtgacgatgctgtcgccggttggccggcgagtgtgacaagaagcagccacgtcgcctctgcatgtgccaccttctcatcacacttctttctgtctttcttttcttcagacatgtgaagcttagcaccgagctgcaggaaattaacgtgctgcacactaatcgccgggcatgcacgatatgcgcacacacacacacacacatattattatatggtcaacggcaatcagtttataacaaaatcactgtaccatctttgactgtcaatctcggccggtcggcctacgtacttacgtcttcagatacaacggccacttcatgttcatttggctcccagcttcatgctagtggcaattagagtattaatcaagattctgccgaagaccaaccaactaatcatgcaaaatatggcaccttcctacttgctaacatgctgcatgttttagcagttgcaaacttggaaatcagctgcaagcagcttgcattacaacctgctcttcccgctgcaggtttcgtcagagctagcagacgatcccaactttgcaaagggtagtagtagtagcagcagcagcagctgtactagatacggcatattctacgtagacatatacaaatagtgcagtgcttccactgacagatctacacgtccatatggaccatatctgaacagatatactaccattgaacacgtcagaacatacatcagatagattataatttgcctagcagatgtatacaaaatgtctcatcttttctggaggggattgagacgacgtaaggagttacgaaccaagcttagcctttgcacctagaacaccaaggagagaaaaaaagttgtgccaggcacgtgcagacgttgaactttctggcaaatcaggcttagtttaagcctcttggttagcaccggaagcaaagaaaggtagctaagctaatatcaattcaagctgagctgagctgagctataggtgtctggtgtgtttcctttagaatcactcgcgtactgcttaattaaccaattcgatcatcaacaacctcattatcgaccgcaatgagatggccgtagggcagcatgtgtgttaagtactaaccttagctttagttcttcttcgtcgtcgtccctatcctgtttggttcactttgatgacgtgctgcgtgtcccaatgggtaagaggatccgtggttatccgtaggacacattgtttaggttgttgggttgtagacaatatggagtagcatcgctatggttactggctgcgatctctccagttgtattgcatatgtatgaaaaacaattctttcctgaataagacacagggaccgaaggactgtttggttgttatcttcaatttaccatggctaaggttagatatgtcaacttcttaggcaatcgtctgattcattgccacaactgaatttagatctgttcttcagagtgacatagcgttggaggttcagagacaaaaaactattcggcgaagtgcctcgcttctcatcaaatcaaatcgttataaacaagtgtgtagattaatttgactgtacttacttccctaccaaccgcatctgactgagtacttttgtcgtcccagcaattcttttacctgtaactcagaatgaccgctcttcagttcagagttcagactttcagcgtggcactcacagcgcagtttttcgccgatcgatcgatcgacagcgccgttgaaccgaacacgaatgtgaaacgtaacgcaaccgtggggccatagcgaattgcatgccattctgaattgaaaaaccagtaaaaatgggcatgtccacgtgatgcccaccatcttcttcttcccccgacctgcccggtgatgagtagtcctactactcgtgcgatgtatggatattttgaccagattccccttctcccccaacgacgaccggcacggacggcgcacgtgcgccggggtgcacgcgtcgcagagccgctagctccggccggtcgacccgccggtacggttgcacgcctctctcacgtgctgcctccctgccgacgtgaagggatcgatccggcgtgtccatggcatcactacagtacacgtcatccagccctgctcgaggaatcctgaacgtccgatcgatccgtgcaacgatcggagggtgccgatcgatcgaccagcctctccgtaccctttgaagccttggagtaagatgatacggcgaacggtcgtcgccgccgtgtgaagccaaccagcagcagctagtgcatgcagtgcaggcgtggcgggcggcggcgaaacgtggcgacaccctacacggcggcggtggcggcggccaaggtactggcctactccgtcagctccatgctccatcgattgtcgtcgcacgattagagtaggttcaatagccaactatgaacatgtatcgaggagataaaaagaaaagaagagaccaggtgtatgacaggtgattccagaggcggagttagagtcttcccatgagccggtgaaaaaaaatttgtaactaaaccttacctatttttatcatgtgtgcaccctctcaatataaatttagaaacatgtatcaacttaaactcgatataaagtaaattaaattaaacaagtgacacccccttcatttcgttatagcttcgcccatgggtgactctaagatgcaatgtgtatgacaagtgagaccatatagtatttttttataggtaactattatatgtattgactattaaattgattatagatgattttgagttattagttagatataatagtattaaactttctaaactttctcttagctgaggtagatagcgagcgaggaaaagacgcaatggtgtacacgtacacgtcgtttcctgtcatcggtggctgcttcctccgtgccgtgcataaaaccccctcccatttctgctccatctccgcaccatttttgtcatatatttaccggttgtttgcacgactacaaagtttgctccactacatcatgtttttgtggtcgtactgttcttgaggggacaggatacaaatatactagggtcaatgcgcatacataattaaatacataaatgtacttgtctctttagaggtttttaaaattatctacaatatctaaattagacacacctgtagcgatgtaagtcggtcggatcatatggtgcaaaatgttaatgattttggaacataatttcagcggttcgttgttgaaatttttcggtgcgctaccatatggtgctgccagtaaaaaaaagaaatttatttgtatacagttaaaaaataaaattcagcaaaaaaaaaagttgggggagggtcggagtagtctttaatttttgcattccggagtacaaaacacttctaagattggagaaatatcagtccttgattaataacattaattaggatgtaaaacaaggagggtaatatataataggatgaaaatggtcaacatgggaaaaatgttcaaaccatttccaaaaatatatattttttcttggaaagaaaatcgaaatggtatagtcagagacgaaaataatgttggtcctacgattgcaatggcaacaaaattacattgagaaatatggaaacataattatcggaattgaacacattggaaaatatcacattaacaatgagaagcaaatatttttttatattacaaatttaaatgatatttaagtagatatttaaaatagtaagtaactaatttaaatactttataacgatgttataacatcagcactctacaccacacaaatgttatggttattttctttattttgatgggttgtcagtacttatatgggatattctggcaatttaggttgaaaatggtacttccctctatccaagaaaatcttatatggaacatttcatagtaaaagaaatcttgacaaagagcatattttagattcatagtatgttgctagtaaatgattaggaaaatctaaacgatctatacaaatagaaattatatcatcttcattataaaatgttataatctaggatgacgagatctattctaaaacaactaatctcaacatagatatgtgcggtcagaaaattacgtactccctgtctcgctccgtttcaaaatataaacatttttaaaatagtgccaagtcaaaatttttaactttaactattaaaaaaataaaaatgataaaacatgtaaaaatgatattgctaagtcaaagtagcatcataatatatataacttttttatttaaaacatcttacttctatagatattgctagtcaaaatggtatctcgaaaactgtgtcgaatttcaaaaatactaataatttttaacggagggagtatagccaactactacctccaaatcatatataatcaatttaatagccaattcatatattagttacctataaatatatactacctattaatatccggtcccacaacttgtgttgcagctggctataaatttatagaccgttgttcatctctcttctttcatattctcgatatatgtttatagctggcttatagtctgctactgtacatactcttaccttaaataaagctataaatgtgtagcctactgtttatctctatctttttttcatcttctctctatatatatttatagctggtttaaagtatgctattgtacgtactcttaccaagtaaacatcaactcggcgtgattgttctagggtgacctatcttcatgagcggccgggcatgcagaaccaagcctatccatccatccagatttgaagcgagcattgcccctgcctgcaatgcaactttgcttccaaggcggtcaaggataccgccggcgccgaccgcaccctgccctccacctgtaaaacgccacctcttcaccgctgccaccacacctctcctctcctctcctctcctactagcggccaagctttcaaagccatggaatagtagtactagtaaaaagcatctctctctctctctctacatacatggcgcctcctcgaaaccctcatataaatataccgcgcctcgttgcctgtgcggcgcccctctctctctctctctacagactacagtgcgtcgtcgtgtcttctctttcctctattttatcaccatccaccgccccattcctgctctcttcatcttcaccttcacctagctgctgctgctgcttcttcttcttctatctgctactagtagctcgcagaaaaatactcgcctcgatcgacaagctctcgttgttaccttaccatggacatggacacctcgcaccactatccatggctcaacttctccctcgcccaccactgttagtactcattctacttcgttgtctgttcatcgatcacatgtgtgtgtgttcttggtcattttttggagtaagtgccgtgcttatgcgttggtatgtgtgtgtgtttgtgcaggtgaaatggaggaggaggagaggggcgcggcggccgagctggccgcgatagccggggcggctccgccgccgaaactggaggacttcctcggcggcggctgcaacgggggatcaagcggtggcgcttgcccgccggtccagacgacggcgccgacggccgccgagctgtacgagtcggagctcaagtttctcgccgccggcttccagctgagcggcgcggctggggcggcgccgccggtgcccgcgctgttgccggcggctgctctagagcagaccgacgagacgaagcagctggccttgccgccgcaggccgcggtggcgccgccgccggagcagaagaaggcggtggactcgttcgggcagagaacgtctatctaccgcggcgtcacacggtaagctatagctaagctaagctgagatcgatcagtctatgcatgtgtcggccataaaatctaaaaataaattcttagctagctcgtctaatttcttgcacgcaaactaatcatctcgtgttcgtgtgcatccttcatatatagattcacatgcatcatcgatcgtattaataggatttagtagtagttttttttgttaatgggagtagaagaatcaaatgaccaatatttgttcagagattttaattagggcataaaaaatccttggttatgtataggcatcggtggaccggaaggtacgaggcgcatctgtgggataacagctgccggcgtgagggccagagccgcaagggacgccaaggtcactactcaataattttactactgcattttgctagctatttgcatctaatctcataagtgcatccagctaacttcgattttcttttttgttctgtcgacttgttggcaatgcttcttctcatttatggctgatgtttctggtgtcttcgatctacagtgtacttgggtaagaaaagacacatgcatctagtctcttggccagctactagctagtagtagcagctattgtaactttgcatcgtttggaacattttaaggtgaatgatgcagagagtttgttcgatgattttacaggtggctatgataaggaggagaaagcggcgagggcgtatgatcttgccgcgttgaagtactggggtcctagcaccacaaccaactttccggtaattaactctcatgcatatatataaagatggatttattacatatttacaatgcatgcatgatcaaaatatatagctcctgattgatgcaagtgtgtagtaaaagcatgtgcatcatgcgtatatgtgtgtgtgtttttggttgatgtatctttatggggcaagctgtttataatctttcaggttgccgagtacgaaaaggagcttgaggagatgaagcatatgacacgccaggagtttgtagcttcacttaggaggtacaagctaatgatcactctttagcaatgtttaattatatgttgtgatattccatgcatggccattcatcaaagtatatatgctcccatgcaaagccattctatgcatgcatgtttcatcatgatcacctgtttttttatatgtatgtatgtagctttgttaatttatttgttcatgtcagcttgatgaaaaacttgtactggtgcatgcaggaagagcagtggattctctcgtggtgcttctatatacaggggtgttacaaggttcatatatatattggtcttgtactaatctttcacttgtagcctagctagccatgtttggcctcttgcacgtaagtctcaggtaactgatgttttgtgtgatgcaaccatgtagacatcaccagcatgggcgatggcaagcaaggatcggaagagtggctggcaacaaggatctctacctcggaacattcggtaattaagtttgtacattaatttccatgttgaatctgtcgtccatgttcattttttttgtttagcagaaatttgttaagcctttttttgttgccctcttcttcaacaaatgtatgacctgataagaaaaaatgatatcaataacccaacaaaacctctcaacatttgactaattatatctgggtgatgtttgcagaaaacacgcatgtaggcaatactttcatgcatgtaggcaatactactttcatactaatgttttctaatactagtggatctactgacaatgcaatgtcagtgtgctcatcatgtagaagaatgctcaagagttttctcgacgctaagctatacataatctttgtcattagaactttcttttatcaaagatgaaattgcaagtaggagggtgcatgcacgtgttgggcccctcattagctagcattagtcattttcttacactcaacattacaatattaagcccttgcacgtaggttccatcttaatttatgctttgcacacacagggcttgtagctagattcgtcgacatattttatgcaggtcaaaaacatctactttgaccaagatgtaagcatgcccacatttgattcgaaatttgtcatcttttgcgcgccatgcatgatggttttggggctttatgcagcaggcaaggaaaaaagaagacacaccatgcttagaccatggacgcatgtatatatctatggctgattgatttgcaaacctgaacactactgcctttcttcgttcactgcatgtagcagcccgtgtttggaatatcattattactgctattaccgcgctcggctttccacaaagcatgtgattggtgattaatttactactgccttgctgaaccggccattattattgtactatgttggatttaactaagcttgatcaccacactgggctacagtttcgtcagttgttgcttggtccaaagtcttactggtgcaacttgctggttatctataaacttactggaaggctcactgcactatgatgccatactttgttaagtacaattagctaattcaaatatgtttcatgtgacattactattcagccattagtaatttacaggtggtgttgattttacttcaagtacctaaataaaattgacaataacgcatcgttcttctgcatatgtgtggtgttcaacagctgattgttgcttgcttccttctttcaggcactgaggaggaagctgcagaagcttatgacatcgcggcgatcaagttccgtggcctgaatgctgtcaccaactttgagatcggccggtataacgtggagagcataatcagtagcaaccttccaatcgggagcatggccggcaaccggagcaccaaggccggcctagagctcgctccgtcgagctccgccgacgccatcgccgccaccgaagcgaaccacaccggcgtcgcgccaccgtcgacgcttgcgttcacagctcttccaatgaagtatgatcaggcagattacctgtcatacctcgcattgcagcatcaccagcaaggaaaccttcaggggtaggcttcggtctctacagctcaggtgtaaacctggatttcgcaaatgccaatggcaatggagccatgtcaaattgctacaccaatgtctcattacatgagcagcagcagcaacatcagcaccagcatcagcaggagcagcagcaagatcaacaggatgatcagtcacaaagctccaacaacagctgcggctccattccgtttgcaacacccatagctttcagtgggtcatatgaaagctccatgacagcagcaggcacctttggatactacccaaatgttgcagcctttcagacaccaatctttgggatggaatgatttggggaggtggcactttgcaggcaaaaaggatgaagagcctgatccctgatcagaggtgatgaggatcaagactgacatagttcattctcacacaacaacaacaacaacaaacataaagagcaggggaaaagagaggtaatgtagtagtagtggtatgatgataaagtatgatgcaaacatagtaggaagcagtatgcaggagagagatactgacaggtcagagacaggaggagaagactctgctaacaaaacgatgcagcgcaagcatattgttttattttactgcccttttacccttttgtagctttgttttcttgtgcttttgtcatcgctgagctttgtttgccgctcagcttcttttgagcttttctttctactgacatgattctgcaagtgccatgatagcttagcccatgtacaatggaagcagggacgtctctttgtagcttttgcttcttttcttttgttagatcgcctttggtagcggcccctgtttactcaagaagttgctctccctccacaagtatacaatgaaatgtactgcaggaactaaacaatataagtttttgtaacattttccataaagtttagttcctagttttcaaacaccccctaaatatttcattcagtactttaaaagaagtaaaaaaaatcagtactcatcacgagttatgcttgtactttctccgtttcacaatattaacattttttatatttatattaatattaatgaatctaaatagatatatatgtctaaatttattaacatcaacataaatttggaaaatgttagaatgatttacattgtaaaacggagagagtactgtttacgttgctgagatctgttacaggctgatggagcattatctccgtaaaaaaggacgaaacaaagttctgtaccaatattttcatcatgggccgaaaaggatgagatggtcggcctgacccacaatccttttttgatagttctcgttgcgccctggcccaagaagaatggccttcaggccggcccaactactggcctgcaggccggcccaactactatgggaattccatcccagccgaaaaaaagatgggctgcaagtgggcgggaatcttatcatctacgtagatgggagtcccgtttcggccctattatgggctgcacctacactaaacttctattctggcctaaagataatagccttctaagcaaccgtatcaacctccaagtacacatgtgttcacatgtgaatatgaagatttccgagcgcacttgtgaaacggatgactacgaagattaagttgtcgtatgtaaaatgagagagcgctattagtatataattaattaaattttaattattataaacttgataaatggatatatttaatattttaaaacaacttgaaaagtttccgcccaaaacgtatagtttaatagtttaaaaaatatactaatgtaaaataagataaaatctaaatcttaatcagaaaactgagataaaatttgaatcttaatcagaaaagaatggaatagtgccatgcacgaagtgtccacgtcaactcccctcaggctgtcgataagtagggtgactagggtgacaacgacgatcgtcaccgggcctaggtgctttgggcagcgcgaggtggcacacgataagtagtgggacactctagaatttgtcttaatcaattggataacatatattcaaataagtacttcctctgtttcaggttacaatgagttttgacttcggtcaaagttaaactgtcttaaatttgactaagtttgtaaaaaaaagtaaaatatatttaattattgatttgatgaaactaatttaatattataaatattattatatttctctataaatttagtcaaacatgaaacaatttgatattgaccaaagtcaaaacgtcttgtaaccgaaacgaagggagtagtatatgtataataaagtacattttacccataagaaagtataggtagtttttgctaatataatacataaacatgtaagaggatgtttacatatagtgacacataagcaaaactaccaatgtgtttattattcttattccacgactgatgtaaatgaaaaacactgcaaagcaaaatcaaactggtgtgtagatcagagggcatgaaattccataggaaatatcgtttccacaacacgccctctcctccatgctctgttcctttattaacagccacctccgccgccgccacagccacctccgccgccgccacacccgccgccgccgccacagccacctccaccgcctccacacccgccacctcctccatagctgggccgcttccgtccaccggagctgcccttgccatcggcgcagttaaacacgacgaacgccacgatcgctacggccgccacgaagaccagagctatgccgacaacactcctgctcacgtcgggcatggagccgccggcggcggcgaagcctgcgtccacggcgagcctgaccatatatatatatcaagatcgagctgccccgcttgttggtgagatcgggtggtaattaaagggttggagggagctaatagcttagctgtctatatatatatactactccaggtgaaacggacacggaacagcggaactgtcaagttgaaatatcttcatcgagtggtgagctaactatttctacgaaattgctacgttatactccatctcaaaagaaaaagaacttaggagagaatacatgattctctctttctagtataatgaatctgaagaatatcacacctctttctagattgtttttttttttttataaatagagtatacctgtaacctgcatgcaggatgtatataggatcattgccttgagaaatctagctcagaatggtacgttacgttattttcttgtctcctttttttctttgcgagaacaatatacgttacgtgtattacagatatatagcttgattgaccgggaggttttcatatatatctaaggatgactgattcaatcgttgtccatctagaagttagctaattggcaattgttcccacggcggctagttttacatatcagcttaaatgcttaattatctgtattgcgcgtccttgattgtacgtcatgtcgacaacgtcacgaccacgttgctgtttgaccttattgctaattagctcgatatctactgaaattaggctttgttggccgatggggacaaagtacttctacatccaaaacatgagatgcacttacactactacatgataaatttttctgcacgccgtccccttttattttcatgcaatccgtatgtggaaccgcacgagaaaataggggaaccggcgccgggttgtatcctgtacgagaaaatgcattttcccgtgtgggcatcttaatctaaccgcacgggcagtcgacttaagaagaccgtacggaaatatcgattttcgcgtgcgaacctcttaagtggaccgcacgcgaaaatactctcccttctctctaatttttttccctcccaacacttcaaaattttcatccttatccttatttcaacatatcctctcctcttctctctctcacatcccccctctttctctcatttctcccttcctctccccatctttttctctctcaccgcgagcaggggcagtgggccgatgaggaggcgccaggccgatctggcggccgccgccctccccggccttcctcctctacggagacagcagcgatgatgatgaggtggcgcgcaacggtggcggcggcggccacccctcgcacggatccagtggcggcggacctccgtcgcacagatctggcaacagcgacgggagcgggcgacggcggatccggccacggctacggcaacgatgacgaagacgggagggtggcggcggcgacgacgaggtggcgcgcgacagcagtggcggccaccccctgcgcggatccaacggcggcggacctccgccgcacagatctggcaacggcgatgggaacgggtgacggtgcggacggcggatccggccacagtgacggcgacgagagggcggcggcggcggcaacggctagggtaagggtttcgtatatttcaatattgtttttttttcgattttttatttttgcctgcaggcgacataagcacccgcacgcgaatattttcacgtgcgggtgagccacccgcgcgcaaaaatagcgattttcacaggcgatttgctccatacggaccgaagctccgtacgcgaaaatccgattcgaccgcacgggaaaatctatcgtgtagtagtgttaatttgttaactatatattaattatacattgtgttcatggaaattggctcacgatgaccacgcacagtgttaataaacctgtaatcgcgagcgacgagccgtatacgtggatcattacggcgaaacgcacggacacccatctgctgatgattcgccgcgagaagctactctctccatccaaaaaaaaaaacttaacctaagagaagatgtgtcccctcctatgtggagatgtgttccctcatagaaggatgaatatgtactacccttactccagattcatcctcctagaagggtcgtaatccagattcatcctctcctatgtccaacgccgacggccgcggagctatacgagtcggagctcaagtttctcgccgccggcttccagctgagcggcgcggctggggcggctcatgtacaatggaagcagggacgtctctttgtagcttttgcttcttttcttttgttagatcgcctttagtagtggcccctgtttactcaagaagttgctccccctccacaagtatacaatgtaatataatgcaggaactatcagaaattcttaagtgtagtagccagcttcataagctaaatattgcattccgtacttcaaaagaagtaaaagattcagtactcatcacgagttatgcttgtactgtttactgagatcagttacaggctaatagagcagatttatctccgtaaacaaggacgaattgaagttctgtaccatcattttcaacatgggccgaaaggatgagatggtcggcctggcccacaatccttttctgattgttctcgttgctgcctggcccaagaagaatggccagcacgccggcccaactactatgggaattccatcccagccgaaaaaaagatgggctgcgagtgggcgggaatcttattccccacgtagatgggagtcccgtttcggcccaataattatggcccgcactatactaaacttccattctggcctaaaagtagtagccttgggctgcgttcttcagtaagtttccaacctcactctattatttcccttgcgcacactttacaaactgctaaacagggtatagtttacgaaaactctatagaaaagttgctaaaaattcatattgatcctttttaagttttttaaactaataattaattaatcacgtactaatccattgtgttgttttcgtgtcggaggtgagagttcccaaccctcacggactcacctaagaatacagtgcacatgtgaaacggatgaatatgaagattaagttgacgtacgtaaaatgagatggggctataattagtatataattaattaagttttaattattataaacttgacaaatggatatatttgatattttaaagcaacttctatatagaaaatttttcacataacatataccgtttagtagtttaaaaaatatgctaatgaaaattgagataaaatctgaatcttaatcggaaaagaatagggccatgcaccatgtcgactcccctcatgctatcgatagagggcggcgagccagcgactagggtgacaacggtgatcgtcagcggatcgaggtgctttgggcaacgcgttaggtggcacacgataggtagtgggactctctaatatttgtcttaatcaattggataacatatattcaaataagcacatgtatagtaaaggatggacattttacccataagaaagtattgttatataatacataaacatgtaagaagatgtttacatacaatgatacataagcaaaattaccatagcgttcattatttcacgattgatgcaaatgaaaaacagtgcaaagcaacatgcgtcaaactgggatagatcaaaggacatgaattccataggaaatcgtttccacacaacgctatatatatacctacaccgctatatatctctcctccatgctctgttcccttcattaacagccacctccgctgccgccgccgccgccgcaaccaccgccacctccgccgccgccgccgccgccgcaaccaccgccaccgccacctccgcctccgccacctccggtgcgcctcctccgtccaccggagccatcggcgcagttaaacacgacgaacgccacgatcgctacggccgccacaaagaccagcgctatgccgacaacactcctgctcacgtcgggcacggagccgccggcggcggcggtgaagcctcggccaaggccggcgtccacggcgagcctacccatggtgatatatcgatcgagctgccgcttgctagtgagatcgggtggtaattaaagggttggagggagctagctagctagcttagctgtctatataggctgtgtgtttagatcacaccaaaattaaaagtttaattaaaattgtaacgatgtgatgaaaaagttgaaagtttgtgtgtgtaagaaagttttaatgtaatagaaatattggaagtttgaaaaaaaaaactttttaactaaacacggccttcacagacacggaacagtggaactggccagttgaaatatcttcatctggtggcacgaactatttctacgaaattgctgcgttgtactctgtcaaaaaaaataattagaagaggatatatgattcctcctagaacaacgaatctgtacaatattatatctctttctaggttagtttttttttttttgactaattgagtatacctgtagcctgtaggatgtatataggatcattgccttaaaaaatctagctcagaatggtacgttacgttatcttcttatctcctttttttttttttgagagaacaatatacgtcattgattgtacgccaagtcgccaacgtcatgaccacgttgctgtttgaccttataactaataattagctcgatatgtactgaaatttggcttcgttggccgatcgggacaaactacttctacatccaaaacattatacgcacttaatttgttaactactatatattaattgtacattgtgtcgatagaaattggctcatgttgaccacagtgttaaccgctcatcatcgccggcgtacgtggatcattacggcgaaacgcactgacacccatccgctgaatgattcgccgaggagctaggctactgccaggacggtgacggagtcgttaggcccatccaaatgtttgtgaaaagaaaatttttagatgtcacattaaatgtttgactggatattagaatgggttttcggacacgaatgaaaaactaatttttataactcgtctgtaaaccgcgagacgaatcttttaagcctaattaatccatcattaacacatgtggattactgtagcacttatggctaattatagacaaattaggctgaaaagattcgtctcgcgatttctatgtaaattgtacaagtggtttttatttttatctatatttaatgctctatgcatgtgtttaaagattagatgtgatgtttttaggaaaaaaaattagtaactaaaccagccaagtgctcgatcgccgtttaattctgaccgcttgcttgtacgccaagacatgatcgacaacgctgctgtttgaccttgacaattgacggtctcgatcacttttgaaaattatcacttggcgaaaagaaaatttttagatatcacatcgcacgcttgaccggatatcggaaggggtttcgaacacgaatgaaaaaactaatgtaacgctccgcttttcgtgagtcgttaaaaactaattcggcaaaaatcctaattgcgaaaattttcgttctttgtgtaagagtctaagttgtgccaaggatctcaatttaatcccgttgttccctctcatcgaaatcaaaatcctccacctcgaaaattcctcttccgattcgagtctctgaaatcaaattccgaaagtcaatcccttcccttgaatcctctccaaataattgttcccattcccgaaagtatcaaactcccactttgtttccttactcgtctccttgaacccttgtgtacaagtatcaaatttagattcaaatccccttttttgaatcccgttggcgactcctccatctcatccaaatcctaattccggaagtcaatctctcccttccttgaactcgttgccaaatctttctctcgatttcgagaggatcgatcctcatccgaatcatttccttgacctcaccctatgctcccttgaacaaatacccaagtattccttttgaatcttttccatgacttctccttgagtttcccttgatacatccctaaaccctcgagttcgaatatcaaatttgaattcgaatctactcctaatcagttttctctgcaaaagtctattttacctccctcgggtgttgtgggccgtattcccccttagcccacctccctccctcagccgtttctcctccctcagcctcgcacgtgcgttgcacgtgctgagccgagccgagctccctctgtttctccttctctctcggttctctctctctctctctcgttctctctgtttctctctctctctccctcgtcgaactccctctccccggcgtcgatttcccgccgtcgctgtttgaatccggacgcgccctcgcgtccgcgcgcgcgcgctcgcgcatggccgaccgcccggtcgccgccgcgtcggccctgccgcgcctgcgccgcccggccccgctgccctgccgtgctgcaccacgcagccgcacggccccgcgcgcgtgcctgagccgctccacgcgcgtcctgccaaaacccggaggccgagctctccctctccctcctactcccttcccgaatcggcttggagcgagcctctctttttcccccttctttttccctttcctcgaccaccgccggcgtcatcacctgtcgccgccttggctgcacgcgtcgatgaccgccagctcgctctccttgaccgccaatgtcggttcttcctccctaaaccgacattgccatctattaaaccgagcctccctatcttcctctcgttcattccctcgccaccaccgtgcccttgccaccttgctaccgccatcctcgcctccctcctccatcgctcgtgctggtgaagccggcgtgcgcgcgagaagctgacgcgggactccaggcgccgtctccttccccttccccggcccgaggccgaagagctcgctcccccgtcgtcggccgctcgtcacagcgtccgtctcggctcggtagtgcatctcccgttctccctcctcgctccctctcctctccttagctctgggtagtagtgcgagtagccttccaatagcaagctggcaccgtcccgaccgccgccgctgctcgccgtaggctcgccgccatcgccgcccaaactcggtagtagccgctcgtcgccggccttcctcggtatagctccacccaatccgactctagaaatgaactcaggaggtcgcgtagatgctcaagtccctaggaatcgagctctcgtcgcatcgtcatcgtttccctcttttgccgccgccggcaagcgccgccgggattcgtcgtcgccggcctccctccggcgaatccgatccggtggctcactccctctcgtccgtcccattgttcagatgtactccctctctctcgaatcgtcgcgacgagctccggtgaactccgccgccatccgccgtccatcccgggcgcctcctcctccttccctttcgcccctgcccgcgtggccgaccacgtggcagcaacctcagccccgggcccgcttgatcgggtcaagcacctagtcagccgcccccaccgccctttcttctgtgcgcgcggtccacggagagcccttaggcttcgcatgggccctccacctcttggtccacccgcgtgccacgccgtgagccgcgaccgcaaaaccctagcaccccgcgccgcatgaacccttcccccgtgcgccgagtcgctgactcgtgggcccgtcccgggacccggcacgatggatccggtccacccggacccatccccctctctcctcccgcgcgcccacccgcttgggccgcgcgcccacccgcttgggccgcgccttgcccggccatgggccgcttcctcgcgcccgcgcccggcccattagctcggccgcgccgcgcttattccttgggccgtacccgagccgccaaaggaagtctaaatcccatccctccttccttttcttatccaaagggattaataaatccttttccctttttcataaatcaattccttattcccaaaattccataaatcatttccttggtcccgcacgtcagtgacggtcaataatattcttgagaatattatttctataaatttcataaatcaatttccccttttccacaaatatcttcctttgcccagaaattccaattaaacttccaaaattcatatctctcaatccgtagctcagattgactccgttcaacttccagtatttccataaaattgagatctatttaatggcagtactaattagtctaaataggatctttcttttggtcttttgtttaggtttttgattgtttgcgtatagttacggttaccagattttcgtcgatcgcgagttttctcgaagattcgtgaagcttcgtgaagaccttgagcaaggcaagtcaccctttgaccaattgctcctataattggaaaatcattattattttgtttgcaacttgcattattagaatcacacacttaacttgcttggcctcggtttgcgtgccaaaccgacggacctacccagtagtcgcactaattcctgtaggttgtactaccctgatttccttgtcgctccacctttgtggtacctcggtatccgtgctctctgagcgcatataccaaatatcccacatacaccgttgtttgtcgaaaacttgggaaatgggtttgagaagccttgaaaacccgacatgtggcgtcggtgtgttggaaaataaaatggattgtgaaaactcgcgatgcgggggttgtgcttgtgtggcactgtcccgtattcgcatataagtaccgattcctgtgggaaattcatccgagcatataacaagtgcgaccacacgggtgcaatgggacgcccctggctgagtaattagttaatcgggggagccatgatgccaagagacatgtggattcaacggggtggtgtcggggagaaccctcgggcttcctggcacagtatggtctgggacctaatctagtgttggtctgggacccctctcgttggcatatggtgaacctgtgtcggctttccaaatgccttgtcatgaaagccttaaggtctcccgacgtggctgatctcacgggctgggtgatccgggttagtaatgtcgtgtgggtaaagtgtaccccctctgcataggttaactaactgttcgaacagccgtgcccgcggtcatgggcggatgtgaggtgtttcctgtagcgtagatttgtttgcctatgctttgtgaaaagttgttgtggtgtgggaatcgttaccagaatcagcctatgtggcagatggacgacctgagtggtcaagaaacgaatctgtgtaattcgggatgtctatgggcatcatagattaggcttcccgagtggaagcggattgttgtgctactgggcagctggactctgggagtccgagaaaatgaaaaaggctctgggaaccgattaatcaagtggaatggctctgggagccgagaagtaatgatctgacccgggaggtcggtacattaccaaatgagctattgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaaattctcgtgacttgctgagtacgaaagtactcacccttgctctatataaatatatatatatatagttcctctgccttaaagagaagatgaagtgaagtgaagaatagggtttcgtcctggttcccagccgtcgcctgtggtgttgggtgttagttcgttggttccgctgctgctgctgttgttggtgttctcctcgtccgtgtcgtcggttgcattctcgggctgtctgagctgcaacctaagttaaggtaaagaagtcatctatttattttaaggattgcaatgattcatatttgtcaccgtggtaccagcgctatgtcctgggactggtactgtgatcgcggtttcgtaggaagcggtttgcgccgtttttcctacgacatgctcctatcaggtgccattatacggcggtgccagattggggtgtgacaactaatttcataactcgcatggaaaccacgagattaatttattaagcctaattaatccgtcattagcacatgtcggttactgtagcacttatggctaatcatagactaattaggctcaaaagattcgtctcgcaatttctatgcaagctgtgcaattagttttttattttatctatatttaatgctacatgcatgtgtctaaagattcgacgtgacgtttttggaaaaaaaaattatgaactaaacaaggccttaacctatcgaagtatctttagggtgtatttaattccacgctaaaattggaagttttattgaaattggaatgatgtgacggaaaagttataagtttgtgtgtgtagaaaagttagatgtgacgttttttggttcaaactttgcaactaattaaacacggccttacccaataaataatttgcacctcatgttcttacattgtccatatatatatctttttaaattaacagcacaaaatgcatccaataattaaactgatcatatataaattcaaactgagacaagaagtaatactcaaccggacaacctcgaggagctatgattttttcacaatctattacattcgtcgtaaaataaatatagccgtggatattcatattcaacgtttaaccgttcgtcttatttaaaaaaatttaaaaaagtgtacatgttttatcatctaataacaataaaaatactaatcataaaaaaatcaaataaaacgaaaaccaaatgttaaacattaacaatgtaaaactacaattagtattaaggaatgacaaaggatttttggaggaatgagattccaaagaattttttccttcaagcctctttgatcataggaaaggcaagtataaattccatatgattgcattcctatgagtggattccaaaggtaacttaaaaaaagaggtcagacctcttggaattcttctaggcgcagattcctttgttttccctatgcctctatcaaagggatcttcttacgtttttctctgttttctcttcctgaggatttcaaaatcctaccacttcaaatcttgtgttttttctaatcctgcgtttttcctatcctgcgaatcaaagggacccttatttgactatgaaggtagtcagagtatctcgtgttacaaaagttagtcaatatagtggaacgacgactaaccttcctgatcgcttttagtagtggcccctgtttactcaagaagttgctctccacaagtatacaatgtaatgtaatgcaggaactatcagaaatttttaagtgtagtagccagcttcataagctagtattgcattcagtactttaaatgaagtaaaagattcagtactcatcacgagttatgcttgtactgtttactgagatcagttacaggctgaaagagcagatttatctccgtaaacaaggccgaaacgaagttctgtaccattatttttaacatgggctgaaaaggatgagatggtcggcctggcccatccttttctgatagttctcctcgttacgccctggcccaagaagaatggcctgcacgccggcctaactactaggctgcacgaagatcggaattccatcccagcccaaaaagatgggctgcaagcctacaagtggaagggaatccattctggcccaacttgtatgagcaccacgtagataggagtcccgtttcggcccaataattataggccggacctacactaaactcccattctgacctaaaaataatacgccttctttggaagccaccgtttcaaaagaatttatgggtgtttgttggtaatataatacatataaacacgtaagacgatgtttatatatatataggaggtctattcactttgatgtcatttttaacattatcaaattttggtaaagttaccaaaaaaaatatctacatttagttttctgtcaaattttggtaattatcacaaaattttgacaataccaaaatttagtaaggttgaaagtggtatcaaagtgaataggcccataatgatacataagcagaattaccaaagggtttgttatttcacgactgatgtaaatgaaaaacactgcaaagcaaaatcaaactggtgtgtagatcaaaggacatgaaattccatcacctacaccgctatctctctcctccatatgctctgttcctttattaacagccacctccaccgccgccgccgcaaccaccgccaccgccaccgccacctccaccacctccacaggcggggccaccgcaagcactacctccacagacggcgccaacgccaacagtaccgcctcctggattggtgagccgcttccgtccaccggagctatccatgccatcggcgcagttaaacacgacgaacgccacgatcgctacggtcgccacgaagaccagcgcaatgccgacaacactcctgctcatgtcgggcacggagccgccgccgccgccgccggcgaagcctcggccaaggccggcgtccacggcgagcctaaccattgtgatatatcgatcgatcgagctgccgcttgttggctgtgatatatcgatcgagctgccggccgcttgttggcgagatcgttcgggtggtaattatagggttggagagagctagctagctggctatactagcttatcttcactgacacggaacagcggaactggccggttgaaatgtcttccatcgagtggtgcgaactactccctccgtctcaaaatataacaactatatgcataatataccttttatacactagatgtgatgcattctaccctgtccagatttgttgtcataagatgcgtcacgtataggacagaacgatttacattgtagaacggagagagtacgaaatcgctgtgttgcacctgtagcatgtaggtgcgccgcaggcagggttaaacctttcggtttagccgatttgatcggactcaccggaatgccaaaattttagaaatttccaaaattttgaataaaatttagttgaacttgaataaatatcaccaaaattcacggaaaaaattaaaaaaaaataaaaatttcaaccaaaataatatagtatcggaggggtctgaaatgaccgcggaaatttcgttccggaatttccaaccctatgtgctctctctctctctccataaaaaaccaaattctattaatgtatctagataatgtgtctagatttatctttaggatttagtttttttatggttcagaatggatacactacgttatcttcttcttcttctttttcgacaacaatatatgcgttacgtgtattagagataggttgatcgatcggttttcatatatatctaaaccaatcgaaggatgactgattcgatcgttgtccatgtagaattaactaaggcaattgttcccacggcggctagttttatatcagcttaaatgcttaatcatgtgtagtgcgcgtccttgactgtacgccaagtcgccaacgtcatgaccactgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccgcatccatccacttttagttctcgtgcgctacccccttttattattgccgaaatcatgtttcgacagttggcgcgccaggtaggggttgcgtcgagtttcttatcaacaagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcgtactgatttttaatcccagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccgccggcctgcctccgtcgccgccgattggtgcctccgcctacacggctggcctattatgccgccgctgttgggcgtctacgacttcaccgccggcctgcctccgttgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacaactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggctgcctttgggccgattcctagcacccgggggctcgttggatggaccgagtaacgcaaggtgctaagtattattcggaataaatcaaaagcatagagataagataaattcattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttacctcttacgctccaggaatggatcagtcagaacatcaccaccggctcgcctcgaccgccgctgactggtgtttccgcctgcacggctggcctattatgccgccgttgttgggcgtctacgtcttcaccgaccggcttgccttcgtccgccgccgactggtgcttccgcctgcacggctggcctattatgccgccgttgttgggcgcctacgtcttcaccgaccggcttgccttcgtcgccgccgaccgatgtcctcgcctgcacggctggcctttatgccgccgttgttggacgtctacgtcttcaccgaccggcttgccttcgtcgccgccgaccgatgtcctcgcctgcacggctggcctttatgccgccgttgttgggcgtctacgtcttcaccgaccggcttgcctttgtcgccgccgaccgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcatctcgtctgctgctgactagtgccctcgcctctacatctggtttatacagctaccactactgatggacatcatcgtcttccgccgccgactcgtgttatgccgccgccgaccggtgcttttatcttcacaactgcgtcttcactaccggttcacttcatcacggcaacacaactttgtcatcatggtggagcgacttcatctttattatcttcggaaccagcaaactctattgctgctacttcacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttagacgagttgggcaacaacatcaactctcctccaagtgaagcatctacaacagctataacattaatttgatggattattgtcactgacatcatcaccagcacctctgcttcatcgaccctgacatctctgctgttgctaatggatgattatgttttcgctgacttattatttcaccttcacggttgacctactatgcaaatgctgatgagcgtctttgtcattatcattggttgctacactgctattggctggatcaccgacatcgtcatcttcatcatgtcggttgcgtttgttgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatgttctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatct

SEQ ID NO: 60650 - DNA, 16324 bp, Oryza sativa
ttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggactaaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacgaagatgattgaagcactcggccttggagtaatctagttcgagagaaggttatctttccgactgtgaaggtctcaggggctactgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcagatgagacaacctgatcgtcagatcaatacacacacggcggattcaaatccccaaacaggagtagggtattacctctcattgagagggcctccctagtattttaatatatgacgccgttgactttttgataaacgtttgactttccgtcttatttaaaaaaattatgtaattataatttattttattgtgatttgatttatcatcaaatgttctttaagcatgacataagtatttttatatttgcataaaaattttgaataagacgcgttatcaaacgttgattaaaaagtcaacggcgtcatacattaaaatacggagggaatacttcctccatttcacagtgtaacttattatagtatttctcatatttatattaatattaatgaaattagatatatattgtgaaacgggggagtagctcgatatctagtgaaattatgcttcgttggccgatcgggacaaagtacatccaaaacatgatatgcacttaatttgttaaatatatactattaattatacactgtgttcatagaaattggcttgaccacagtgttaattaaccggccatcgccggcggcgagacgtctggatcattacggccaaaagcacggagccacgcacacccatccgctgatgattcgccaggacggagtcgttaggcggttaggcccagccgcccagccggctgtgtttaggccatgtttagttccacccaaaatcctaaccttctgttacgtcacatcacatcgaaaactttcctacacatataaactatcaactttttctctaaactactaactttctcacagcttcataacttctccaccatctaaacacacccttaattagttcacataaaaaattgaaagtttggttgaaattgaaatgatgtgatggaaaagttggtagtttagaaaaaaactttgaagtaaacacggtgcaaattaaaatgctcgatcatatcgccgcttgattctcaccacttgcttgtacgccaatccatgattgacaacgttgctgtttaacattgaccttgtctcggtcacttttgaaaattaacctgacaaagtacctttacccaataaataatttgcaactctgttcttacattgtccacgtactccctccgtcccataagggattttgtagcgcccgttccgtcgtggcgcctagcggaaaaattatctcctaaaaatcctaattgcgaaatttgtttcttcgcttgtcgtctagtgtccgtgccgtctcaagatctcaaatccccgatctatcgtcgagttcaattccgaatccaaatccttccaaatcaaattcctccgcaaaagtctagtttgcctcccccagggtcgatgggccgaatctcgctcggcccatctctccctccctccccggctctctctctctctctctctctctcgctccccctccgctccgcgccgcccgcgcgccgcgcgcgtgcgcgtgagccgctcgcgccgagcgccccctttcccctcgctctccttctccccatccctggcaagctccccgcccgcgaagccggctcccgcgcgccgttgttcgcgcgcgcgcccacgtggttccccgcccgcgccgagtcgagccctcgctgctgctccccgcgcgtcgttcgcgcgcgcgcccgcgtggtcctcacccgcgtcgcgtctgcgccgcccggccccgctgccctgccgcgcttgctgccgcgtagccgctcggccccgcagccagtgcgcgtgcccgagccacgccactccatccgccgcgcctcccgttgcgacccgcgcgcgcgtgccgtggtggccgaccgcccggtcgcctccgccgtcagcccatgcacgcacctgtcgcccgtgtcgtcgcgccgctccaaaccgccccgccgtcatcgccgtcgtcatcgcctcggccccgtcactcccgcgcaagccgccaagggacggaggcagagcctccctcctccctctgccgcgacgccccgctccctcctccttttcccgaagaggcaaggggacaagcccctttctccccctccttttcccccttttcctcccgccggcgtcatcctccctccctcctgtcgccgttttggccgctagccggagcgccagctcgcgccttgaccgccaaagtcggtttccaaaccgacattgccgccccctataaacccgagctccctccctttttcctttcctctcccattcgcctccgcgccattgccgccgcctcccgtgctctgttcgccgtcgccgttcgtcgttgcgcgtgtcggaagagccggcacgagcaaggacgcggaaggggactctgggcgcaccctcttcttcctcttcctcggcccgaggccggagagatcactcccgcgccgtcggcctctcgtcactgcgcccctcctcatctcggtagtgcctctctccgttctccctcctcgctccatcttccccccttagttttcggtggtagcatgagtagcctccccgtagctagccggcgccgccccgaccgttgccgtcgctcgccgtgtgctcgccgccgtcgccgctcgagctccgtagcacccgctcgtcgccagcctcgctcggcgtagctccgcccaatccgacgctagcatcggattcccatggccgcgtggatgctctcaccgccgggaatcgacccctcgtgacctcgtcgccgtttccctcttccctccccgccagttgccgccgccgcgattcgccgccgtcaagctccctccggcgaatccgagccgttggctcgtctcccctcgtcacgtgcaaccacccggtgtgctcgcttttgcctgtatcgccgtgggttgctccgtcgctcgccgctgtcgaccgccgtccgttccggccggcgtcgtcgtctacctcccgccggcccgcgtggcagccacgtaggcgccacgtcggcgccagcacagccaaggccgggtcgagtcgaccccggtcagtcccttcccgtgcgcgcgttccaccgcgagccgtgaggctgcgcgtgggcccgccgcatccgcgtccaccgcgaaccgcgcgcgtgcaccgcgtccctcccccaccctagcgccgcgccgcgtgctccctccgcacggtgagccgagccgctgacaagcgggtcccacccgggactgcgcgtggtgagcccggtccaccggccctctctctcctcccctcccgcgcgcgcgcttgggccatcttgggccggccggcccatttagctcggccggaccgccccatctctctcgggccgcgccctagccgcccgaggaaaagtctaatttccatccctcttttctttcttttcttttctttttcaaaaaggatttaattaaatccttttcctttagaccaaaaatccaataatcttagaaattcaatatcttcccaaccgtaaatccgttcgactccgttcaacttccaaaattcctcaaatctcgagatctatctaatggcacgcttagaggtcattaatagggctttattttcgccgtttgttgagttgtcccgtttcgcgtgtagtctcggagcccgaagacccgcagtgcgaggattgcgaggatcaagctccagatctcgagcaaggcaagccacctttgaacatcttgagcctatatttgaaatttaattatgttgcttgaaaaatattatgcattgataggatcgcactttttctgtcgtcccgtctgcaaggcagattggcggacccacctagtttgttgcatttgatccttcctttgttaattgttataccttgtccccttgtaaccatctagttgcgtctcgatattcgtgcaccctgtgcgagtatcgacggacgccttcaaacttaaaaatctgaataacaacttgggtaaaacttgggttttacaaaagatttggaaaacccgacacctgggtcggtgcttgcgaactaaatgaatttccaaaaccgcgggccggggaacgtaccgggtgtacggtttcccgctctcgcacttaaggaccgatttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggataggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacaaactccgaccggacgagacgcactgtctcaaccgtgtcgtttgagaagcactcacctagttgtttttagaaaagagttcaaataaaatcaattgcaaaaacaacagcctttcttcgaagcctgcattaaacacttatttcccatggcttgctgagtactcccgtactcacccttgctctatataaatatccccccctcagttgctgaagaagatgaagcggattctgttgatgaggagttcttccaggagcaagccggctacgatgagttttagggtttcggcctagttcctaagtcacgcctgtgttgattggtccaagtcctggcttccgtttcccttttgtaatgcagttgtgagctcgggatctgtccgcagcccaacatgactgtacctctactctataataaagagacctctgttgctgtgatattctgtcttcctgtgataccagcactatttcctgggactggtatcgattaacaggttaatttagagcgtcacgggctagttccggtcggtactagttcggggcgtgacagattttaagtttttgattgcaaaatttgaccactcgtcttattcaaattttttttacaaatataaaagacgaaaagttgtgtttaaagtattatagataataaagtaagtcacaaaaaaataaataataattttaaaaatttttgaataaaatgagtagtcaaacgttgcagacaaaaatatcttttttaattaaggctgtgtttagttcatgaaaaaaaattaaaagtttggagaaaaagttaaaagtttatgtgtgtaggaaaattttggatgtgatatgatggaaagttgaaaattgagggtaaactaaacacggcctaacagtaaaaaatgcatccaataattaaactgatcatatatacataaatacaactgagacaagaagtaatactcaactggacaacctcaaggagctctgattttttcacaatctatctcatattataatgtacataatggcaacatattagtagcaagcaacacgtacagtggccgagttaactcccgtgacgtcagaacccaccaccaccacccccgccgccgccgccgccgccgcagccgccaccgctgaatccgctgcttgccccatggtcaccggagtagtggtgcccgccgccgccgccatggtctccgccatggtggtgccagcctcctccaccatggtctccgccatgcccgtggtgatggtggtgcccgccgccgccgtggtccccgccatgcccgtggccatggtggtggtgtccgccgccattgtctccgccatgtccgtggccatggtggtgatgcccgccgtgagcatccgagctagcagcgaaaatgcacaaatcacaacaagagagatggaattaagcactgatagcacacgtgttaactcgttcttacctaggctggtcgccgccgccgccatcaccgccatcgccgccgccgtccggcccgtcgccaccaccatcgcctccgtcgccgccgccaccatccccgtcttccctgcggcggcggcgcttatctttcttccttcttgggctgtctttaggcccgtcggcacagccgaacaccgcgatcgccacgacggctaaggccgcggcaaagccgaagccgatgaggatccaaccggcagcaggagcagtagggacggcgccgaagccattgcccgcagtaacagctaacgccctcaccattgttaccgagcaagaagtgtctagctagctagcactgtgttcttgcagcagcagcagcaagcgagaatggaagatggataagtagcacacaagcttaaagtgcttctgttaattaggtgcaggaaaaattaagcacgcatcttatgaagtctcgacgcgttgtttctaaaaggatagcgaatggattttccaaactttgctgagaaattgtgttcgatcagtagtgccccagaggatatcgtcaaaaaagtgtgaaatgagctaaggtcaagccttcaatgttgacgaagagtttgcgatgataaaaacggaaagtccgcagctagacgacttctaattcagagtgtgtttagttcacattaaaattgaaagtttggttgaaattggaacgatgtgatgaaaaaattgaaaatttgtgtatgtaagaaagtttcgatgtgatggaaaagttggaagtttgttaaaaaaaattggatcggtctgaggctgcatacgcgttcagaagttgcacagaaactggctcatcttgacccatgggcacagttatcgccgccggcggcgagctatccgtgtgattacgccgaaactcacccgccaccgaccacgcccacagatgataattcaccgaggagattggacggtgagtcatcgcgatgaggcccaggccaaatgacccagggggatccacggcctggcaagtttttcctcgatatatgggccgaaataggcccactctatcggcctactccatcacataaagcccaccaaatgagacggcgatatgtttgaaaaaaattgcaccgaatgtctctcaacttgtcatcgagttaaaaaatcgttccccaaccgcaaagccagatatatgatatccttcaactttcaaaaccatttactttagatccttaggtggttttgaccccggtttgtccgacgtggcggctgagttagcgtaaggatccacgtgggtcccacatattagggtgaccacgtcaccacccaatctttttttcccctcttctctcctatcctcctctctctctctctctctccgacctctctgcgtaggttggccgtcgggtggggaggaggttggcggggctaggcgggagaggagggcgtcgacgacagtggtgacagcgacgatgctggagaagagaggaggccggcggggtgaggagggagagaaggtccggcggcggtggcaacgatgcaggagcaggccattgcgccgggtggggaaccggctggccgatctcctctccgtcgcccttccccgcgcgcatcggtgacttcgctaccgccaccgtatcatccctcggccctcctctccaccgcgctcctcccttgccagctgccgaccgcggtgggtagggagccggccagtcgatctcctctccgctgctcctttcccgttggccgtgccgaccctcttccccgtcgccggccctccaatccgccgctccgcctgtgccaccgtgcatcaccgcctcaccccgacgacgacgtgtgaccacagcaatggcgccgcacggcacgtagagggggaggaggagggcaggcagacgaccgccgcataataaagaaaaagaatgaaatgaatatcaggccagtccaacaatatttttataatgagtgtctaggttgattatttttctatattatggtatttataagggtagaatggtcatttgattattgttcttgcatgtgaggatgaaatggcatacccacgtgacgttttttttttgtttaaaggactaatgttatgctagatgataaattttaaacatttgtttgtgtgtttcttatcttggtcttatcacttttataatgtttgggtgtgtttaattctatttgaactacactttttgttcgagtgttagattgtaataattggttgtaactctgttgagtaaagaccgggatgttaactattctattattaaaaaaaattattgaaacgtcaagcactaaactaatcctgaaacttcatggattggctattcaccctaacaaaaataaatgagctgccgcacacaaagtacagactaatggtcatgtcgtgatgtatgccacctatatatcccaagttttaagtgagcgtgcaggtcagaagaaaatattagatatgggagaaaccctaaataatctaatgtattatgttgtattgacactgtaatgataggtatatatagagagagtacatatgaggtagatacaagttagaatatacttatctttaggactcccttttatcagtacaattcgtatttaaactctttatctccacctgtacacaactatagctactacggccacggcaatggcgccgcacggcacgcagagaaggagaaggagggtaggcagacaaccgatccgtgcaacggtagccatcggcggcgccacccgtcgcatcggctatcctgtccactgcgctcctcccctgccagccgccaaccacgctggccctcctccctgccgcgtcgaggacgccgccgccatcaacgcctagggggaaaatgagagaggaagggagagaagagggaaaaaagagagagggtggtgatgtggtcaccctgacatgtagagtctacttgggtcccacgctgattcagccgttatgtcagataaaaccggagtcaaaaccacctaaggacctaaagtgaatggttttataagctgagggatgtcatatccctggttttgtggttggggacgattttgtaactcgatgacaagttgagggaccttcggtgtactctaatgataggtatatatagagaaagtgcatatgaatatatgatgtagatacaagttagaatatacttatctttaggactcccttttatcagtacaattcgtatttaaactctttatctccacctgtacacaactatagctactaacacccacctccgccgccgcagccaccgccgccgccacaaccgccaccgcccccatggtcaccggagaagtggtgcccaccgccgccatggtctccaccatggtggtgccagcctccaccatgatctccgccgtgctcgtggtgcccgccgccgtcaccaccaccatcgcccccgtctggaccgtcgtcaccgccgccgtcatcgtcccggcggcggcggcgcttgtccttcttcctttttggtttctgtttaggtcgatcggcacagccgaacacggcgatcgccacgacggctacggccgcggcgaagccgaaggcgacgaggacccagccggcggctggagcagtagtaggcacggcggcgaagccattgcccgcagtaacagctaacgctctcaccattgctacgtgagcaggaataatcggctaataaccttttcttcttgcagctgcagataattaacgtactctcaccattgttaagtacagcacaagctcttgtgttacgtgcagaattggagagagagagacattgtaagattcaacgcggttttctgagtcgtagagaggaattggaggagttgtacagactcttccttgaggaaatgtcgtaagcgtgtgaaatgagatcatatcagcctgaattgctgacgagtttgctactatatataaacagtggaatagtcaataagtacatctggcagctatacgacttttcattcaaccccccagatcagatcatcaaatgtctgttcacagaagttgcacagaaactgggtcgagctcatcttgaccggcggcgagctttctgtgccattacggcgaaacgcaccggcgccaccgaccacgccaacagatgattcaccgaggaggctagtcccagaacggcgaggccgtgccatgcggcccagcccaaataacccatggcaatcacgtccgcaactgaaggaatctgtaatagcaggtgatccattaaatctgagccacacagcctgatcgaacggctgatagagatcctgggggttgggagttttagactccgaccccctcgaacacccaaaatcaccgctctgtccaatttaccagccgctgacagttcgcgaggagcagctgatcaattaatctgagccgtacagttcgatcgagcggctggtagagacccatgggggttcggagttttgaaccccgcgcgacccccattcgcagccggaaatccaccactgcgcgtctgcgcctcatcgtagctctgccgagatcttggctgcgtcttctcccttctcctgcctcatcgagctccatatggccgcactccatccgtccagcgcctgcaattctgaatttcagatttagaaaccgtgcttcacatcgctctgcaaaggagacttaattcctgaagccgattaagaaaccgatgattcagaaagagaagaagacacagcaatgcttgggagtttcaccattgtttttcagacgaaccgaacgagatgaaaatgaagtatcatcttgttgcttgctgatctttttacagcgagatgatacgtggagtttcagtaaaatattcctggtctgtccctgatagtcagataagagcttaacaaccaaatctttaatatgaagatgctccttgggtatttgcatgctagctgtttgcagcacgcaggagaggaggaccagcgtagcaagactatgcgctattgcatccatcgtctacggcataacaattgtctggacattgctgctggatacctctttgtacctcttaaactgtaaaatttctttggaagacttagcgcgaaagtctattctgatcactagatacaaacaaattaacttgaaaaaaaaatatgttggcgtacaacaattgcatgctcgtaggagcttagcgccgtaaataatcattgtttttcaactagaaattacgtaaaagagatactgtaagctgcttaagccaagatgaaaatggaagaggcgaatttgatcgtgagtcaattaaactgtactgttattactcactatcactgccatagtagtgccatgcataatgaataatccataccacgaatcttgtcttgatcaactggatccgtcaattaacctccgtctactctccacctcctcctccgtctgcgcctccaccgccgtctgcgccgcccccgcaaccgtctgcgccgccaccatcgccaccgtcatcgccgccgccgccgccaccgccgccatcaccacctccatccccgccggcgccccagcaacaacaacaggtggacctccgggatctgttcttgcggtcggcgtatccacaaaggagaatgaccacaatcgctagcacgaacacgacaatgcctgcagccgaagcagcagcagcattggacgtcgcgttgggcacgagaagatgttgctcgctagccatttgtatgatctcttcgatcttcttcgtctaattggttgatgattagggataaaattaaattaagctgcaagctagctcgatcgagtggtaattatatagagaggccttccggcgcattaattatgttttctccgactttgcactctagactggtgctagcgtgtagcgccttgcagatgtgtgctggatcgatcgatcactggagacgacgtctacgactttgccaatcgatcccaatggaaaattggaatgcattggtaggatagaacatgggccagtgtggatgctgctgaccttgacttaatttaatcaagctcagcctgtatttgtatactgtctacgttgaccatgagaggggcagagatcagcttcacatgtatacgcccgacggcctgacattgtttcagcccaactttaacgggccggacgttccttgccttttcagcccaactatacgggccgcatggcccatatgagaatatactggactattatgcgtacgtcgccttcctgcggcccagttttagtggtttgatgattaagatccggaataagttcactttgtaaccctgaaaaagtaatcgaaatctaatccgtgaccctaaaccacaaaaccggatatctagacccccaactcttaaaatcggtgcaatttgactccctcaacagttttgaagggtggttttgctaacgtgacgcctacgtgacaatattgactcggtcttctttgcacatggcattgacgtggcacttaggtggcattagaaataaaaaaatatgtgtgggacccatttatcattcaccaaaacataataccacaaaaatgggtgggacccactgacatgtgggcccacataaatcatcctctcttcatcctccccccccccccccccccccggcgcgtcttctctctatctctcttcatcgcttaatttagctgtagctccgcttgttgatccgtagctggcggatctgcttcctctatcctccccatcggaattgttcgtaccgtcgcggaggcgctgttgcattctactgataccaagattacaactacagcaagatcggatgagagagctagctgctgcctaattagtttcgagatcaatgagagttgctagctggacagggtggttacgtacgtaattatatatagggttagatcgtacgtggtgtgtacgtgcagaactgaagagtatgttataatgtcaaattccatttgctatcacagagagtataaattttatccgtcaggtttgtgcttcgcgcttacggaaccagccggccgtaattaaagtactgttagcttctctctttttttttctttacacgaaactttatcatgtactagagaatagatagattcactgtacaatgctgcaaaagtatacagtaatactccgtattttaattagatcgctggagacgatttcgcaattcacggattgatccaagtcgacggatggggaaaatgtcaggaaagtggttcgcgctttgcttgtcacaccatttcggcccaaccaggcaaccacgcgcgtgggccgtgccaccaggggagcgaacgtacgggccggcccgcgcgtggccgctgggctgacgaagcgcatcgatataggaaagatcgagttcctccctttaatagcaaaaccgggtataacgtatctcttatcatttaaaatcagtgtattgaaagcagttttggcttacgtggtactaaagttttcatctaaaaatgttcagattggagaccacatagccttgcaaaaacattataaagcaagaaattgtgtactacttctacttgattaggacttttgcctctactgaccaaggtttttgtttcttcgcgaggaggcgcagtagaataactggagaagcatcacaaatctgtatatacagcttgctcttttttgttcttttgcaaaatcttgatttacattatctacacttagatcatggttaaagctggactactggagttgagaacaaaggtaatcttgtcatggatatttatattttgcattagaacagaggcaatcttaccatttgggtgaaaaaaaagtgaatatacattttctaaatttatatttatatacatgtttgtggggggaattatgaaaatatacatgtttataaatgcagacgtgaaaatattacgcggcataatattgaacagattgaatccggttttaacaattgaggaattctctatatttgattttgcggttgaagaatacgaattaaaatgtgtctatatatgaggcatgtaaaatgaactttttttctggaaacaaatactgtcgttggacaaaacaaaggttgccgcacgtggatggcaatcacgtccacaccgcaagagccgtgggaaatcgtttcaaatgaagagctgtcatagatagacaatcatctgtgagactgtgatggctcttgatcctaatatatctcttacggtagatttaagcacccgtcacagatataattatttgtaaccactctctaagagagccatcattgataactgtttttttttcatttttgttacatcaaataagttgatcatgcataatatccaagacaaacccgttatgaaatgatcttacctcatcattttttatgcagtttgcaggcataaatggcatcctctactatactcctgaaatacttgagcaagttggtgttggaggttttttctcgaagtttgatcttaattagttcttctacatctatacttttaagtgccatcgcaaccttagtgatgattccttgtattggtgttgctgtgccgttcgtagatacgaaaggaagaaatttagtattctaatatttataattactttctccgtttcacaatgtaagttattctagcatttcccatctagacattcattaacatcaatatgaatgtgggaaatgctaaaatgacttacattgtgaaacggagagagtactacttattgtcattatttaattaaaaagttaaagaaagtacaaaatggtaatttttctccctcgcttcatgcatgcaggcatattctccttggcacgatacccattctgctattatccctagctattatgcttgttgctaatattatgaatatgagcactgatttacatgctatcacctcagcattatgcgtaatcgtttatcaatgtgtttttgttatgggatttggccctattccaaatattttgtgtgctgaaattttccgtatagtccctcctcattcacaagatccatggatacccccggagcaccctcttcaatttttttcaccatgaatgataaactaaaggtccctaaatagttggaggttgaagaaactgtataattgagcccccccccccccccaaaaaaaaaaattctgttcatggatccgaccatgatgcttggtaatatgtagcctagcattttggatttgtgataccatcgtcacatacacttttcctgtgttgatgaatgcgattggtcttgcgggtgtttttgggatctttgctactgtttgtgcactagctaactatttgtatatttcaaggtgccagaaactaaaggtatatacctcttgaggttctgtcggagtgttttgcttctaccaacatctcatccaaagatgattcgaaagaagataagtaatactccctccgtatttaatgtatgacgccgttgacttttcgaccaacgtttaaccattcttttattcaaaatttgtgtgcaaatatgaaaatatttatgtcatgcttaaagaatatttggtgacgaatcaagtcataataaaataatgataattag

SEQ ID NO: 60651 - DNA, 28453 bp, Oryza sativa
  unsure (1)..(28453): unsure at all n locations
gtaggacggattttattgcaatgccatatattgatgtattttttgctatattattatgtattaaatttgtgaaactgtcatatgttttgtgtggtggcatctgtacatgtatctgtacttgcctgtacatatatgtacctgtgttgtctactatgttctaatctactttacatacaaccctttgcatgctgtccaaattattggtatacatctgaattacattatttatacccagttagtacagttttttttcctgttttgccatgtgttaactaattcaatcatatggtaacctttcgtatcgtgcattagaaactactccatccgtttaaaaaaacgaatctaggattgaattattttactacaacgaatctggacatatatttgtctagattcatattattaggatatgtcaaatccaattctagattcgttttttatgggacgacaagaataattaactatttgtcactcttacgagtggtgctaaattatttgccactggacccacatatcatagacacatgagggtccacatgttatatacagcgagtggtaaatagttaaatgtcccagactctactactaattagcatgcatctagagagcattggcagcctgagtcgagcagctcactgacttgcttccaccatgtaccgagagctgaacacgcaaaatcacataaaccacatacaggcatggtttagtttccaactttttcttcaaacttttaactttttcattatatcaaaactttctacacacacagacttctaactttttcgtcacatcgttccaattttaacgtgaactagacacagccataatcagggtgcaattgataatgcttatgttagctgtgaacactttttttttaacgcaaactggtctcaaagctatttttagataatggaataaatatcccggcctttactcattaaagctatagctaattattacaaggaatcgcataaacaacgagtgaagttcaaataaaattaaatacacccaacgataaaaaaacaaaaccaagaaaaggagcacacatttattcaagtctatttttgaatttccatccatggttcgcaaatatttacataaccgtcgtctccaaattacggcatgcaacctttataaactctccatcatcttcacacttttgcaactttgcccaaaaccggagccaatatgttgccttgaatattacctgcatatatgagatagatggtgatttgtcagaaactatatcattcctactcaaccacagagcctaacaaatggcagatgctccaacaagtatgagtttactcatcttcttgtgaacccctaaaagccaaccatcaaacatattagatatggaactagagaggtttaaaccaataaaaaactgtactactctccaaacaaattttgcaaaatgacagtcaagaaaagatgttatacggtttgcaatttgccatggcttggagccttggagctgactgacgaacggttgacatgtcacgctcaaagcctctccccccataattgtcccatccgatgcgaacacactcacacaaacagggagagccgcttgctgcattcattggcgtgcggacagatcgccgcccagcaatcagcggcaggccaccaaatagacagccacaacacctatcaacttatgggagaattcagccgtggaagaagccggcagcagcagcagtagtagtaggtcgatttggtttgaagagccaaacaatgcccacgagatatggctatgctgatgagctgctgaggcagtgatgtgtagactgtagatcctatttaatatagtttaagattgtaaaaacagttggttagtagtcattttctgaaaaatctgatttctattttttttccattttgtaactatagctattaaaatccaaaaaaaaactagactaatttaaaagaatttttaattttgatagaagttgtagaagctcccaaacagtcgaagtagctatggtgataatactctcttctcccattttaagtggtagttgtaaatttctgtgtttaactttaatcggctatcttatttaatttttttttatgattagtatttttgttgttgctagataataaaacatagtagtactttatatataacttatttcttaattttttttataaaatttttaaataaaataaatgatcaaatgaattatgaaaactcgtgactgcatttaaattaggacgcgcgaacaaagcattggcgtttgcttccgttggcggctgggacccaactgtcccgcgccgggagcacacgcgtataaaggacggtaggagtggaggcctcgccgggctcgcagttcgcatcgcgctgttccctcctcggctcctcgcgcaggagcactggcacggacagtgacatcgtcttcccttcacctcctcgtccttccctctcgtggcatcgcatcgcatcgtgtcctctgcgactgcgagagtgcgtgtgtgcagcgcgcgctcgtcgagacagacagcagcagcagttgctctttaatgccggtgccttgctgaacagagcaaggtctctccaatggccttgaggcattcaatgcgcccgtaatccatctcttgaacggccgtgtgtgtgttcttggcgtgttggtgtgcgtggattgggtgggtgaggaggatgaactatctcaggagccggagcctcaagcggctcctgtctctcggtcgccggagcaacaattccgatgagtccaatgacgagtgcgtcttcgtcgtcgaccagccgccgccgtcgaacaagcctacttggaggtgcttctcgtatgaggaggtcaacaaggccaccaatggcttccaccgaggtacagtagatatatattcttgttggtttctttggggatttggcattgagaacatggcgccatgacagacaatatggtggggagaggcgggtacggcgaggtgtaccgcggcgtgctggaggacgggagcgccgtcgcggtgaagcggctgtcgccggcggcggcggcggacgagaagaaggagaaggacttcttgacggagctcggcacggtggggcatgtccggcaccccaacgtcacggcgctgctcggctgctgcgtcgaccggggactccacctcatcttcgagttctccgcccgcggctccgtctccgccaacctccacgacgagaggctgccggtgatgccgtggcggcggcgccacgggatcgccgtcggcaccgcgagggggctccggtacctccacaagggttgcgcgcgccggatcatacaccgcgacatcaaggcgtccaacgtcctcctcaccgccgactacgagccccaggttcttcctcctcctctacctctcctctgctcgctatctgttcgtccggttgctcaccgagaaagaattgaattcgcctcagatttcggacttcggcctcgcccggtggctgccgtcggagtggacgcaccacgccatcgcgcccatcgagggcaccttcgggtgagcacacatacgttctccatggaccatggccatggcagtaaaaacagggagacgagacgacgctgagccgacgacattgatgtgcaggtgcttggcgccggagtacttcacgcacggcatcgtggacgagaagacggacgtgttcgccttcggcgtcttcctcctcgagctcatctccgggaggaagccggtggacggctcccacaagagcctcctcgcctgggtacgtacgtagcacattcatacgccatcgccgccgtcgcgtcgcgcatcgcacaacacgcgcacggcggcgcgcttgtggcggccaggtgttcggccagggacattgacattggtgccgtggcgcgtgcatatgcaggcgaagccgtacctgaacgactgcgtggcgcaggggctcgtggacccgcgcctcggcgacggcggctacgacggcgcgcagctcaggcggctcatgttcgtcgcgtcgctctgcgtccggcccgccgcggcgtggcggcctaccatgacacaggtaagaagaaaaggaaaaagaaagcaaacatttttttttctgcaactgcacttgctgttccatctaggagtagactaaattgacaacaatttagaatccataaataaatgtgagagaaaaagcatccggattgaactgtccatgttaacaagtacagtaaaattgacactgaacaataattgaatttcattattttcctaccaaggtactccactctagtactagtactacaagaaatggaccattcatcattgtgaagggtttctttgctgacatcagctccgaaatggcatggtagcttgggattagttggcgacctaatcgttctagagtgtgcaaaacacttagcttaggaatgttagagtaggtctgactctgatctgacagtctgtgtagcattgcaatgcatgggccaccaaacaaaatctctcaacatcacccaaagaggacaagagctaggaaagctttaattcctttgtggtgtggtgtgctaattgggttgctgcttgacccagcaactcaaataaatatggcattgcaatttgcaaccactgcaatcttcttcagtagattgttaattacataggggaaacttgatggtttcttatggtggcagagtctagttgattttcgttggagtttgcgtatccacatacacattggttgtcaatcttgttcaggtaggttgttaattatatagaggaaacttgataatttcttttggagcatagtctggttgattttcgttggagtttgcatatccacatacacattcgctataaacggtttgtatatggcattatggtaggttcaacagctctatcaaaccatacaacgacatgaaaaatctcaacagaaatcaggagaaccggtatacaggaataattgttaacggctggtggataaattgatgaggggatctagtctaagggacatcattgtattatatggattatcaagcaagttctctaataacactggtctaaaagaagttcactaatagtactcaagtcatactctgtagatgacctcattacttttttcatggctggtgctaggtagctatctcactcaagtataattctcctatctgaagttatattttatacagcataatctgtatatgcttggtctaatcagacatccgggtgccctaatgcaatggcaatgtatgatgctaatgtgattgtcctactgctactagtctaatccatatcatccacttgcctcctatggttgttaaatactgccacattgtgttgtgtcagttgtgacagccactcctttggtttttattttatcttgctagcatctagcaagccagttggcgagtaacattgcaccaaacttgattgcgtataccttgtcttggtctgtcatagtgtggtgagatcccatttttaatgtgaaactaattgaatctctttcagtaggattccacagtgtgtgggatgataatgtttgtttatgtactacaatacagaaacagaggtatcagttatgtatgaggatatcatacatgaaagaataagttgaacctaaggaaggtagcttgaacacatcaatgcatatcatcaatattgacttctttgttttttccccccaaacagaccctaaagcttgatttactcttcaccttttcgtttcgtttttactacgtaaggcccacatattgttgtgttccaatacttgaaagtttcaataattcttgggtattttccaaaaggtacacactataaaataatttcaaaaactcaagcaacaaaaccgaatttttagacagtaaataaaagatggtaagtatcttgtagttctcaagttcttagtattcaaagtgcaattttactttttccagaccaaaggatagtctgatgaagcaaggggaaaaagaactctaaatattgttttttagatggaaaatataacagcattatcatttcaaagaatgtataacttcttttatggacatattgtattcgcaatctttcgtaatagatggtatttacaagtcaccaacagttgcaaccagaattactcttttagtttagaccttcaagacttaaagcaaacaaggggaaagcttacccattcttactagaccaagtagttgcacaaagccacagagtaatcttacaattttacttgacttgagaagaagacaagagtttggcctcatctaaaatgtggccggtttcttgattttagaagggacattggatgctctgtagcctcctaccttctccattatccttttcttccccccattgattcacgagaagcccagagccaggtgaagtgggggacacaggacagctcaagaacataaatcttgggacaaacgtacaaaacatgccaccccaatgtgcacatagaaaacttggtcacctctaatcaagatttaatcatgcactactttattagtattgcattgcaccatactaccattggcacacaagctacctactgtgaacagttactttggttttaacttccaaatgccttggaaggtggacatatacatacattcagnnnnnnnnnnnnnnnnnnnnnnnnnnnnaaatcacaactaaatttagcactttcagcaaataggttagcaagcagggttatgcagtttgttaacaagctattgcttacaactgaccgacgatatctagttgaatttgttatgagaacaatcttgattttctgagcaacaaacttgatttttcaatgcattgcgtttggctttcttgtttctctaattgcaaaattcagtgcattttgtcatcgtgtatctggtatcttgtcaaaaaaaaaaatccaactactgggaacatccctggaaagtttagaatcatttatccagtagttactagtaccaacaaccggtcaattgtagagcgtactgcagctcaactgtgtttcgtactgccacttaataaatttgcaactgtgttgtacttaactgactcggttcacatggggaaatggcaggtcctggagttattggagtccggcgagatatctcaagatcaatggctgatgcccgaggaggaggaggaagacgagttttgggatttcgacgatctcgacgacttcgaggacgacgacgacgacgatgatgacaactatgataacgacgatgaatcggattctccctcgatatcgtcgtcagcgtgcagcatccacgccaatgattagccccaaaatatttgagtctgtcagtcttgacagagtgccccaattggttttggtttttaggggatactatgatcgatgggattatattagtgtacataaaccacctagacaatagtaaattcagaaaagaaaaaaaaactgttcaggcccatggttttgatcatcatttcatgtctccattagcaagaatctccttgttaaaacccatactactaactccatcagctgatctgttcatctgacagtgatggttcagacggtttctgtcaaaccgtgctagatgaacagactgacacaagtttgtcatgatgccatgcccttggcttagctttctcccaaccaactggaactgttgttggtttacagtttcctgtggatggattggattggattggagacgagctgattagggacatgatagtcctttcagttaattgtttagctagcaaccagcacatgccaggcaccggcaggtgggcttcggtttggaatccgttggttagctcgatcaggtctcaagtgcagttgggcgaccctgcttagctgctgctgctttatttgttcgtccttcctgttcagctagatgtcgatcgatcaatgaagtaaccaagaagtcattgagcaaagttcagattggatcatgcagttctgtcaacgcaagaagtcagtcacgtttcattggactcactaaaaatggctaaaaatcaaaataaaaatatggaatgttagtctgaatgtctggagctcaaattggaaaaggagttgaagaattgaactgtatcatctactgccgattaagctgaatcactgtgcttggcagagatcaacagtatacgcattgacattcatggacctgaagaaatgtcgccgatccatcgatcgatcgatctaccagtggccgtatttgtacgtgaccaccaccggtccatgcaagatgcaccacaatgatagatgcaaacctctgaccaccactcatcgacatatggttggttcgttgtcatctcctgcttgccagatctacaaattgctgctacaactcgtcctagtttggaactgtagctacgagcctacgaggatggacgagatgcttggtgcccattggctcactcactcacacaggtccaagctagctactagagctgtagttaagctcaatggcccaatgtcattagtgctactgacagtgtgagctgcaacatctgtaattagcaggaccagcttatcccaaacagtagcaatgcagtgtcatacagtattgattcctgtgagcactgtgtaccattcatagggcttgtggtacacttgtgctagctagtatgcactgacaaatcctgatgatttccatgcgagttgaacccagcacatggagctttttgttcaggttaccgattgatcgagcagctaagacctcgagcattatgagatcgataagcatagcaatcgatcccgtgatcatacatgcagatgatgcagtggcgtgcgtgacactataggtacgttgttgctgaagccgaacatgcgatgctgcgtgcccgtggcgcaatgatccaaaagattacaggcttgcacgatcgaccaactgtttttcatgcaagatgttcagagagacagatagtgatatgtgtgttgttgtgtagatgcatgggcctcggctagaaatgctatttcataccgctacctcgtagctaccacggagagctatcgatcgaatgctagtttgtagtaggggtttgagaaatgatttgtcaattgcaatttggtaggggacaggtgccagatcagtgatggttgttgatcagtagtgtccgtcagaaaagatatgtgggtttcgatcttcagtttttttaatgaattaacgactaatagaacttttctacgagactacaaattaaatatgttcttatagttcttctggataccaaagcaaacaatattatcagggatagggaagaaattagcacgttctgttcgtttttttatctgaacctgaatgcatggcgacgaactgaacaattaagctcaaagtgaccgaccgatcatgttaactgttaagcagtcaaggtccagtgctgataaaccacatgagagagagagattctcagatcccatgtcaacacatccattcacagcagatcgaagctagattctttgcaagcgtgctgctcgtcaagcatgcagcgaatcaggggagagattaaacaagttgggtgcagataaccttcactgcagaacgacaaaaaggcccggattgaccatacaatgtaccatatcaagttatgcgattctgtcggtaattagcatgcatcaaagattcttcagataagccaattcgggttaatcaatccgaccgatggtcggtatatacaaacattgctcctcactactaggtgcagtccaggaattgctgtaaacacatgggcacttaacacacccagcgaagcagaatgcataaaaccaagtgttgttgtttttttattttgaaaaaggccaacggcccggcttatattgaaagcccaggggtataaccaagtgttgtaactgagaaaatgcacattttctcaacaatgcaggttattaagtcttttgtttcatggtcacattttaccacgccacattttattagacgtgtattagtttactatcacaattgtgcattgctacactttttcaacaacatattctgcatgtcataggcttaattttttttgtcaacttttgtcacgctttgtggctaccaatttattcattattttctttttgtctatcaaaatttgctaaaccttagttgtagtaaagtgtggctgacaacctaatacatcgtaagatgctagccaaaaagttcaaagatgcaaatgataaagatgaagtactgaactgggctaaacacaagttcagataaggcccgatttgtggtacttaccaagtgggccaactacacaagaaattgggccgtcctccccggcccaatcgacccaataggtaggtactgcttccatgtattgggggaagcagagagatccccgaaatcaaacccctcctcttctcttccccttcctcctgcgttctagggttttgcctcccagcggcgactcggcgagcgagaccaccggcaagctcgtcggcgatggagcccacctcgtcggcggcgatggcgaggcagacgtgggagctggagaacaacatcccggcggcggcctccgacccggacgccctggacgcgatctaccgctacgacgaggcggcgcaggcgcgggtgcagcaggagaagccctgggcgaacgacccccaccccttccgccgcgccaagatctccgccctcgcgctcctcaagatggtcgtccacgcccgcgccggcggcactatcgaggtcatgggcctcatgcagggcaagtgcgagggcgacgccatcgtcgtcatggacgccttcgcgctccccgtcgagggcaccgagaccagggtcaacgcccaggccgacgcctacgagtatatggtcgagtactccaccatcaacaagcaggtcaggccccccaatccttccctcctcgctgtttattttggacctcatgatctgaccacgctttagtgttgctccaatctaggtcgttatctgctttccctgcctgaaattgtatagctaggaacactaaatcataataataattagtagtgccacggcgccgtctgctcaaaagttgtgcgggaggaagtatttgtggttaaatattgttagtgccacggtgctgtctgctcaaatgttgtacgcgagaaagtatttgtggtaaaattttgcagtgctgctaatttggtgttcattgtgtcacccttagattggttcgcaccatgctattgatcataatgtttctgaggtctcagtttttgctaacacattgatgactgatttggtatgtttgttgtgatatttgatcctagggataaaaactacagggtataatatttggaagttttagttgatattttagcactttgaactggtggtatttactgtttgtgcacatactgcattgtataatctgtttcatagcatttgttgtaggatttggtagtccccatactgtgtatcacagccatcttcttctaggatttagtcatcttagaattgttttgtgtccatctgatcatacataatctttggggtggctgaaatgctaagggggatcttgattttttttccttattctatactttcatgttctattcaaaattcattacctcgtgatcattgagctccgaaaatgagaataaatcgatgcaatttgctatataaagttacctaacatgcatatattcatttggataggctggaaggttggagaatgtggttggctggtatcactcacaccctggttatggatgctggttatcaggcattgatgtgtctactcagatgcttaatcagcaatttcaagagccattcttggctgttgtgatagaccctacaaggactgtttctgctggtaaagtggaaattggagcttttaggacatatccaaaagattacaagccaccagatgaacctgtgtcagagtatcagacgataccactcaacaagatagaagattttggtgtccactgcaaacaggtaactaacttatacgtctatttttttcctcccttgcccaacaaatgatctaattctgttctaattgtgttttgtgcagtactatgctctggatataacttatttcaaatcatccctggattctcatctccttgatctactttggaataagtactgggtcaatacgttatcttcatcacctctcctgggcaacagggattatgttgctggccagatatttgatttaggtaagaaatttcttttatgaatatttacccaaaaagaagtacacatctatttttgttttaccatgagaccagataaagttataaaccaatttgtgctatgcagctgataaactagagcaagctgagggtcaactggcacacagtcgatatggcatgcttatgccatcgcaacgaaagaaagaggtcatattctttaccatctgctgttcttcgtcactttcaataatttgtggtggtattgtatgcttgcaacttgcaacctatgagataaatgccaactatatttgaaaaattccatctgctgttctttgtcactttcaataatttgtggtggtattgtatgcttgcaacttgcaacctatgagataaatgccaactagatttgaaaaattgaacataaagacatttagttatgtaaatattgaattagtgacatcatgcatgggtcagtttgttatgtgctagggctttctctcatgagaaatttgggaggaagctatagctgtcatacttccattaggaccattacttctgttatatttggagtactgcaattgtgttgctctgtacttgtgttgataggagatttcaagctgagtacgcagattgatgatagtaaagtaaaatacaagatattaatatgaaagccatctgagtgagactgggaaagtatgatccagattatgttctgttcagagttgcaacttgcaacaaatgggttaaatctatattcgggataatagactaggattgaactagtcaaacagttctctttcttgcaaatatataaatcaatttgttctttgttattgtatatatttgtattatgtgtcctcaacattgtgatgtttgacccatatgtctataacacacatatttttggatttcttaagaattattgcctattctgctctctccaacctattttgtgcaaattacttaattagtgttatagtgtgtcaattgtttatggctatctttgagatctaaatgaaacttcctcttttttgttcctttttatgttttactcagcaagaggagtctccactggctaaggtaactcgggatagctcaaaaattactgctgaacaggtccatggtctcatgtcacaggtaatccataagcaagcctgactgttgacgaggtttgattctcctggtatatatatttgcttgcattatgctaacttttgcaacatgatgtttcaaggtcattaaggatatcctcttcaactctgtgcacccgtcaaacaaggcaagcacaagcgcaccagattcatccgggcctgagcctatggttgaagcatgagtgttctacagaattccttcattagttagccttttgttgatgctggattcacatacactgggtgcctagttgtttcatgactaaaagctgtgtccagcataactacccgattcaaaatgcgttagctgcgttttatcgtcaaatcataactgatatgtaattatgagttgccttctgaatctttcggctgccattgtgaaggtgcgtggtctacgttaagataaccaattaccttggcccaacttaccatgttctctcaacaatgaatggtcccaacgtcgctaggcacagtgtatgttgatttggatgatctttctggtatttatcctccgattttggtttctatatttccagttcatttcactgtgtcaggtgctacgggtacagccgtacagcattgttgctttcaattaacgtcagaatttgtcttatgattattgtagggcctcgttaacttggtcggtcaaataattcgttcccacttcgaagaagaaaccaaagaccttatcaattaaggacaagtatattactttcaactcacgacttcgtgggatcttccactttgacatgaatatcttcaagtggagaaatataaacatttcattttgacacgttagcagcagtacccagagatgctactttactttgtttaacaatatagtaaaatatagtaatacgttttaaataaaaagagttacatattatgatagtttgtttaatgataaattctagtaacatcaatatgggtgggtctagtcgtcaaacgtttgcattccacgaacgtttaataggtttcgtcgttattcgttctaatgactcgtttaagctcgtatatggtagttagagaccaaccaatcacttttccctactatcaaatcgattttatttcttgaaaaaaaaatccggtgatgcttagattttttatttgtactgaaatttatacatgcaaaatataattcataatatgaagttccattaaaaaagctataaaaatgactataaagaaaaaaaaaagtaatttgaaaaaaacagaatgcaaaaacaaaaaaatgatacatatcgcttcgggagaatcaacgtaaaaaaataacgggaaattgaaaagattcacgtaaaaaggagaaaaaaggaaattaagaacagaaaaacgtagcgacacaacctctcacgcatcgccacgtatcttcgatcctccccagcctgacccgttcacgaggatgagcggaagcgaacgttcgctcattagtcatccttcatcaattttacataattaatcttttttaattttttttactattaatagtcaaagttgaaaatgtttgacttccaaaaaaaaagaaaatgcttatattttgggacggagggagtaatcattagacacaaaggaaattattttaaaaaagttaaacgtaatattaaaaatccttcgaaactcactctaagaaatttcaaaagaatttaagagactcatcccttctttccaaaggaacacatgaattctttccatatagtaatctaatcattcaatattcccccaaaatttggtactttcaaagaagctctacatgcataaaatttggtacttttaaagaagctctacatgcatagccttactggtggctatagccttgaacgatcaatacggtgctatgtatcatcaacatacaataagacctaacatagcattattgtgagttttagacgggttccactgaagtgtattagcttgcccaatatgtatatggctagaggggtattacggtagaccatgaacctcataggattagctactgggagagagagagagtaccaccatcatggaaaagaagaattttatagcctttaagaaaatatcctaaggtagtttacactataaaatatggtgcctctgttagcttttcaaggatggaaaaattgcccatttccgaataagtataatgtgcatggcctaacaagaaaaacaattcaagtcttcaacacggcagacgcaattgatgcccccaacgtcgccaacgagactcacgactgctgcatttgctgctagctcatgagtggcgtagagatgatgttctatcgtgtccaacgagatgagcttatgaacaaccgtgctcatgctcggccgcctgctaggctcaccgtccacgcacgaaaccgccagctccagcaacccggctgcctgcacatggttgaagtcaccgcgcagccgcgcgtccacgagctcctccagccacgccggcagctcgccgtcgtcgcacttcagcttctccttgagccacacggccagtcgctggacattccatgccccgtcggccgtcgccgcagccgctacccagtcgcacaccctctgccccctgaccagctcgaggagcacgacgccgaagctgtacacgtcggctttgccgttgatcgagcgaccaactgtccagcactctggcgtaatgtagcccctggtcccctgcacccgcgacagcgccatgtggctgccggcgtcgcggctcagcagcttgacgaggccgaagtccgtcaccttgggctcgaagtcgccgtcgagcaggatgttctccggcttcacgtcgcagtgcacgatccactccaggcactcgtggtggaggtacgccagcgccttcgcgacgcccacggcgatcttgtacctcgaccgccatggtaacaccaccacaccggagctctcgccgtcgtcgcagaagagggccttgtcgagcgagccgttctcgacgaactcggagacgaggaggcggtgcgggtgctccgagcagaagccccatatcctgacgaggttcatgtggttgatccgcccgatgacgctcagctccgaccggaacacctcgtcggcctgcgtcatctcgtccagccgcttcacggcgatgctccggccatcctcaagaacacccttgtacacggatcccgtcccgcccttagcaatctcgtctctgaatccgcacgtcgcgtctgatagctcgtcgtaggtgaacctccggaaatggctaaacaccaagctgtacccttcatcaccgacccgtcctgccgccacggagtcagctcgaaagacaaacaggtaacccacgacgacaaaaatggcctccacgacgaacacaaccgcgaggaagctgtagaagtagatgaagtttatcgtgttgcgcctgccatgaaggtacgagctgctgaccgtagcgtcccgttcgtccatggtgcaggtgtggccatcgaagtgcagcaaggacgggttcaggttcttggcacccgtagggaacttgaggtagatggtttggtacggaatgctcataacccggccgttccagagagagatcttggggtagcactcaccggtgccctgccggtaaccgaacgcctcgcagcggcagtcgacgaggcagagacgccggcacgtgtcaaacgagatcccggcggtgtagttgaggtcgaagccccagtagtcggtgtgccgcatctcggcgaacgcgacgtcctcgccgcacctgacgtcgaacgtgcgccggcatcccttgctccagtcgctcgcgtcgtgaggcacatagccgtcggggcaggagcacgtcgggccttggctgtacgtgcatatgccgtagcggccgcacaaaccgtgcacgtcgcactgcctctggaccgcgacccacgtgacgtgccagcgcccggcggcggcgtcgaggctgtagaggcggaggttgccgtcgtagtcgagcgtgagccgcctcatgacgcctccgtcgcccatgtcggaggcgttgaactgcagctggtcgctcgccgtgaagacgccgcggcggtcgaagctgccgtggcggctgctgttgaacgccgtccggttgttgtcccaccacttcttgaaggggtccggccagtagttgctgctgatctccggtccgtcgtacatcaggttgaggatgttgctgctgtcgaagtagaacttgtagtacccggagtacggggagcccctggcatagctcctctcgtcctgacgtccgtatcaccgagctgtcttgctacctgcgctgacggcgctgtcccggcaaggagtcgtgtccgtgggccagtcgaagctctgccacagccggttgccggcggcgtcggagacgacgaggttgccggtgtcgaggagctgggcgcggtcggccggcgtgccgctggtgttggtgctccacacgacgcggccgtcgtagtcctgcagcaccagcgagccgtccttgcggagctcggcgcgcgagccgacgccgttcacgggggtgtcgcggttggccgtccacgcgacggtggcgtcggcggacgcggtgaaccagacggcgagcgtgtaggcgttggtcgccaccttgtagaagccgcacgagaagttgccgctcggcgacacgaggacgctgtcggcggcgtcctccacggcgatggagccgccgcgccacagaacgctgcggcgatcgccctcgcccgccgaaagagcaacgcaacacagggaggtgagtacgatcaagtgcaagccatggactcgattcatcgtgtatcctaaccccacagggctggaggcgtgagttccaacttccaacttaaaaactggtttaaaaggggaaagaatgtggctagcctgctgacagtgacatttcccaattgagatagtgtgtaccgtcatttatttaaccattaatcttcactgtcactgccggcaagtgaacatgcttcttggtactcccactggatggaggtagctccttggtacttgaccggtggattagtgcagttagagcaagtataataatgagctataagcttactatgagtttaggtggaggagagatagtgaaaaattaagggtgttggctttcatgcaagagctaacttatcacaaattccaagacaaatacattaaatgtataagtgagggatagctagagagaagagaaaacaattatagccaaccttataactaatccattatatatgttgactttaagatatgctaataataagaagtgagctatactattatttttgctcttagcagcctcagcctgcagccagaacagtctggcagtcaagcaccccggtgaaagtagttgtactcaaaagagctaaacatcgttagtactacagactaattgacagcccaaaggccgccggcaacgcagatgggcaattacttgatgctgtggggaatgactttcacatattggtatatcttaccattttttttattttttattactttaagacagcacgtacaaaagcgacaaaaatccatctgcgatgctgtaccaaactactgaaatgggcttgcaaatgtgctattataagggaggggcatatttaccgttagcaagaagccactactattcacggtttgcaatgtgtaaaactttaggccttgtttagttggtgaaatttttttgtttggttgtcgtatcggatacacgaacatacattttaagtattaaatattgtctaacaacaaaataaattacagattccaccaggaaactgtgagatgaatttattaagcctaattaatccgtctttagcaaatgtttactgtagcaacacattattaaatcatggcgcaattaggcttaaaagatttatctcgcaatttacacgtaatatgtgtaattggttctttttgcctatatttaatactccatgtatctttccaaatattcgatgtgacagcgtgaaaatttttgtttgtaagaggtcctgtttagttcccaaaacatcatttttcacctttcacatcgaatgtttggacacatgcatagagtattaaatgtagacgaaagaaaaccaattgcacaaattgcgtgtaaattgtgagacgaatcttttaaacctaattgcgccatgatttgacaatatggtgctacagtaaacatttgctaataatggattaattagtattaataaattcgtcttgcagttttctagcagaataatttgttttgttattagactatgtttaatacttcaaatatgtgtccgtatatccgatgtgacacattgagcaaatttttttttgccaactaaacaaggccttaactctcaaatattttaaaaatatcttgattggacacgagaaataaatgcattgataaatttttcagttacgatattgtgtgaaaagtcaacacatgtcataaatgaaagtataaaataattatttaaaaatgtaaactgcactgtggatccttgctgtgcggttatgtcacgacaattttcattttatctcttcacacctgaacttgactacgctaagcggcatatattctgtttttgtatccatttctcaaatctcaataacatgcaggttagtgagaatgcatttatgcggccatgcgggtgaagggaacatacaggaaatatcttactactgatgttcaatttttgtctgatgtacttgtagaatcatgtgatgattaattttagtgatgaataattttcaaaggtattaagtcaaaagaacaattgtcaaaggtgaatgtttattgaaaatatgttgaatagtgtttccggattatgaatggtgttgttggctctgagaggttggtcagaccggtggtgttggtgcggtttgatcgggtagcctgatggtcagactggcaaatttcgggaaggagtcggttttgggttgtgtacatataagaagaggaatcaaatttggattggaaatcaagtttgagataattggagtgtggagttatatggggttgttgtttccctggtttccctatatgattagaaattctagttctatttggattcatggctaggggaagccatatttcaggtataaataacagaggggttgaggttagaaagatattgactttttaggataaaaagttagggtttgtttagcaactttaattctaattcgtgagttaagagatgagtgctttatatgcactttgtaaacatattgatgtaattataaagttaatataatttcaaaagttttattggtttgtgtttttctggatcccggtggtctaatcggagtacattgcgtggttagatcggtggtggctgcagcggcaagagcatcggcattaagtaggaaggcggtctgaccggaggccagacactgatctaatcggcgggtagacgacggtctgaccggtagtgtaatggtggtttgaccagcgatgatctaattcgaccggtacgtcttgttcagagtctccatcaagtatttgagggaaatcttttacttgtgcaaaaagatttgtttttcaatgtccctaccattcactccctggtaggcatagatgttgttattcactttcgagtatgaataaatcatggccacagttagcctgaatatttgagcattttggttcatgcatcttatttgttgactgttggataacgtactctcttatatcacttaatttctctaacttttcctattgaatttagatagccaaagtaacaccggaaaacaaaaagaaatagtgactacaaaaactatgtttggcaaaattcaaatgaattagggggcatatgtatatttcaaatgaagagtcgtgtcaaacaaatataggaggctttccctgctttaaatggttttcgagctattttcatgaaaactgacaaaaccgctcaagagaagtttttgatcagtgaacggttttgtaaaccctgactgcaacccatctgattaggaacatagttcagcttttcattctctacattagaaggaaataactcataattctattatatacacctacatttatatgaaaagcatataattttaataagtggaaataagtcaaccctaaagagatgtagtttgactaccactatgggtgtatatactgtgtattttctgtagccataaaaccatatcatcctagaactaaatgttgcaacttgcaatagacttatccaaatctttgctcaattcctatccattggaatcaacttatctatatatttactcaatttctacctgcggaatcaacttatctagatcattggcgttgacaattacaactcacactgaaaggattactgattggtaattgtgtaattgttggcaccatagttgggaatcggagagagggaaaaagggttggcaccagtcctctatttttttttctcaatgtaccgagaagaaagggggcttagcaggaataataagatgaatgattgcgatctgtagcccatgtaagaataagaacgaaattttgcaaagacaaatgaaaatcaatgaaagtactaaagggaatggtgaaaaggaaacgcaaaatcaagtgaattacaataaggaaaagataattaaattacaataaggaaacgataattaaaaaatcacttattaattttattcgtcacgcgacgtcaaggcgcatatatattcccactatcctccacgcacgttatagggaaatggagacagaaacacgacgtgtcactatgcaattttagatgcgccaagaaaaaaaagaagatcaaattttggtgacacagccttacaatttcaagatatgcctttgtataggatggcattgacttttcacattacaataataccctagttgaataatgtattaatgcatttttctcatgtctaataagatatttttaacatcatggtagttactcagaaagcgaagcttgccgcactgtaaattaatcgtcaatattaatactttgtttgtactccatccattctataatataagacacaacccatccattccataatataagacacaaccacttttcttagatgttccataatacggagtataaggcatacatgcaagcatgaaattaactatgacatcttctccattaaattattacttttttaaatcctccactctcatgctatctaatcttattggatgcatgcattatatttattaggatgatccaaactacaagatgataataattatttcttagtttttgggttaagggtggttgtaccttatattttggaatggggtgagtaataaataatagccctccaggagtctggtacaccgtacaacaccaaacgataagaaagtgatttcatctcctcgttacgtgcatgtcacctaaatggtcatcaaattttttttaaaaaaaatagcaagatagattaatatgaaatataccactccacaaacattcaagttgaaattcaacatctacaagttgaaacaaaaagaaacaaatatgtaagcgaatgtacgataaccattttaatttgttccttttttgcaacttgtggaaatcgaatttggttttgcatgtttgttgagtgatatatttcatattaatctatgttgtcaattttttttcatattttttaatgactatttagatgacatgcaaataatgagacgatatcccctcgagggatgaaaattcatttcccggcacgatgtttatttctgtggagtaatgactttcacgcttggtttggggtgtggctgctaagaaaattggcatatatgatatattcaatgcaggtgcttccattttgttttcttgtttatgctgggagttgagaaaatcttagtccataatcaactggtcaagtgccgaggaattgcctgggtctcattgactctgttaacttgttccattggcggctgtaataagcctgggacagtgagaattagtaaaagaaatgactgtttaatttgcagctaaacagtatctcaatttcgaaatgtcattgtcaacaaccatgttattttccctttaaatcgttcggagctcacgcatctaaatcctaaaccacctgggttccatgatgagtcgtcgaatccatggcatgtgcttactcgtcctagccaccttcctctcttgcattgctctctcggcgggtgatcaccggagcgttctgtggcgcggcggctccatcgccgtggaggacgccgccgaaaacgtcctcgtgtcgccgagcggcaacttctcgtgcggcttctacaaggtggcgaccaacgcctacacgttcgccgtctggttcaccgcgtccgccgacgccaccgtcgcgtggacggccaaccgcgactcccccgtgaacggcgtcggctcgcgcgccgagctccgcagggacggctcgctggtgctgcaggactacgacggccgcgtcgtgtggagcaccaacaccagcggcacgccggccgaccgcgcccagctcctcgacaccggcaacctcgtcgtcgccgacgccgccgggaaccggctgtggcagagcttcgactggcccacggacacgctccttgccgggcagcccgtcacgcggtacaagcagctggtgtcggcgtcggcgaggggcttgccgtactccggctactacaagttctacttcgacagcagcaacatcctcaacctgatgtacgacgggccggagatcagcagcaactactggccgtcgccgttcaacaagtggtgggacaacaaccggacggcgtacaacagcagccggtacggcagcttcgacaggcgcggcgtcttcacggcgagcgaccagctgcagttcaacgcctccgacatgggcgacgagggcgtcatgcggcggctcacgctcgactacgacggcaacctccgcctctacagcctcgacgccgccgccgggcgctggcacgtcacgtgggtcgccgtcgggaggcagtgctacgtgcacgggctgtgcggcagcaacggcatctgctcgttccgtcccgggccgacgtgctcctgccccgtcggctacgtgcccaacgacgcgagcgactggagcaagggctgccggcgctcgcccgacgtccggtgcggcggcgacgacgtcgtcgacttcgtggagatgccgcacaccgacttctggggcttcgacgtcaactacaccgccggcgtcacgttcgacgcgtgccggcggctctgcctcgacgactgcaactgcaaggcgttcgggtacaggccgggcaccggcaggtgctaccccaagatcgctctctggaacggccggattccgatcaagcccgaccaaaccatctacctcaaagtcgctaggagtgtcaagaaccagatgatcaaccagtcgtcgtcatttctgcacttcgatggacacgcctgcaccgtggacgaacgggacgctagcgtcggcagctcgtacctgcatggcaggagcaacgagataaacttcatctacttctacagcttcctcgcggtcgtgttcgtcgtggaggccattttcgtcgtcgtgggttacctgtttgtcttccgagctgacccggtggcggcaggacgggtccgtgacgacgggtacagcttggtgttcagccatttccggaggttcacctacgacgagctgtcagacgcgacgtgcgggttcagagacgagattgccaagggcgggacgggatccgtgtacaagggcgttcttgaggatggccggagcatcgccgtgaagcggctgggagagctgacgcaagccgacgaggtgttccggtcggagctgagcgtcatcgggcggatcaaccacatgaacctcgtcaggatatggggcttctgctcggagcacccgcaccgcctcctcgtctccgagttcgtcgagaacggctcgctcgacaaggccctcttctgcgacgacggcgagagctccggtgtggtggtgttaccatggcggtcgaggtacaagatcgccgtgggcgtcgcgaaggcgcttgcgtacctccaccacgagtgcctggagtggatcgtgcactgcgacgtgaagccggagaacatcctgctcgacggcgacttcgagcccaaggtgacggacttcggcctcgtcaagctgctgagccgcgacgccggcagccacatggcgctgtcgcgggtgcaggggaccagaggctacattgcgccggagtgctggacggtgggccgcccgatcaccggcaaggccgacgtgtacagcttcggcgtcgtgctcctcgagctgctcagggggcagagggtgtgcgactgggtggcggcggcggacggggcctgggatctccagcggctggccgcgtggctcaaggagaagctgaagcgcgacgacgacgaggaggaggtgtcaacgtggctggaggagctcgtggatgcacggctgcgcggtgatttcaaccatgtgcaggcggccgcgatgctggagctggcagtttgttgcgtggacggtgaaccaaacaggaggccgagcatgaacgccgttgcgcagaagctcctctcgctgcatgatactcgctagagcatcagtgcatcatcatcagccatctgcaccatgcatgagcccagcatgcatcgatcacctttcctggaaggctggaaccccaatgcatgggactgtgtgtgtcataccaaaatgaaaaaaaaaaaacggatttgctataattgtggccacagattttctgtccaatcgcagtcgattttttggccttaggatggcatgtagattcgtgcttatgtgttgtatccgcgcgcgttttacggctcttccacagcttttgcctcgtcaattgactccgtgtgtgttgtttgatgagggacatgctgatttgaccgatggatgagatacgtgtagtaagttacaccataattacatcatatttacactacaattacatatgtaattttaaaacttacatatgtaattttggtatttacatagtaagtacactattttttggtgaatacaatgtaaataaatgctgactattttttgagggaaaaatatggcaccataaatatagctactccccaaaaaaaattgcttagttagactgttcagggtgtgaaactgtgagtgtagtagtgtacattgtcccacaatttatttatttatcaatattcactaattattctcaaaataaattaaaaatattggtgtacttctttatacgacctagtggatggttaagcggataaaatatataaaagcaagtcctacttttgtggattaacggatacggagtatgcaacaatcaggctgatggagtgtttcgtggggaaataggataatgtactgatgtggaagcacatggccccatttcgctgaagggaattcaatttttaaaatactgtatgcatctgcttgtgtgttatatatgtaaagagaggaaacgaagaacggaaaaataatatagagtaagaattttttttttcatttttagtggtctaatagaggctgagggacgaaagcgactataaagccctcaaaatcaatctaaaaagtaaaattggttgtatcttataattcgcgcgccttccacggaaattattggattaattccaaacggatgcaacttgatggcagaaatattggcactaagttgacattagcacactaaaaccaatcgtcgacggttccatttcttttctccaacgaattagcggtgttaactattatatgattgcgattgcgatgcatccagctggctggaataatgcaatgcaaaaattgacaaaacaattatgacaggatctaatcagaattactccctccgtcccacgataacttcatttttggatttttatgtccaacgtttaaattaaccgttcatcccatatgaaaaatttatgaaatttattttgaaaacatagtgacgcataaagtattattcatgttttatcatctaataacaataaaaatattaatcatataaaacttttaaataagacaaagagtcaagcgttgtatccaaaatctgaaaaatggagtcttcgtgggacagagagagtagtaatctaaagcacatttgtttaatacgcaacctagtttagtactaggtcgcactatcttcaggttgatctactagtacatggatgatcgatgctaaaaaaacgactttggttaatcgtgtttgtcaacacgaagaattgatgcacatatgtccaattagatggccacaacgtccaacttaacgagtcactttcgagtatgaattactccctccgtttcaaaatgtttgacaccgttgactttttagcacatgtttgaccgttcgtcttattcaaaaaattttatgaaatatgtaaaattatatgcctacataaaaatatatttaacaatgaatcaaatgataagaaaagaattaataattacttaaattttttgaataagacgaatggtcaaacatgtgctaaaaagtcaacggcgtcaaacatttcgaaacggagggagtaatcattgccccatgcggctgagcatgcacatttgagcatgttggtcagctcctcggctcatgaataatccacgcttatattatatgatttgtacggactgctggatacctgcgtatagtgttcacagtttagtggactgggttttgccgagttcatgtaatacatgaaaactagctagaaagtatcaggatggtgaatataatgcctgcatttgatgaaatccgaatctactcgcgtcaaaaaaaaaatccgaatctactctagctagctaggaggtgacacacacacacacatatatatatatatatatacatacatacactccttcaaaaagagggtagtaggttaataaaaatgactaatgatatgttaatgataattttctttaattaaaatctcattacaacgcacagacaatatgctagtcttacaatttactgaagggaagagctagccctgtcaaagtaagcagtgacgaccgagttagatgaaacatgaaaccctcccgttcaacccatttgaatagtaccagagtttgttggagttcaattaacttaattacttaagtcataatcaccttcagataatgtaatgcagaaatttgatttaactgacttcgttgtgaatggatgaatcacctcacgaacccctttcaacgtcgagtcaacaactttccgtacttcattcggaagagaatattttgtaaaatcctactttgcataagtttagacaaatcctataatataaagatatggctaaaaaatgcagtaccctctagggtttttagaaattttcacatcaataaaaaaaagagaaaatgatgggttcaaacttaatgatatagaccgaaagctcaattaatttaacagttgtatacatcaaatttaattctactttaactgtttagctccgtataaaattatgcggataatctcctagtgattgtgtgttaacaaagcacgctcaccatggaacgt

SEQ ID NO: 60652 - DNA, 13856 bp, Oryza sativa
tactagagcatgccaaactgcccattgccaagtcggattcagattaagtgacatagggtaaacatgtcacgagatgacatagcgtagatttcggtcctccaaaataaatccaatggctgagattcgtccacgtcattacgagttttcgaatttctttgaccaccgcctcggagcccttcttcaacaactatatgtgactttcttttcccccgagtttcgaacccctcgagttgaaccatgtagatctcctcctcctcgttgttgttgcggagaaagaccgtattcacgtctagttaaaatagatgcaagtcccctcggccgctactatatcgagaatcattcggatggttttgagcttgactgcttttacctgaaaccatgcggcactcaattgccgcacacgcaacgcagcgcaattcactcagccgacccacccttgtgggcaaacatgttgtgccgcgcgacgcgataacgatatttttcgccggcccggccgcctccacggtgtgagacgtgaaggcgatacggccgttacggccgttcgcgcgtaaaaatgccgactgagatgtggcggctcccggctcgggacggcgcatgcgcagcatcgaccaccatccgcgacggcccgccgccccgcgagagcgaacaaccacgggttgcgcggcccacgctataaggctacgtacaaggccgcgtgcagggcttggggttgggggatggaattttgggccttttggtggaatgaggggccgatacgttgcgttggggaagcccatcctatctgagagagttggagtttacacccattgggtcttaggcctgcctattagatcagcccaaatacgcccatttcaactcgtattcgatagctagagagacttcctttcccttaaaaaaaaaagtgagttcctttaagatttgagcacttttttttagaacaaagatttgagcactgaatcaataattaagtagtactactccctcaatggcggaggtaggtgtattagctggccggctcgctcccagcacgcaatgcaactctcctcgaccactgtcatgtcatctcatctaggccctatttgtaggccctatttggttctatgggctaatgtttagccctaacattttagcctcaaattagccctcaaggatccaaacaggtggactaattttgtatggggaccatcaagggatgctaatggggttaattttgcgtggggaccatcaaaatttgatatcctgaagtgccaggaagcaagctactgtatcacgctctagtactgaagccgaatataaagccttggctaatgcaactgctgaggtaatgtgggttcgtaaattgctagaagagattggtttgttgcatccaggaccttctcaattatggtgtgataatattaaagctacctatttgtcagcaaatcctgtgtttcatgctagaacaaaacacatagaagtggattaccattttgtcagagaacaggtggtgcagaaaatgttggaatttcggtttgttccgtcacaagatcaaattgctgatggatttacaaagcctcttcctgtgagacaattacaattgttctgtaacaatctcaatcttggagagttgagattgagggggagtgttagatgataagaatagttagctagatagattggttcttatcttcagtttgttgtaactaacagagagataggataagatctctcatcctttgtatgtaccacgctaggggttattcctagcctatataacatgcaggcgtacctggaggaagggtatcgcttccatcacagctaatggggttaattttgtgtggggaccataaaaaagcagctctctctctctcctctctttctactctctctccaccttttaaccttgaattagcacatggatccaaacataccaccttagcctaatgtttagcctaccaattcatgactaaacattagctctcaaaattagccctgggctaatcttccaaacagggccctagtacgccggatcgccgactaacgaacaggttgccgtcccttgtttaaataaacaaacaaatatttcttccccgttttaaaatataagaaaccgaatgtgatttactataataaacaggttgccgttccttgtttaaataaataaactgtgatattttttaatattataaatctaaaccgatcagacctaagatcggatgggatattttctagtagtataccgattcttaatagtaggaaatggcttatccgttttcggtttagtccctccttcccagtaccaaatgcggcctctgctgtgcatcggtgcatgtgccttatcgagttcttcggaaacttctgtgtgttgcgagttactacttgtttcaaaatagcactattttagaaagagaaagtaaagtctaacacattcacggctaagccggcaaaattctcaattcatgttaaggacctctcaatgattgagataatttgaagaggcatttcatttggcttctacctcttatatgattcaggcagcaatccccgaaaagtaatatgattcaggcagcacacaacgatttagacaatacgcattccaaatcatatttatatattttcacgatgtaatcatgcattacaaataatcgtgcgaataaacaaataagagcaaatagttagagaagctgacagcctgcctaaccactatagtaaccaaatacgaacacgagcagataagcaacaactcgtcacgcgtcaaccgccgcagccgccgccgcagccaccgcccccgcacccgccgccgccgcacccgcctccgccggagtcaacggccgaggcgatgatggcgccggtggcgagccccgcggcggcgccgacggcgagcccggctcctgggccgaacccgctgcggccaggcctcccggcgttcgccgccgggtacgcgtaccccgcggggggcggctgcgccgggtagccgtacgcgccggcgggaggcggcggcgggtacccctggccgtagtagtagacgtcgttcctgttcttccgccgctgcctcttggccccgtccgcgcagccgaacgcggcgacggctgccacggccaccgttgcggcgacggccaagatcaccaccgcggccgggctgagggaggcggcggcgcctcttccaacgccggcgtgaagggcatggagagccactcccgctctcaccatggcttgcgcgcccgataagagaagagatggagcgaatgaatatgaatgcgtgtttaaaagagagatgagggtccacggatttggcatgattggctccttttggtcaaagtctaccatatttgattattgaggagtactactactgtatttttttttaggagagtagtatactataactaatatcctcagatatgtacgcgaatatttagtattcaaataagtaaaacgactcgtacaacttgagaacatcgtgccctccagcatctctcaacgtcaggaaatttctgagcctgactggatgtggatgaatgtctctcccatgcaattgcagctaagcccaagcggttgataattactacctcctatagatgacgccgttaactttttctcacatgtttgaccattcgtcttattcaaaaattttatataaatgtataagatataaatgacacttaaagtactatgagtgataaaacaactcataacaaaataaattacaattacgtaaagtttttaaataagacgaatggttaaacatgtgagaaaaggtcaatgtcatcatttattaaaaaacggagggagtatatataaggaacgcgttagggagggagctcaggaggatatgcgaatagataacaaaagtcaatagcttcaagcagttgttgggatggagtcatggagattaattttctcggaccacttccagttgctcatagctaggttcgttcgttgactttgtgaaatttttaccttcttcctgtgcactctgagaggcagggtttaactttccaatttcaaagtaaaaactgctcctcggttttgccaaaatccgatcgaaaatcggtaaaaaccgatgactttcaattaacaccatacgaaaactgactaataccaatccttttcacaaaagtcgaccggttttcgcgaaattccagcggtattgcgaatcctgctagtgagaggcaatggagccgccattgcagacgaagatggagcaggcaagcaagatacgagggaaaacaaaaagattattctctccatacttttcgagcaccaaattccaccctacttactcccaattctgcacacatcaaccatgttactctccatgctttggcataatatgctcccggccggtcatctttccatgttgcatcgacgtcatactcactcgaacgatgtcgacactggctcttggagaaaggaacgacatatcacatatgtctatgatattctatcccttcatcaaaccaacaggtatacaagattatcactagctagcactgcaccatggctagagcccaatttcgctctcagctagcttggattgtctgatggcgacggaagatatttttttgccatgctcaagagatctagtcggccgatgatcaaaacgatgaaagccaccaaggcacaaaactcgatcatcatggctgtcaaaatatgcctgacgcactcgctggcatatgcatctcatccaggattagatagttgtttcagatatgattgcacaatatcctttaaatccagtcgatatgttatagcgattctgaatgacctctaccgtacttgttgtgcatgcactgaaagaactgaaactaaaatatgcaagcatgaaaaaatcgcaatcatgaaaggatcaagcatcaagtcacacaaatctgaaactgaaactaatttcgaagcgagagagattgagggagagaaaagagaagctggagaagccataataccacttgcaggtgggtctcaaaagggtttttatttttatttttgtatatagggccacatagatgccatgtcagcattaattgaccccattaactcgccacgtgagataaaaccgttattcaaactgctcaggaactggttttgatggttagaggatgctctgtagggatgcaaatgaacctccacctatagttgaaggaagtgaagtggacttttcccattcgaaatcagtgttgggccagttattgggttttaaagcaggccttagaaattgtttcggacgaaaaaaggctacccgattcggtcaaccttaaaaaactgcaactccggttctctatggcatatgctttccaaagatcgacaaagcccatcacaattcgcacgagaaacataagaagtcagctgaaaagcatcagttgagttggaccagtccagcagagataatatagtataacgaatctgaataatagtagttttttcctactaatatattgacgtgcaatccttttacgcgttcgaaaaaaaaagaataatagtagtttatgttttatcctaattctagattgtatttttttttgggaacggatggtgtaaacctgaagattcaacggattcacagaggatgttccaatcacagctttttagtctcgacgttcgagcagacgccgcctgaagcatccgtaggcgatttggtgattggcgagagctccgactttcgccaaagattcagcgtttgttattgttagtcaagaacggctgcgcggtgcgcgcgtacgtgtgcttttcctgatccactaattctcaggccatagctgcagacagtcagacatcctctgatcctctccatccagagaggcaaaacggggcctcttatcattttggatcctccatgagatgagctcaatgatttagctgcgaaaaacagctcgtcgacatgcagtaagaatgaagaacatcaagctcaaggaagttatctagattctactagacaagtaagccttttttttttctctgtgcccagttgatctcttcttcatttggttttcatagttcagttgtgttgtgatcttcttctgtgttcctcagctgcaaaccaagttctactggttgttcttctccttttcagtggaatcagaccaagccttttacgtgttcttgaaaaacatcgttctgagtcttgtagacaccataaacaaacacagttgacatgtgttcctgtcatgcaggccacaagtgattcttttgagttctgagatgattttgttcatgcatgaagtcctttctgaagtttattatggtgaactaaatatattttctgtaatccttaaatttaagcacgtggtgtagttccatctgttggcacatttgtaaacttaattcgtatttttttttgtcttcacgccggccgccgggcggctaaatccgtacaaagaataatcgcccacactcacccacacacacacccaaaagaaaaaaaaaaggctccaaaacaaagcagagttgttagttgttcctttcttttctatgaggaaatcaaaagcaaactaactgtgctcagctcagattaattctgaattaatcaaactaatggtggaactggtgaaatgtgaatagtacaaactatcaatgttaccttacaatcaagatatattactgctaattaaaatgtgcaatgatatctctgatttttatgcttgtctgatctatgcaatgacgtactagtacgcaaactccagagtaaagacaagctcaattagagaacgaatgtgagcatgtctactgctgttgccataagtaagtaccaagattaattagtactatcaccatggcaaaataaaagaccaagattttgcttatctaactgttcgtctcacctcactggtttcttcagtatcgtcagtctcggcaaccgcggctgcagtagtgatgctcgctctgatcaagcgatgccgccgctacaggaggaagatgaagaagaagatgctagctaggatcgcccacgaggcgaccgaacagcaccgcgagatggaagcccgcgacgcggcggacagcgtgatgatcgagatcggccccgtggagaagttcctcaacgagatcctcagcgagaagccgatgcgcttcacctccgagcagctggcggcgtgcaccgggaactactcgtcggagctcggctccggcgggttcggcgtggtctacaggggggagctgcccaaaggcctgcaggtcgccgtgaaggtgctcaaggtgtccatgaacaagaaggtccaggaggcgttcatggcggagatcggcaccatcgggaggacgtaccacgtccacctcgtcaggctctacggcttctgcttcgacgccgacaccaaggcgctggtctacgagttcttggagaacggctcgctggagaagtacctctacggcggcggcggcgaggacagggggaagaagctggagtggcggacgctgcacgacatcgccgtcggcacggcgaaggggatcaggtacctccacgaggagtgccagcagcggatcgtgcactacgacatcaagccggcgaatatcctcctcaccgccgacttcaccccgaaggttgccgacttcgggctggcgaggctgggcgagcgggagaacacgcacatgtcgctgacgggcgggcgcggcacgcccgggtacgcggcgccggagctgtggatggcgctaccggcgacggagaagtgcgacgtgtacagcttcgggatggtgctgttcgaggtgctggggcggcggcggaactacgacctcgccgcgcaggcggagagccaggagtggttccccaagtgggtgtgggacaggtacgagcagggggacatggagtgcgtcgtgtccgccgccggcatcggggaagaggacagggcgaaggcggagatgatgtgcaaggtggcgctgtggtgcgtgcagttccagccgtcggcgcggccgaagatgagcagcgtggtgcggatgctggagggggagatggccatcgtcccgccggtgaaccccttccactacgtcatgagcggcggcagcggcagctcgacgctgacgagcagcagcacgaacctgagcagcgggggcaccactacaggaagcagcgaggtggcggtcagccttcctgccaaaaagtccacggacgtcatggttgaatagtctaagtccaagtgaaaatgttgacccttctccctttgtacaacggtaccagcgagacaaagatttcgtacatattttatcgtcataatgttgttgcaattatatttgttaataatgtaattattttttacctctgtttatgagtttactagtaccggattttgaatcactttctaaaaaagaataaaagaaatgtgtgaattttcgtaggaaaaagtctttgcctccctcaaggtaataattctttccctctctatatatttatcgataaattttctccaaaatatttatcagatataagtatagtaaattatgattaattacattataacttgtatgtaattacaatgtacacggtaagttgtgtgttaaaatccctcgttaccatgctatatttttgtaaaatagagattgtgggaccaaatcccctcatgtgcgcacactatgatttttgtcttcctcgcttgcataagacttaaaacagatctaacagtttaaaaatatatgaaagttacacataagatatactgtatttacatgtaagttagtacaatataattacactatgatcacactgtatttacatatgttaaatttcagagagaaaaattgtcaacaaatatatagcaaaatcgatcctcctctacctctgatcctcccaatgacagtcagggcccacatgtctaacccatcttcctcgctacagagtacagactgcagagtcgaattgagtcacaccgaaacgtttaaaaccaaaattagcggaacaaatacggcactataacagtctaacacactaaaatgttgtagacatgcacttatacacatcagtaggtgtacgtctttgaacacaacagccttgctgacaactcacacccgtgctgtgcaaacgtggaagaatcagaaaacgggaattcgtttccgacacgtctacctgccggtacgagccgacgaaccatccgattccgtggtggcggtagtggtggtcggcgacgagccggcggcgctgtacggcgcgaggtgggcgaacgggttgcgcggcgcggcgatgtggtcctccccttccagcatccgcacgacgttgcccatggacggcctgtcctccggcctgtactgcacgcaccacagtgccaccatgcacaccctctccgccttctccctctccctcccgccgcccgccgccgccgccgtcgcgcgcgccagcacggcctccgtctcgccggcctcgaaccggtgccacacccaccgcgggtaccactcctggctgccgtgcccgtgcgcgccggccccggcgccgagctccaggttccgccgcctcccgagcatctcgaacagcagcatcccgtagctgtacacgtcgcacttgtgcgtcacggggagcggcatccacagctccggcgccgcgtaccccggggtgccgcgcgcgccggtgatggtcaggtgggtgtcctccctgtcgcacagcttggcgagcccgaagtcggacaccttgggcgccatcccggcgccgaggagcacgttctccggcttgatgtcgtagtggatgatccgctgcgcgcactcctcgtgcaggtaccgcaccgccttcgccgtcccgacggcgatctcgtggagcttctcgaacccgatcctctccgccgccggcgacggcgacgagtcgaacaggtagcggtccagcgagcccttctccatgtactcgtacacgagcgccttcacgtcggcgtcgaagcagaagccgtagaggcggacgaggttgatgtggtacgtcctcccgatggtgccgacctccgccatgaactgctcctcggcgcgcttcccgagcgtgctgttcagcaccttgacggccaccggcgcgccgctcgggaacacgccgcggtacaccacgccgaacccgccggagccgaccttgtgggcgtagctcttggtgaaggcgcgcagctgccgcgcgctgaaccgcacgggccgctcgttctggaggccctcgatgaagtggctcatgctgcccatctcgacgacgtccgcgtccgcgccgccgattccgccccggctgctgctgctgccgccgccgttggcgatgggcgtgtgatggtcacgactgctactataccacattttgatggcgatcttggcgcacttgtaaatcgcaactatggtcacgactgctactataccagtcgtgatcaccccaactgcgatatgttaatcaaaattttgttactacaagcgacatagatgtagataataggcgatgcatatgagtacatcgatcatacttactgagtgctaaagcaagacttccattggcgatggccatgctgatgaactaccaggaggggttagctacagtgtgcaaggagtgttggctacttggcttatgaagtgtcttcctgccttgtgagttgtgaggatatttttattggttcattttgtttgcagctagctgatttgactgtttctgtgtgccactgtcaactgtgctagtgtgagagaaaacaatgtttctgcactcttcatgcttacgcgatgaacacaaagatttgataaattcaataaactaaaattagaagaaggaatactatgtatcctgtttgattggtgttgactaaactagttccccttcctttctcaccaagtaaactattttaatgattttttaaaagaaccgtataaataccatgaggcttcattttttttaaacacagtacaaacgcagacacttatagaaaaaattacaaagttgtaaccctaggagtaggagcagagccggttctatgcaagaaaaaatagtgagaccatacagtattaccatgtacatatagtcgtgatcacaccaactgcgagatgttaatcaaaattttgttactatgagcgatatagatgtagataataggcgatgcatatgagtacatcgatcatacttactgattgctaaagcaagacttccattggtgagggccatgctgatgaactactaggagtggttaactgcagtgtgcaaggagtgttggcttattaaggcttctggggagataggggagattgagtctcgttttccgtgcgcatgtttttcaaactactaaacgatgtattttttgcaaaaaatttatataagaaagttattttaaaaaatcatattaatccatttttgaaatttaaaatagttaatactcaattaatcatgagctaatggctcaccccgttttgcgtgccttcctaccttgtgagttgtgaggatatttttattggtcattttgtttgcagctagctgatttgactgtttctgtgtgccagtgtcaactgtgcgagtgtgagagaaaacaatgtttctgcactcttcacgcttacgcgatgaacacaaaagaatttgataaagtcaataaactaaaattagaaggggaatactatgtatcttgtttgattggtgttgactaaactacagcttccccctacaactgattatgcttccattttccccttcctttctcaccaagtaaactattttaatgatttttaaacaatggtttgttaaaaccataccaccctatatttacaaaatttgagatatgccatccatatcttaattacatgtaggacctacatgagtcaatgacatgtgggtcagggtgacatatcataaattttgcaaaatttgtatggcatggtttaaattgtccctttaaacaaactgtataagatgtcatgaggtttcatttttttaacatggtacaaacgtagacgttcatagaaaataaccacaaaattgtaaccctaggagcagggccagtcctaaatttttggaggcccaatgtgaaaaaatatagaagccctacaatattagtgtgtgtgtatatagatgtacgaggacaaaattaactttattttattatatggaagtcccgtgagttcacatacgctcgaagtgaccgagatcaacagaacattcatacaccccaactgcgagatgttaatcaaaattacaaaaaaaaattaaagagttaatacaactgtgagcaccatagataagctaattatcgatgaacatataagttgtactccctcctttttttaatagatgacgccgttaactttttctcacatgtttgactattcgtcttattcaaaaaatttacgtaattataatttattttgttatgagttgttttatcactcatagtactttaagtgtgatttatatcttatacatttgcataaaatttttgaataagatgaatggtcaaacatgtgagaaaaagtcaacggcattatctattaaaaaacggaggtagtatggattatacttactgatcgctaaaacaagaattcctggtgacctggtctgaccgccatattgatcagttaggactggatagcttcagtgcaaagagggatggattattggcttgctgtgcctgtgacgtttttttagttcatttaatctgctttcatgcttgtcatttttggacatttatttatcacgtttgtcaacttttacatatatagttcttccaagtgtgcaacgaatggttcattcggagagaaaacaaatagtttctgcacccttcacactcggacgataaataaggggctgcttggttggcggcttggaatgccacgccacggcgtggctcgccacaggagtgtggcggacgtttcgtccgcctcagaaaacactgtagcgtggcgaaaatactgtagctatggcattcaatggctgggatccaaacacacccttaagaatatgagcaagtcaatggaactgaaacttaagagaggaacttagcttggtacgatgatagcgtccgctgcgatgcatggaacagcgtgtattggttctaaaaaaaaaaaagaacagcgtgtatttgtatgtcgacttccattttcctcttcttccctctcagaataaacagttttattgcttcttacatcaccggcaatggcgttgatcaactgaaaagtttaccatgtcaatcagaattcgccctccttgtgaattgaaaattttcaacttgtgtcacaagtggttctgttacatgaacagacagataccgtcataccaagttaccaactcgtatagtgacattttgatgggccgcattcaaagcctcaaccttttgtggggccaagagcccattaatatgctagcaatttctctaggaaacatgtttatttacagtacctgtagtacaagatgacacgttgagtactccctccgttttaaaatgtttgacaccgttgactttttattacgtgtttgaccattcgtcttattcaaaaaatttaagtaattatttattcttttcatatcatttgattcattgttaaatatactttcatgtacacatatagtcttacatatttcacaaattattttgaataagacgaacggtcaaacatgtgctgaaaagtcaacggtgtcaaacattttgaaacggagtaatatttgagtgtctgcactccattaacgttcccgttcaaacatgacatcatacatgcacttgctgtcataaacttgatagactcagccgcttcctttggattgactgataaaattttcaactcctattacttgctgatcctgctggtgttctgtaaaataatattgcactgcgtgttctgcgtacacacgtactctaaagtttgaacgacgtgtaacggcatatgcatatgttaatgatcctaagcagtacgcgtaagcattttttacttggtagtttagagtatgtgccaagtttctgtaaattctccctgcgataccgaccctgataatcaccttt

SEQ ID NO: 60653 - DNA, 3917 bp, Oryza sativa
  unsure (1)..(3917): unsure at all n locations
ctaatggaaattttgtgcacacatgtagctgggattatcatcggtggcattgccgccatcctggtcttgaagttcatcatgagatgcgtggaggccaagcacgccgaacgcgcgaggcggcgggaggaggaggcagtgccagtgtcgccgccggcgagcggcacgtacagcagcgtggacgtccgcgtcgagatggggtcggtggaccgcttcctggacgacatcctccgggagaagccggcgcggttcacgccggagaacctccgcgagttcacgggggactacgcggagcggctcggcgccggcggcttcggcgtggtgtaccgcggcaggttccccggcggcgtgcaggtggccgtcaagatcctgcaccgcacgctggaccgccgcgccgaggagcagttcatggcggaggtcgccaccgcggggcgcacctaccacatcaacctcgtccgcctctacggcttctgcttcgacgccaccaccaaggcgctcgtctacgagtacctcgagaacggctcgctcgaccgcgtcctgttcgacgccgccgcggcggccgccctcgagttcgacacgctgcacggcatcgtcgtcggcacggcgcgcggggtgaggtacctgcacgaggagtgccagcaccggatcatccactacgacatcaagccggggaacgtgctgctcgccggcgactacgcgcccaaggtggccgacttcgggctcgccaagctctgcagccgcgacaacacccacctgacgatgaccggcgcgcggggcacgccggggtacgcggcgccggagctgtggctgccgctgccggtgacgcacaagtgcgacgtgtacagcttcggcatgctggtgttcgagatcctcgggcggcggcgcaacctcgacacccagcgcccggcggagagccaggagtggtaccccaggtgggcgtggcagaggttcgaccagggccggttcggcgaggtcatggcggcgtcggggatccggagcaaggacggcgagaaggcggagaggatgtgcaaggtggcgctctggtgcatacagtaccagccggaggcgaggccgtcgatgagcagcgtcgtcaggatgctcgaaggggaggagcagatcgcgcggcccgtcaacccgttcgcgtacatggcgaccatggacgcgatctccagctccagctccggcggcggcggcgtcagcaccgccacctccgcctccgcctccggcgactcggcgcaatcgactcgacatgacatctgccattgacatatgcttgggacaaacgtgcatgtgtacccattttcgtgtagtacatttggatgagctgcttggaactttgaatagtatgtaaactgataggcctcggttagaatttaatatgcttgaaaaattgcagtttaaggaaatttcattcaaaaatttaaaaattttaaatcgcacgtacattttaccatggcgagatccctctgcttttgaactctcaaaatcaaacatcaggtcagctggtggcctggtaatgtaactcgattattattgggccattcggcccagcattaaaatgatgtgaagaacagcccagcccagcacacagaatgcgtcttcgtcgatgggtggcgtacctaacatcgacggcggataaagcgtaatcgacggcgtaaggcggcgggaggggaacattttccagccgccactctccccccgagagaagacattccttcacccacctacccaaacacgccgccggccctgacccaatgcgtgcgggcccaggcctatccactggatcaacgggcccacatttcatcggctacctcacgttgtacatctggaatctggagcttattaccaaaaaacctcgtgtacccaacacgtcagaattgtgacccatacgagtcacagacaactgggccccaatgcctatccggacccaccgcacagatacagttaaatcatcttctgttgatgaaagattagcagcggaaagtcgcatcgaaactgaggcggcgattggattgtatgtgtcactgcaggtgggcccgtgcacgcgaagtacaagggggtgtcccgcttgtcataggatgctgcacacgcacgctcccgcataaagcggtggacttagcagttacagtagttattcccccttcccaaaaatcgcctcagattttctggttcgaaatcctctaccccctcccatggcgtccctcttcagggctcgccgccggcgatcgccggaggacgacggcgagggggaggacggatccgcgtccgggcgggtcacccgccgccgcctgtcgccggaggagggcgcgctgtcgctggccgaggcgtcggcgtcggtggccgcggcgggggcgggggcggagagtagccccgggtggctctccagcatcgtgtccggagcgaggagggtgatctcctcggtgttgttctcctctcccgaggaggccgcctcaggggaggaggaggaggacgacgacgaggaaggtactccttgagcgccgtggagtagccacgctgttcctcatttcagatttctgtttgtcactctctccttgcttgcttcactgaactgtttcgtctacttgaccgcccgagttgtgccgctgcggttacttgcgctgttgggtgctaattacgtcttcgctgcaaagctagggtttcggcttgcttgctctaattagagtagaagtagtggaattttgataattcggggtcagtagcagagagagagtgtgcgctgacggttttttcccttagtagactgtggttgggtaagaattttgcggttttgccacattaggtggaattggggataagcttggtttgactccaattacacagtcctagtgttgtggaattagaatttgaagtttacaatgtggagtgctccggctgctgtattcatcaatcgatgcttcagcagcatcacacttccatttggtatgcttgcgaagataccatcattgattcatcaacacaaaattaaaggcatgtatttggttagctgccaccatcctaaggtttataatgtcctgaaaattatgatacgaggtgcagagggcttaatttagatctggcatggttgttttcagaatcaacctcatttgggaaccacagttacttgcatgaacatcgagttaggatgacatggtgcatattattggaattcagaaaataattgagccatcttttgtcacatatgctagatatttccagaatgtagaatagttgagctatttgttattgacctgttagttctattgtggtttgagaaggtgctcgatctttagctttgtaatggtggacagcacttttaattgaccttagaccattttagagggatgcactgcagactaatcagtgttttgtacttttgcatatgaaggaacagtgtttccaattctgttgagccattttacctttcgtaaactgttcgctcacacaactacattgtgctgcccacattcagatgaactatttttgggatggtttatgagtgcgttcatttgtaatacctgtgcagatgaaacagaagacaatcatggagcaatagtttcatacaatgagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 60654 - DNA, 3039 bp, Oryza sativa
aaaatttcgagtcaagattagagtctcgtcacatcgacagtagtggagtgtaggtccaatcgacggagttgtcttagaaaagttatacgtagtacttaacaaatttcttgacatagaaacattgtattttttttttgagaaacattgtatttaacaaattaactttttaaattgaatttgaacctataatattttcatgtacttcctctgtttaacaatgtaagtcattctagcatttcccacatttatattgatgttgtctatctagattcattaacatcaatataaatataagaaatgctagaatgacttgcatttgaaacggagggagtataaacctttgatagaattttttttcaaacgagctggtacttagaaagtctgaagtttcatgaaatatagggcccgttaagtagatcagcaactgcggcatgcagctaggatgcgtgcgtgtggtactgttggttttggctgcggcacagtcgtgaaatcaactgtcgaacaggcccaaagcatgaaaaaattacaagaatataaccttaaaagattacataatcagaaaaagaaaaacaaaacatcaccactatgcacactttactgaggaaggactagcatcgaacctgctgctattaagctttgaccggtcatcgctaaaccaacaataagctttaattgtactctccatccttaaaaaagatataggatgcagcacattctagcacaacaaatctagacatatatacgtacagatttattgcactattttttttttgcggagaacagatttattgcactataatatgtcacaactaggaatagattgattttttaaggaacggatggagtatctccaaagtcgggactccaaacaaccgaggaagatgtttggacgagtatgtcgcgtgagttcgtggcgcacaaattgttcgcggatttgccatttcgctagcaggctgctccactagctggctcgaataaacggagaagcgatacgcgtatatacatacttgtgggcgtaacgtaaccgacggaatccaataatacgcacttagtaagtctaattttgggacagcaacgtggtctacatatttggggcaagcaaaccgccaccttttcttccccagcccttgcccttttcagggtgacgtggcatccttcctctcttcaaccctttcttcacggggccccacgtcgttgcttgtggagctcgtcaacgtatatacgcacgtcccgtgccttgtcgcccatgacttgtcagtccaaaaacgagacagagtcacggttgaaatcttgcttcaactgcactaaatttcgtccaatttggaccaagcaggacacgatctttggctgtgttcagttcatgtgccaaaaattttttaagtatatggacacatattgaagtattaaacatagactaataacaacacaaattacagattctatcttaaactacgagatgaatctattaagcctaattaatccgtcattagtaaatgtttaatatagcatcatattgtcaaatcatggcgtaattaggcttaaaagattcgtctcacgatttacatgcaaactgtgcgatcagttttttttccacatttaatgctctgtgcgtgtgtctaaatatttgatgtgatggaaaagttaaaagttcaaaaaaaaaattttaactctaaacacggcctttgatcaaatcgataaatttttgtacgaggactaatcgtggtaattgattactagtagcagtagactaccgtggcaggtcgaataatggggggtacagttggcgagattatgaaattggataaagccaaatttaaatacgtaaagagatgatgatggggctcaatttgcggtcgagatttacaaatatttaaatccgtcacaatattcacatgcgccgtttgctgtacacatacgactaccactagtaccctttcttccccaaaccccctcccgatttctcgtttttgctctccaatttctcgcgagaagccgaagaggaagagagcgagagagagagagagagagagagagagaggagaggaggagttggttgagatggatctgttggagaagaagaacattaagaaggggggagaagtggaggaggaggtggcgcgcaagggagaggagaggaaggaggaagaggtggtggtggaggagaagagccatcagcagcagcagcagcaaggggaggaggagctcgtcggcctctcgctcgccggcggcaggtagttttccggctccgccttctcctctcgcaagtcgagtcctattcagctttgggttgatcgattgggtcgcgggagagagagtatttggttggttgttcgggaaatgcatctcgcgcgggattctagccgcttttcagttcatagtatcgccccttctccgagaactcgccgccggggagccgcttcctgctgggagccgagcggcgccgcagccgcctccgaagtggtttaccggaggggatggattttctccggtactggactcctggtgtttgaatttttgggtggaaccggagactctttttttggtcgggtgaaattccttggaccgaccaaaaaaatctcgaatccactcggagtttcctccgttccagatggagctcttgcgttgaaaattttcctaaaaatagagtcaaaatgtttcgacttcgagttaagagtccaccctacaccgagttgcaactttcccttttttacgagttggtgtaatcatggaagagcccttagctttgctgcagtggatcaaattggtgggggttcttgcctaggtcatgtgaagattcttctgattagtggtagtctcatgcttctcctcggcctgcaatccaaatcccctttattcctttcccgctctcttgcgcttggcgtcagctgttcttaaccttgaacaaattagggtgtcattctagttgcacgtgttcttatccagatgttgggagtgcggtgaactgctgatattctactaaaccgatatcaattatatggatgttcaatttggttcacgtcactaggtaaatgatttccc

SEQ ID NO: 60655 - DNA, 7804 bp, Oryza sativa
tccatgtaccaaggggattcaatggtaaaggcctcatccccttgtcttatctttacttcaagactaaatctgtagctggggaccaagtaccatagtttcgcaactcttatataatccactaggctgctgtgaaaacaatagatgcagtgtttgttttgaagtaagtaaggtgaaagtaaaaatacctggtaatggctaatatgaatcgtggctattattaaatgtttcagcattttctgaataggtaaaccacatatatgtaactatgtaagatgtttttaaatctagatgttctattgagcctgtaacctggtcttttagactagattatgctgagactttgaagaaaaaaatttcagtacattccgtccatcttggacaacctttggacagattattaactctgaatcagtcccatcatgctgcacatgttggatatttcagagtggaccataaagttgcaggcctagtttgctatttttagattttagatcttgtgagttttaatcttgatcatgctattagactcagaatgtgtgtaccaaaaacattgataatggtatctatcctgacttgggtataacttgtgttactggcagctgtgggagggctatgttggcgtagcgtactgaccaagagataatcctctcatcaagtagaatatagagagtagaataattatttatgaaggagatgggcctttatctggctgcagacaaggtgcatagtaaagctcattaaacctctaaaaaaggctggaaatacggcctacggtgtaattgcacattatacatcagttagctaggttggcctccaattttatatggcactttacccttggatgcccatcttatgtattgccatgtactcatgtatgcaattagtcaagaacggcccacttatgccaatatctgtgtaactatgcaatctgttattaccttcttgcacatttactaatttcgctttgtcataatcaggcccaaagtatttccaatgtcgagccctccacctaatccttcgcaacttacaattttctatggtggatcagtatgtgtttatgactcagtgccgccagagaaggtcatattcaccccacttatcttcgttatatcctccgactaactgttgaaagtttatgctaattcgttatctgcaacattgtcatcaacaggctcaagcaatcatgcttattgccgcagcagctgctgcagcggcgtctgccaccaaaagcaatgctgccattgctgttaagccccctgtgatgcctgcagccaatgctacccaagcagcagtctctcctgtgctcacaagatcgctctcattgcagagcacttctgtagcaactggacaacctcaagttgccgctgaccctagctcaatttgcaagctccaggctggtaagactacaagatctttttgtgaatctaaaatggggctgttttaatccctcgtcatatgatgtactaagtgattgaagatgctacaaatttattctttatttgctgtgcagatctccccattgccaggaggcactcccttcagcgcttcctagagaaacgccgtgacaggttggcatgaatgaatgtagaaatagcattctatatttgtctgatgcatttccttaggtttagtggtccattagaacatgctaaaagaatgtggatagctggaaactgacttgtaggggataaaacatttgctttagcttgacttggatacgaaccaagtatatgtgcaaggactgttttcagtttcattaccatagcccatgttttcatgatacataacaaagtagccagtagttatagaaacacagctttctgcaaatttgagaaatccttagcttcaactgattaagccaaatgaccatgttaagcaggttggtgagcaaagctccatatcccacaaaatcctccgagggcatggaagcatcagggatggaagtaactgctgagggcaaggcccagtaactgtcaacttcgaatggtggaggctgacgtttggagggggaaggaaggaaaggcgtcgcgttcattgtttagatggtgtcgcaccctagaaccttactaataatcgaacctatgcccttattatcgttgtactgttccttatgtgctagtctattctgtcatgaatttgtttactcgaacagcaaactgctatgatagtagtatatcattgtacatcatgcatatcattgcctgacaatgttatcgtgttcgtctagtaatgatatcatccaggttaattgttactagtaaatttcagtttcagcagctatgatagtagtatatcattgtacatcatgcatatcattgcctgacaatgttattgtgttcgtctagtaatgatatcatccaggttaattgttaaggtggtgtttacatccagggacttaactttagtccctgtctttagacactaatttagagttttaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgagttttattaatagtctacgtttaatatttataattaattttcaaacatccgatgtgatagggacttaaaagttttagtcccatctaaacagggcctaatttcagtttcggcactggggttttacagtgccagatgcatgaaagttgaggatggttttcttgtatctggcattccggctgttcctccattttacaaacagcatttgttccagatcttacgaagcttacaattttgcagtgatggattcctatactagcatttttttcgctgcctctgctcgactgccgctccggtaccatgctgacagtgtcaaccggcgaattagcccaacgcggcagtctgaccggccgccggagacgacttgccacctgttgctgccggccgcattgagtattatagtagtactgcacaacataaggtgtgtttagttcacaccaaaattagaaatttggttaaaattggaacgatgtgacgaaaaagttagaaatttatgtgtgtaagaaagttttgatgtagtggaaaagttggaagtttgaaaaaaaagtttggaactaaacacggccatatttcccatatacaaccatgccactgtacatgctgccaaggagtaccgatgttcaatcaaaattcaagacagattcaccaaaccttttattttttccatctagcatctcacatgcttaaccataggccatattgtaccagaaaaggagtgaactacgcccacaacacaggtacatgatcaagaaggagaatgtcacacagttgctgcagattctaaaacacaaaaacggaagggaaacatgaggcttaggtagggagttgcatatagtgattgccacggctactgtcagtttgtcatgcatgagtgctgcgcaagatcccatggatgtaaccaccgaccatgaccaaggagacgagggaaacgacaccagctgggaatatcttcccggacttcttgaagcgagatcccatgaccgacaagagggcagcagatatacctagaatgcaaagcgagacaacatcagggaaagactccatgttgaagtaattccatgccaaggataataaggaccacaaggtccacaacataggtggctcagaaaatgattttgcatacctaaaccaatagatgatgcaaagacaggtctcactgggagttgagtgtggacgaagtacaggaccagggctgatatgcctcctgcggctaaggatttctggcttccactcttcatgtaccccatcgctccaccggctacagaatttggaatcacaatagtcaatttctaacaaaaatgaagctctcttttgatggcaacaaccaatgcttcaatataatctatcctcagatgcaccttgaaggctagaacaggctgtcaggctctgatgtagaacctcacacaggatggtaacaccacacagtcattcactccagtagatcataacgctattattgaaccgatgatgcagctaaaattataacaggactatcatctgctagtttcacagacataatcacaatggagaaaaaataattcaaaattttaggatgatcactcttgtgttaattttcttctttttttttttaggatgttcatttttaggtggttgtttagctgtactccatttcattcttcctaagagaaaatttgtgcacattgtgcttgcctgtaggccaaaatttgtgcacatcctgtgaccagtgatatacagagtgctaatgcaccatttgtgtttgtgtctacaaaaagcacatgctggtagttgtatcatcattgttctgatacaagctggacttgagaaaccaaaactcaaaaagcaggctgctgaatctgaatgttgcataggtgttctggttttctacagttggaaattatcaagtacccagtcaagtccaacaattattgatctcatcaaattagtaataattcgacctgactaataaggatttaattttattcacgagaataacctgacaagtatgtgtgttctaacttattgggaactagttggtgaaccagaagttgaaatgcacacaattaccccaatggctaatcactttgataaagaaatgcagtagctctcattctccaaaatcaaactactcgaatccaaggcgtttgcacactacagtagatcagtaggagtactaaaaatgaactggtcgtggcattactgcatttttacctccgacgagagcggcgtaggcgagggtgatcttctgcgacatggagagcccctgccccatcttctcctcctccccttccccctcctcgtcgcccccaccaccccgcggcttctcgctgtccccgccgccgccgctcccagagccgtcgcctgcgcctccgcctcccgatccgccgagctcgggctccctggccgcgacggcgacgaggaggcgcgcggaggggcggagcgagagggcggccggggcgcgggggcgcagcaggaggagcgagcactgggagatcggggaggatggcggcgcgagggcgagtggcgcgagtggtaaggtcgtcgtcgcgatggccatggatgagctcgagttccaacttcgagtgctcgagatggaggtgatgtgatggggattttttacggggaggttggtggtgtgagactgtgggtgggcccccggttttctttttcttttcttttcttttcttttcttttcttttatttccttttctttcttttctttttctttttggaattcctttttttttccttttctgttgctggatttttgggttgggttgcatctagaaggacgattcgtttcttgtggagcgcgtgggacgcatgactgcatgtgcaccccctgcatcatacgcatgttgcccaataaagaatttcaccacatttctgaattatgattttaaaattaagtttaattttttttccctggttacacggagcacacatacgcacacaccgtcgtacacgtataccagtgaagaatataaaaaccttcaagagtttaggtaaacacgtaccacgcttgcaaacctgcgtactccttccgtttcatattgtaagactttctaacattattcatatttatataaatgttaattaattaaaacacacacacatatatatatatatatatgtctagattcattaacatatatataaatatggacaatgctagaaagtcttataatatgaaacggaggtagtaatatattttgacttacatatttatagaataatttagggaattcttttgatctaacaaactatagagcatcgtgagcacgccttttaagcttctaaacaatacgattgtggtgtaacttgcattatcaatattttttaaacacttttctaaaccaaccttttcaaactttataatactagttgattaattcatttatttgtatcttaaataattaccataagagctatattctaccgtgctactagttgtacagccgcagctgtcagacaaccattgctaccgaacatccctataagctaaggccgtgtttagttcggagtattaaatatagaaaaaaaaataattatatagattatgtgtaaattacgagacaaatcttttaagtctaattgcgccatgatttaataatgtggtgctgcagtaaatatttgctaatgacgaattaattagacttaaaaaatttgtctcgcagtttacatgcagaatatgtaatttgttttattattagactacgtttaatactttaaatatgtgtccgtatattcgatgtgacacgcacaaactttaaatagggcctaagtttcatttacaatactatccccttggaccaaacctttgtaatattcattataacaaacctttggtaatgttcattattggattatgatgcttcacacggctaaacaaaaaagctttcaactttatacatacctagtccaagattgtgactctgaccagtaacaccggcacacttgcaatctttacaaaccggagaaaacgacttgcaatctttacaaaccggagaaaacgaccgtgtttctcacccaacctcaatatcaaaatctctctttttttagtttacttccagtatatacaaaaagcttcaaaatttatagcaacccaaaactgacgaactcgatcgcttcactttccaccaagacttcacctgaccttgccttgccggccagcgtggactcagaaaacagtagccaagtctcggcaaagaggaggaaattgcccaaccaaaacacccacaaagaagaagaggaggagtcgccaagacgtcgtaggcaacacctcccttcccccctacccttgaaccgaggccgagtcgtggtcgccgcgagtggaaggcaacaactctccaaggcaggcacaggcagcagcagcaggaggagaggaggcaggcgcgggcggcgtgagcagcagcggcagcgccgcattacagccttgggagtaggaggaggaggaggcagcggatgatgatccctagggaaggggcggtgccggagcccgcggcggcgtcctgatccccgaccgacgatcgcggctgctgctgttgctattttttcaggttggttttggtgctattcgattcggtttggttattcacgagttcttggatttggggtagtttggatttaggattagtgggtgtagtgcttgctttggttaggtgcggcgtggatctgggaggtcgatttagtatgctctagtttggtatatgtgaattattcagcgcgatttgagaatattgaagctgatttatgaacttgagcatatcatagagaaaggaagggagcgaatttgtggagaaagttgcttctttttcacacttagaatagttttatatacttttaatcaactgattagacttcctgtggtggtggttatagaggatggagaatcctcagattgagatgggggccttcaaggcgaacggtccgcaattgcagaatggtgggctacgttccagcatggttcagtcctggaacctgcagagattcgttgagagcgcgctgcggagcatcaggattgtcatattcacttctaagctcaatctgctcttgccgtttgggcctgcgtcgatcattctacactatactaccagcagacatgtaagtcctgttcacagcaactgaactctattcgaccgcattttgtttatatttatcattgttcgtaggctagaaaccagagtaccctatcgagatgaactaataattgggct

SEQ ID NO: 60656 - DNA, 16624 bp, Oryza sativa
atgggtgtctattctttctgaatacctggttaatgccattgaggtattccttctcttctaatttagaatgacagcacaaaaaaaaagtagctgttcttaatatgtgcaactgacaaatgattttttttggcctgttaaacttgacaattaactctattttgtttatattgggttactcatatcagggaaaatgtccaccttaaatttggaaatgattatttgatatatgataagagatgtttacctctttctgatgaaagtccatgaatattgcatctctaatactgtattttaggacagatttaactgctctggccatgttatacattgtttgtcttacaggtcacctgagtacctctgcatgggtatactattgatcactgctttgctctttgctatttgctatcagggggcatctgattcactgaacctacccgtggcttttatcagtgttattttgcttcctattgtgggaaacgctgctgaacatgctagtgcaataatgtttgccatgaaagataaacttgtaagcatttagatgtgctcagttttgatgtttctttctgattcttctgttgtctcctaactgtctgtgtacatgattgtttctctgctgcaggacataacactgggtgttgcaattgggtcatcaacgcagatatcaatgtttgtggtaatgcatggtcaaacttgttatctcactatgatctgagtatgcatttccgcacttgttcatcaaataccatgctggcatgaacgttctacagaatactgtgttcattccagatcttgcatttgttcatttatcatatcctattttcatctttgttattttttacatatgttattctccatatacagattccattttgtgttgtcattggttggatgatggggcaaaagatggacttgaatttccaactattcgaaacagcaacgctcttcataacagtactagtcgtggcatttatgctacaggtaggttattgtgtgaaatattaagaattattttgataagggatgcctgcttaatgaagagtttgtcaagctgtgtttgtttttgtatgccttggcacatataacccctccagagtaaacatgttctagcggagtagcggtactaaacgattgttttaacattattaagtatacagtcaagtctttctcaagcataatggtcggtggttgctattggttagtgttgtaatgttcatattatccaatgaacaaatgcttactctttaaaggaactagaactgacctactttatgtaatactttttaccttcagtagtggctttaattatcttgtcccacctcgcttgtaatattagcccagtaaaccttcaatagtaatatgctgatcaggctttcttgttatttcattttcacactatctgctatagctctcttatgaattacctggcataggttctgatatctcaaccatcaccagttgatcacacgctctttctatgtttccacaggatggtgttgcgaactacttgaaaggacttatgctgatcttgtgttatctaatagttgccgccagtttcttcgttcacgttgatccacaatccagtaagtagagttacagactactttttcttcatttcaatgtcacaatcaaacttcattaatttcatgaaaagagaagaactccgacattgacagcttactccatgcatgttttgtggtggtcatatgtaagaaattgttcttgccatggtttgatagtactagtagtagcatttggcatgtagttgaaatcaaccaatggctatattagatggttgatctctggaaggcatatgagcagatatacgctgtgatcttaagtgttgactcccaatttttttgcaggcgatgattgatgccacggacactgtaattattgtaccaaatacccttgaagcctttactaatcttaattctggtgagttgctcctccgtagcagagctcagcctgctggcaggagctggcagaatgttgacacggccgggaaaatcacgtggtgtcggttagtttgtccatgatctgcagcagcaattattgcacgttgcaatagtcaaaagatctgaagggcatctaggaggaggggtggttgtaatgtatacagattacagaaacaaggaaatgcaatgcaatgtcgcccatgtaaaaagtctccttgcatagttgcattcaattaattcagttaatgtggccctggcccgttctctcctgttctgctttggttgctgtcatttttggggcttaattgccgtgttgtgcacttgtgctgctatcctgtgccaatgggaaatctattgaactagcaaatgcagaagataccttagatctaaataaccgacctgggcagttgccaatgcgcaggctcatatcatctgcttgttggcttgtcagccataactgaattctgaaacattattttagattaaagctgtaagcctgtaactgaattatgaaacttagttgctctaggatttttcttttatcgtagcctattttctagccttttaacttttaaagcactaataacatatagacaaaaattttagtcatatttttttcctggttgcttttttttctcgcaagttttttaggaaaaaaactttcaaaagtaactatagtatagtatagttgtataattatactatactcataatgtaaaactctttttagcattgctcacataatatatgtctatattcattaacatctatatgaatgtggataatgctaaaaagacttacattatgaaatggaggaagtagttacattgtaactacagtgtaaccgcactgtacatatactccctccattttttaatagatgacgccgttgactttttctcacatgtttgaccattcgtcttattcaaaaaatttacgtaattataatttattttgttatgagttcttttatcactcatagtactttaagtgtgatttatatcttatacatttgcataaaatttttgaataagacgaatagtcaaacatgtgagaaaaagtcaacagcatcatctattaaaaaacggaggtagtattattttaatacttatatataacttatacttcatttgtttcatattataagactttctagcattgcacacattcacagggatgttaatatatctagacataaatattatatctaaattcattaatatctatataaatgtagacaaaggtaaaaagtcttataatataaaacggagatagtattatagttataattagctatagtggaattatattacaattatactgtagttagagttgaaagttcttccttaaaaaacttgtagtggtttttcggatagtccctttttttctccctttttacaactgaggcgaacagccgtggcaacaagcgcagcagtgcgaccatcgcgtgcatggaattcagaaaagaaaccacgcttgcatcgaagctctcgatgacattgcgaggcaaccacgcaagacgcaaccgatcccgagcaccgcatgcacgcgcgcgacacaccgacgcaaacgcaatgcaccgcgcgcccagccacgcgcgacggcgccggtcgggcgggcgtgcgtgcgtgcgcgcgcgcgtccgcctcgtcgcacgtacacgcatcggcgattgggcggcggacgggcggatgaaccgaattgaagaagccagcgtacgcacattttgccagttggctactgcctactactgcactgctgcatgcaggccagaacattcgtcttgttcgacttaaatttgatcgggctagtacttgccggatagtgggtaactagtgtacgcgtacttctagtagtactagcacttgaattcgctgcctaaaaatgtccagcagcgcaatagctgcaacagctagcccacgcacgtacgcaatgcgcgcatggaccggttcgatgcatggattagtttttttaaccatgacccaagtaaacagtgttgagtactgctggtatcatgtgtagtgcgggaacagggtgacttagggacagagctagaaataactttagctagctttggtagctcaccatccatgtgcgtgctgcatagtagagcacatcgatcagcctaggaaagcatgcggccggcgtgcatcagtgcatgtacgtttggatcggatgtatgcaatgcctgccgagctgcgtacgtaaaatggacactttcgtgttggttaattgtataaaagaaagagcatatgcagtacatttttgcgcatagtcgcaatagatgcatgagattaccatgcatatgcgatggacaagaaaattaaggcatgcaattcattcttccgtttcttgcctgttttaattgtccctttcaattccatttattgatcgatgttgaggctctgaaactcttgacagtactagaggatgccccgcgcgtttgccacgggatttggtttacatcaatttgttaaatagaaggtacaatctcaagaagaaactaatagctttcttggagaaattctttttagcagtcatattcaaaatttatagataaattaggtagcacatgtcaactgaaggggcgttcagccacaaagctcttttatacggattgacgggctagatacatgtagatgtgtgtggagatgggccaatgtgtttatgtgagctacatttgacactgaggaggcgaagagactcacccggtgactaatgggttgggctctatgctacattccatccaacgtctgagaaacgatctattgcattcatccaacggttcataatttgatgatgacgtgaaagcatgaggtttgagcttttagtcttaactttatatagaaagaagggatgtacccactttctcgagacgatcgatcgagagcatgtccaagctatatatatgcgttcagtcctcattgttatcggacatgcacaccatgcatcacacatctatatgtcgtacaagtactcgcgttacgtgcgttattttattgtgctacgtaccgtcggacgacgttgtttagtttttggtgccaaactgccaactatgtagagcatatagtacgagctatagcagagagagatcgttcatagatgcacgcgggcacgtacacatacatgacctgtcaattgccgtcgtaacaaatagcacaaagatacatgcacaaacaggtcgtaataaatatagatcagagaattgaattgtactacgtacgtagagtatacacatagatctagctatatatgttcatgtgcatcgttgtaaggcttgtttagttcgtgaaaagaaatttttagatggcacatcggacgtttgaccggatatcggaagaggtttttggacacgaataaaaaacctaatttcataatttgcctggaaccgcgagacaaatcttttgagtctagataatccgtcattagtacatgtgggttactgtagcacttatggctaatcatgaactaattaggctcaaaagattcgtcttgcgatttccatacaaactgtgtaattagtttttgtttttatctatatttaatgctccatgtatgtgtccaaagattcgatgtgacgtttttgggaaaaaaatttgggatctaaacggggcatgagggcctgtttagttggtgaaataaaaatatttgggtgtcacatcggacgtttgaccgaatatcggaagggttttcggacacgaataaaaaaactaattttataactcgcctggaaaccgcgagacgaatctgttgagcctaattaagccgtcattagcacatgtgggttaatgtaacacttatggctaattatgaactaattatactcaaaagattcatctcgcgatttacatgtaaactgtgcaattagtttctctttttatctatatttaatactccatacatatgtccaaagattcgatgtgatgtttttgcgaaagtttttggcggactaaacagggcctaagggcagtcccaacccatagtgtccataagcagtgtctatggtgccatgtcaataagacatcacaatagaaactacactctacaacccatggtttcttaaagtgggacattaataaatacgtcacctctcttctctaccaatcatatttattcttcatctattatgaagacattattctctcccaatgcaaaacttgatagtgtctagtgcataggttcttgtgttgaagctgtgtcttgcatgagatccagtttcttcctttcttcactctctttcttaattaatatagtgccacataagttaaaagtcctacgtgacaatgtatttaatgccataaatatcattctaggtggagggttgggattgcactaagagcacccgcaatggtaaagtaaggtgctctctataaaacatgtacatctcagcaatatactagattaatagtaaaccacctcaatagtatgtctacatgggtatctatagctctctcatctattgcctcgtttttctctatagactatctccaagttagtagatagctttactctctttctcttcatttaatctttttcaaatagaaaaatatgctgacatggatatcttctagagaatctatatataaccattgcgggcggctaggtagatcgatcgaaacagggggttccgtacagccgaagctagcattaattcgtcgatccttgtggtcctgtagcttatagcgcgcgcgcacacgttgtcttgcgacgtgctgtgcatgcatgctgctatcgatggccggccggccggcagccacacggccatggacgtaggacgttaacttacgcgctgtaggtgtacactgtatcacacccagatcgatcgatctgcacgcacacgaccgtacgtgcgcgcgatcacgaatttaatccacacggacattatttatgacctttaatttactacagacgcaatattcatgtaattaagagcagcgggctacagatttgtagccagttgtagcacaaactccaaagcgcagtgtgtgtatgataggtgggaccagatattaatagtgtagtatgtaactattgtataaatgagctattagattaactataaataaattggaactagtagttgactatactattgaacttgctctaacacagacctggtaagagcacaattcaaccaaccacaacgatagaggcagcagtaactgtaactcacatgtttctcgcaccaaatcaaccgcgcatagtactccgtagcttagctccaatccaacgtctccccggccgcgcggccgcccgtttttccagctaccacgacgggtgcaaagaccggagaaacgtacgtacgcgagctagctagatcggtcgccgcgcgggcggcgccgatcgagatgctgcatgcgcatgcgagaagcccccgcgcgacctgcagcggccagctgcgcgagtcgcacgtatacgaaggtccatcgatcggcacacggtatccgcggtggtctcgtgcggtgcgcgcgccccccaccacgacctccgggattgcacgagcagactcccgttttttcttcgtttctctccggacgccgctgcatgcggacgcgcgcgcacgccccgggcggctaacccgatcgatcgatccccagggggaaagaaaatggcaagaaggctagttttgtttaattcctgtctcgggtttggttggttgctggcactgcactactgctcgacccctttactcacttgcaagcaacccgatcgacgtcccaccggtcgtccctgctggcaatttacttgtgtgtttgtgtgtgttatatatatatatatatatatatatatatatatatatatatatataacacacaccgtgcacgtactagcactgtagcgcacccatgactgtctttcttcaattgaaatgaattattgtcgtccctagttaattactagcaattctcaatatataattttgaattgaaaccaagttcattacgacaaaaagaaaaactgaaaagaatactggtattgtattaaatgcagtacagtgatctcgttaatttgcaaccataccttagctccacactccacgaaaactattctaaacttaactttcgagggatatctcctcgttatttacatgtcatctaaataattataaaaaaatttaataagatagattaatatatgataaatcactaatatcaaatttaacttctacaagttacaactgaaaaaataaatttgaatgtaagtatacgttagttagccatagtttaatttatttttctaagttatacaagctaaattttaatcaattggataacatacaaatagtgagctccactctagcctctatgactccatcttctcctacaaaacggtcacacgcttcacacggcaaagacacaattaaccttccacagaacggtgctccaatcactccacttcatcctatttaacccaccccctctcactgtgcgtctgtgcctctcttcacacacacacgcacaaccaaccgcgccgcccacacgccacgagcgccgcgccggcgagctcttcgatcaatcgcgccggccgccatcgtcccatgataagcggcgccggcggtgagcagcagcagcagcaggacacgaagcggcggctaccggcgccgacgacgtccgagcaggagaggcggcagaagcagcaccgcgggaagatgctgaggctgtcggtgcagcagggcgacgacgtgaccgcgggcgtggtgccgccggtcaccgtcgtcctggacggccgctccatctgccaccgcgtccacctcagcaagcacaccggctaccgcagcctcgccgccgcgctccgccgcatgttcgtcgacgcggacgacgacgtcggcgccgccgacgaggcagctggcaggagcagctgcagcgacgccgaccgtggcggcctcgacctgtccaatgccgttccagggcacgtcgtcgcgtacgaggacatcgagaacgacctcctcctcgccggcgacctcaactggaagtaattagcttcacactcatcttgttaatctcacttcgtgttcatctcgtgctttgtctgaattattcttgacgcatttctgtgtgctgttcatctgatctgattctcctgcaatacatccatgtcagggatttcgtccgtgtggcgaggaggattcggatcatcccggcgaagccatctagccggatgaggcctcaatcttaatctgctcgcttgtaactaaaccacataaacctctagctactactagatccagtattcctcctttcgaaatcgaaatagtttgtgtttttgtcatcagtttgtaacgtcgttaagaaaattcagttagttattataatcccgttttaatcgtgaccggtaatgtgcacgtacggttgaattgatctgcaaattagtaaggttaattaatcgattcattacaggttagttaatcaaatcgctgctcgtgtcacatcttgttcgctgtacatgcttaactgtgcgtgtacgtggagtacgtcgtgtgccgtgtccgtctctctcgtgagtcatcgtctgcgattgacttgtgtgttcttgctttgaaagtgagggcttgtgttcactgattgcttgtgtttctcaactgctcgatcgatcgatcagtctctcgatagcttcttgaacaccgacgctttgtccgaacgtgcagatatgcaggtacatatatacagagatgcagttacaagtagccgtcagttaaccagctcgatcagtactcgtcgatctcgatgatatcgaatctatcagtgtagcatcagctacgtactatgctataaaagtcgatttcaattaagcgtctgcttctgttaatttggagattggatcgatttacacgcgtatgcacaagaacagtttggtcgatcgagttgacgatagcaatggatgagactgagattgggatggccgctgtgtccagaagcataactgtcatgaacagcgttctattactgcctgcgtacgtaaggagtacgtggatatgtacttggtctccattaattactgaattttcgtgataaaaacaggcagatggatcggcgacattggaggactagtggttactgcagatggatgtgacattgacggcatgcaagctcgtccatgcatggcatggatggatccccttttttatcagatcttcttcagggtaattctgatgcacctagcgatatgccgatatctaagccaggaaagaacatatgcagattagacagaaactgtataggatcagtcagggtcatgctcatgcagacattcagggtcagtcatgtgtaccgtcgttggtgtaaccaaattagccgggacagagaggaaaaagaaactcaaggcatacgaacgagtcagtactgttcagtggccgtcagtgacgttcagggttggaactcggtggagtcatgacgcacgagaattgagaaagacagcgggggatgcgcgtacgcatctgccttgcaccgatctagatatatttgtcactcactcacttgtcaactctgaaagcctggaacgcaacaggatgaatcagtcgtttttgctgatttagatgcagaccatggtcgccttaatttgttgcctcaaattcagtttccggatatgatcatccttccataaattcttcgtgcaaaccgattgagtgttttggcatgttgtctgatatattattttctcctcaaattcatcttgaatgagttcagagttctccatcgaggctctgcatctctgattaattaattacttctggatcaattaaccaatggcagtcaacgttgaacattcatatcctagatatgtgattatctgagtatacaattctcgtaagatcttctcacagtcgtattgctgccaaatgaggctaagctgttcagttttcacctctttccacatgggcggctgggcttgtattcagtaatcagtagcttctcagcacctgcacctgaagttttttttgagaacaacctgcacctgaagttcccttcgcgtttgtacgtactcttccttgagatctgggtgttgtcagtgccggcgatatatctagctttggaaactcgcagtatcttctctccgtatatatatacatatcgcgttgacacgatagtacgatgaatagtttacaactgcaacttgcaagcactctgttcagaactcaggtgttttctgaagatcatgtacacagtgacagtgaaaccaattggtaacctgttatgaagaaaatgacaaccggcagtttaatttggttctctcttttgctcatatataagactggcaaaaaaataatccactctatgcaagtactggctaaagaattagagttttcttgtagggaacaaacaacctttttattcagtcggttcagataatttacacctgaaactttgcaactcctctttttctatgtttggttgttactataacctaatgcaagtgatcactaatcaataacggactggtcccatccgtaaccacagcacatagtatctcccttgatgagacatgcaaagcacacataaccattctttcttatatggaagtacataacataattctcaagtggtgcttccacggcactacttgctatttatatgttcgttttgcatgccatttggttggcttcctcgccttaaattctgccatcacatcaactcttctcgtcgtttctctaatctaactaccgccctagaagcaggatcaaaggtgagagtatgtgatatagagtggacacaacaatgctaacttgtacttcttgactatacagcattgtcaaccactagtgtcatagcatatccgctcctcaccattcgattgatcggttcggttggttaacttgtataagaacttattagagccagcacgaggcaaatatagatgcctactatcattattatttctttaaaacactgtataaaagcaagcgaacatcttttttttttagacgacgaatcacatcctcattaactgcgtgttcgctcgacaggtctaattccgtgtgatgtcccctcctggctgagttgccctctctccccctcgtggtagctggctccaggattagtggtcatcctccagggcctgtttacctgagcacctccgcatcggtttcgactccttggttctcctagtctcctggcagctgtagaaggaacgaaactccagggttttcgactctgcgctcgcttcggtcctggtggttctggagtccatccgctcagagggccagctgtgttctttagccggtgttgctgtttttagggatttcttgggagtgtagcgtggctctaccccctcccacgtgtttggagttgtgtttttagccgtcatagtagttcctagctcgggttattttatttttctttttctccctccccccttgggcataagctgtttggattcgatgcgacgtacaatccttttacgcgtttgaaaaaaaaaatgaacatcttcttattatcgagatctgctagatagcccgaacaactgtcaagcatcgccagatactttcttacttccatttatcaaatagagcatcacagctctacatactttcttacttccataaaaacctcttatattcggaacggagaaaaaaatagacgctgtactaaagctcttgtagctgtcacatcgcaggaaaaaaatatttgtttaagttggtacgaaattgaaagcaatagcaaaaatattaatggcatgttttcaactttctttagtaggcttataattattttaaaaaaacgaaaaagtcttttcatctagcaatttttgcatcacaagatggatcatccaggacggcagcagatgctgaaaagagatcccagtgcagggttcagacaaaggcagctttctcctcttctgctggggcaaaaaaaaaaagtttttaatcaggcgagaaaggcaacaacaagcgcaaagcacgtcaagatcacgccgctcgcctcctccgttgcaaaagacagcgactttataaaaaacagcagaaaaaggcgagacttttagcccccgcaacaactcgtcttcctcccctctccagcagcgtaggccagcgagcggcagcggcagcagcagcagttgttgttgggggtaggtgcgcctcctccccaaccaaaccctcgcttccctcgcgcgcggcgcggcgatggcgctggcgctggaggcggcgaggtcgtgggcggcgtccgtgctgccgccggagctcgccgccgcggcggggggcgacccgctcgccgccctcgccgccacggccgcggcgctcgtcgccggggtggtcatcctcgccgtgtggttccgatccggtggaggggcgccgcccaaggccgccgcgccgccgccgcgcccgccgccggtcaagatcgaggccgacgccgacgccgacgacggccggaagcgcgtcaccgtcttcttcggcacgcagaccggcaccgccgagggcttcgctaaggtcgctgttcgatccgatccgcctccgatccaaaagttcccctcctttgttcttttttttgcgcgattttgcctttttaatcttcgtgtacttactcgattcgattcgattcggtttgtattgctttgctgcaggcgatggcagaggaggcgagggcgcggtacgagaaggcggtgttcaaagttgtggatctggtaattgtgatgatcttgatctgcatgtgtttgtgtgtatgtgtatgctagatcgcctgtctgagctttggtgttaggaatctgagatatgtgtgggacatatgtaggatgactatgcagctgaggatgaggagtacgaggagaagctcaggaaggaaactatcgtgttgctcttcctagcaacgtgagtccccttgctattttgattggtcgattgctgaattgtgccttttgtcgctagcgggggttacataattcacctacctttgttgtaaagctcaagtgacatgtatgtcatacaaaaattgttgagattctatagttacaaaagctaccctaagtctataacatagggaacatcgctatgccgtcaatcagctatgccattagcaaacatcgcaattcagatgaattatatagcagcctaatgagcctaatggtagagggattcattgctatctgagtaagagttgaacaagtgggttttttgtgggtgagagttgaacacgtgggctttttgtgggggagctagctcaattattcttgtccggattgttatgaactaatgccattgaatggcatcttgaaagaacttaactagcttgggggtgaatttcctttcattctagaatttatgaacaacaatcaatctttgcctttacatgagttgcacatactgtatctcttgtggctatattcacttgctacgtgtcaatgacttctgtagctaattatgtttcatcgagtgtagatatggggatggggagcctaccgacaatgctgcaagattctacaaatggttcactgaggtgtgtaaagtcattttgactccatttcgttgacatattctaactacattattttatgatctccttattaatttttggcattgaagcaggggaaggaaaaggaagtctggcttaaggatcttaagtatgctgtttttggcctgggaaataggcagtatgagcactttaataaggttaaatttattgactatgaaatgctagtataaattggtaaaggttgactagtgttctggtaactgatgctgggttatttatattgaaaatataggttgcaaaggtggtggacgaactgctagaggagcagggtaagtactctttgctctacacttcatttggagaaaagttgggaaaatagggcgagtgcattgctatattgaaacaacttgttgcacaggcatggggcacacttccattgtagcagtttctaattagtttactaacttttgtaacaagtctattgtggaatttagttatcttgtgagcaatttaattttggcatatagtatgaccattccaatacatgtttatatttgttccttattatgcttccatcataggttttactctgttttacatcttgttctgatgtaaacctttgagcttgctgcctgatatattcatcagttagtcattcctgaatgtagtaaaatcatgttgaacttttcttatgtcgtgcattacgtaacaaagtgatatttcctgacatatattcctgcagcctgatcctttattgggtgtaattattctaatttatgctgcatataggtggcaagcgtcttgtcccagttggccttggagatgatgatcagtgcattgaggatgacttcacagcatggtatggagatctttgtgttctcttttctatgtaaatatctgtcgtgtagggacaaaagtgggttggatatctgatttgcctgattctatatccgcaaaatctaggcttgaactccaagttttctctttgattggtcctggatttggatactgaataaaaacctcttttgtcatatgtgaaacaacaacttgtctttttggtgaatgtggaatgtttccgctttctggaaaatggatgtagaagatataccccatatctagttcaacaaatataccacatgcaccatttttttttcttcagtacacagaaacattgatacaaataagtgtgcatggtatattttttgaactatttatggggcagagcttaggcttccacatgtacctgcatagttttggatatattgagccttcctttacaacagaaatatattttactaaagcaagttagatttgttgtagttagattctttaatactcccctttattgttcttaaatctatcctgtttttgcgactaaattaaattgatactaacaatatcaacttggattctggtctataggttgaaaccccaccaaaaatgattattccttggcaaatgttctgttaaaacaatttattgctccttgcctgaattttattgacaaagtgatgtctagattatgttattactttctaagtatactggtattttatctaaaagcattttggcaattctaatacttgtaggaaagaacaagtttggccagaattggaccaactgctccgtgatgaagatgatacaactggtgcatccactccttacactgctgctatacctgaatacagaattgtatttattgataaatcagatgtatcgttccaagacaaatcgtggtcacttgccaatggcagtggtgttattgatattcaccatcctgtcaggtattcatatgtcaagaaaatgatttagctacaccttccttctgttcagttagaatacagtatatgcattctagttcatcatttgattattgcccaggtctaatgttgctgttcgaaaggaactccataagccagcttcagatcgctcttgcattcatctggagttcgatatctcaggcactggtcttgtgtaagttctttggtatcctaaaactgacattttttatgtcttctcgtgtagttttgacatttatgtgtgaagtcaaatgactcaacgatgatccttcaatttgtattttattgatacaacttatatttctaagaactttgtatcaggtatgaaactggtgaccatgttggtgtttattcagaaatgctatcgagacagtggagcaggctgaaaagctgctagatctttccccagatacatttttctccgtccatgcagacgcagaagatggatcacctcgtaaaggggctgcaggaa

SEQ ID NO: 60657 - DNA, 3262 bp, Oryza sativa
tgtcatttcgacaacagctggcgccgaccgtggggacctccgagcgaaaccaccgagagcgaatgccaccgaagagagtcgtgaaggagaaggttgccaggcggaaggaaagcgacgccggaccggacatggccgccgaggaaggagcagagccttcggcacccgtggccgaagatggaggaggacaagcgccatcacaaccgccttcggcccctgcaaccactgtgcaagtgccgaacgcggccgacgtggcgaaggcggctgcggtggcaagggcactccagaccagggcggagatcctttcgacaagccaaccggtggtgccccaagccgctccatcgctggcggcagcggccccaactgcgctcgccgttgtgcaggcccaagtcagccctgaccctgaagcacaagccgaagccgacatggaagccatgcgacagaacatgacacggctccaagacatgcttcgccgaatgcaagaacaacaagaagcatacgaggcggcaaagcggaccaaggccacgtcggctccaatccttcagtattcggcaggttatgtcccacttcaagtccatctgcaagtgacgacccagccctttccgccacaagccgcacaggcgccggtgtacttcaccgggcagcaatcggccgcagctgtgcgtccggcccctcacgtgcaactgcaagctcaaccagtcactgcccaagtacaccatcaaccacctggccaagcgccacaaacagtggcggaaggggcttcggctctgcaggcgcaactccaagctttccttcagcaactctaccaacctcactgcatttcaagtacaaccccatcggcccacccggaggggaatacaagtcaaggtgcgcctaattggttgccaccgattcagccaggcctgggagtttcgccgtggaatcaaggaccgcagttcgacttcgtcaatgctactcaggtgccaaccgttcggcagcaagctccaactccaggcttcggaacaaaccaagcaccaatcaaagctgccatgatgtggtcgcagccaatttttgacccatctatggtggctcagcaagtacctccagttggaaccgggcagtcgaatgccacggcccaacctcacgcacaagctgcgattttgcctttcaccacaccgtacccgcagcaaggtgcggcaaacagggcgggaggagaaaaggggctaccgctgagtgggggaatcaagactcgtccaatcccaccacagttcaagttcccacccgtcccgcgctattcaggcgaaactgacccgaaggagttcctctccatctacgagtcagcgatcgaagtggctcatggtgacgaaaataccaaggcaaaggtaatacatctcgctctagacggcatcgcccgttcttggtatttcaatttactagccaatagcatttactcatgggagcaattgcgcgatgtttttgtccttaactttcgaggcacctatgaggagccgaagacgcagcaacacctactcggcattcgccaaaggccgggggagtcgataagggagtacatgcgtcgcttctcgcaagcccggtgccatgttcaagacataaccgaggcgtcggttataaacgccacttcggccggtctgctcgagggcgaactcacaagaaaaatcgccaacaaggagccacagacgctcgagcacctacttcgtatcattgacgggttcgcaaggggcgaggaggattccaagcgacgacaagctatacaagctgagtacgataaagcctccatcgtcgctgctcaagctcaagtacaagttcaagttgccgaaccacctcccctctctgttcgccagtctcagccggcgatccaaggacagtcgccaaggcaaggccaggcccccataacttggagaaagttcagaacagaccgtgcaggcaaagctgtgatggcggtcgaagaagtgcaagccctccgcaaggagttcgacgcccagcaagcgagcaaccatcagcagccagcccgcaagaaggtccgaaaagacctctactgtgcctttcacggacgctcttcgcacaccacggagcaatgccgaaacattaggcaacgtggcaacgcgcaagacccaaggccgcagcagggaacaactgtcgaagcaccccgagaagcagttcaggagcaaacacccccagccgaacaacgccaagatgtacagcgaagggcaatccaagtgattacaaggctgacccgccaagccagttgtccaaacggcagaagaagatgcagatccgtatggtccacagcatcacttcggcgggtgaaggggcgccgcagtatctgaaccagctaatttcttttgggccggaagacgcagaaggagttatgttcccgcatcaagatcccctggtaatctcagctgagatagctggtttcgaagtccgacgaatcctggtcgacggagggagttcggccgatgttatcttcgccgaagcatatgccacaatggggttgcctacccaatcccttaccccagcaccaacatcgctccacggtttcggcggcgaagcagttcaagttctcggccaagcacttttgctgatagcctttggctcgggggagaacagacgcgaagagcaaatactatttgacgtcgtcgacatcccgtataactacaacgccatcttcggccgtgcaaccctgaacaagttcgaagccatttgccaccacaattatctcaagctcaagatgcccggcccgacatgggtgatagtagtcaaggggcttcaaccttcggccgcttcaaaaggcgatctagccataatcaacagagcagtgtacagtgttgagaccgaaccacatgaacggccgaagcacatgccaaagcccacccgtcacggcaagataacaaaaatgcaaattgatgatgccgaccccataaagctcgtatcactagggggcgacatgggcgaagaagaagttgagagtatcctagaggtgctcaaaaagaacatcgatatcttcgcctggagccctaacgaggtggggggtgtcccgacggatctcatcatgcatcacctagcagtcaagccggacattaagccaagaaaacaaaagttgcgcaagatgtctgccgatcgccaagaagcggcgaaagccgaaatacaaaaattgctcagggcgggggttatccaagagattgaccatccggagtggttggcaaatccagtgctggtgcggaagtcaaacggcaaatggcgtatgtgtgtcgatttcacagac

SEQ ID NO: 60658 - DNA, 13329 bp, Oryza sativa
  unsure (1)..(13329): unsure at all n locations
ctttcggcttaagaaacgcaggagcaactttcgccaggctggtgtacaaggtccttggcaagcagttggggcggaatatggaagcttacatcgacgacatcgtcgtaaaaagtcgcaaggctttcgaccatgcgatcgacctgcagaagacattcgacagcttgcgcacagcaggcataaggctgaatccggagaagtgcgttttcggcgtccgcgcagacaagttgttgggtttccttgtttttgaaagaggcatcgaggcgaatcccgagaaaatcgatgccatccagcaaatgaagcctccgtcaagcgtacatgaagtacaaaagcttgcaggctgaattgcagcacttagtcgattcctctcaaaggcagccgaaagaggtttgcccttcttgaagaccctccggggcgcaggaaagtttaattggacaccagagtgccaagcagcattcgacgagctaaagcaacacttgcaaagcccgccagctctgataagcccacccctaggaagcgaactgctattatacttagcagcttcgccggtggcagtcagtgctgccctcgtccaagaaacaaagttcggacaaaaaccggtctacttcgtctccgaagcactgcaaggagcgaagacaaggtacattgaaatggaaaagctcgcttacgccctagtgatggcttcgcgcaagcttaagcactacttccaggcccacaaagtcatagtgccatcacagtaccccttgggcgaaatactccgaggcaaggaagtcactggccggctcagcaagtgggcggcagagctatccctgttcgacttacattttgttgcacgctccgccatcaagtctcaagtgctagtcgacttcgtagctgaatggacaccggtacttgcccccgaccccgagcccgccgaacaattctgggtgatgtgctctgacggctcgtggtcgcacaagggagcaggcattgcggcagttctattttcgccgaatggtgtgccgattcggtacgtagcaagactgcagttcgacacaaccaacaatgcagcagaatacgaagccgttctcctgggcctaagaaaggcgaaagcactgggagtccggcgcctgctaattcgaactgactccaagttggtagcaggccatgttgacaaatcctttgaggcaaaagaagagggaatgaagaggtatctggaggctgttcggtccatggaaaaatgcttcaccggcataacggtcgaacacttgcctagagaccagaacgaggaagcagacgccttggcgaaatccgctgcttgtggtggcccacattcacctggcatctttttcgaagtcctacatgctccaagtgtgcccatggacagctccgaagtcatggcaatcgaccaggagaaactgggcgaagacccatatgactggcgaaccctatttgtgaaacaccttgaaactggctggcttccggtagacgaagcagaagcgaagcgtttgcaactcagagccatgaagtataagatggtctcgggtcagctttaccgctccggggtatttcaacccttacttcattgcatctcttttgccgaaggcgaagaaatggcaaaagagatacaccagggactatgtggtgcgcaccaggttgcaagaacagtggcctccaaagtatttagacaaggagtttattggcccactgtgttgaaagtctatgttgagcaaataaagaagtgcgaaagttgccagcatcatggccgaagccaagccgcgccccagtatgatttgcagcccattgcgccaatatggcccttcgccagatggggactggacatcatcgggccattcccggtggcgcgaaacgggtataaattcacaattgtagctgtggaatatttctctcgatggattgaagccgaaccccttggggcaatcacttcggcagcagtacagaagtttgtatggaaaaacattgtttgccgtttcagagtgccaaaagagttcattactgacaacggcaagcagtttgactctgataagttcagagaaatgtgcgaagggcttaacctggaaatcaggtttgcgtcgatcgcacacccgcagtcaaatagggcagccgaacgtacaaatggcaagatcctagaagcactaaagaaaagactcgagggggcagcaaaaggcaaatggccagaggaattgctattggttctctgggccttcggacgacccccacaagaccaaccaagtttagtccgtttatgcttctttatgggatgaggcaatgaccccagcagagctaggggctaactcaccaaggtgatgttctctgggggcgaagagggacgcgaagtatcgctcgaactcttggaaggagtaagggtcgaggcgcttgagcacatgcacaagtacgccacaagcacttcggcaacttacaacaaaaaagctgatgcctggtcatctcatcctaaggaagaaggcgaacccagtagcggttggcaagcttgaatcaaagtgggaaggaccatacctcatcaaacacaagtccaggacgggatcttttcgcatagcgacactcggaggcgaggagttcgaccattcctagaacgccgcctctctcaagcgcttctatgtctagaatgggtggcacccaaattgccaaattgaaaaaatgtacatactgtcatgtaagcccttcggcactatgaaagcctttcggcaagaaaaaaaaagaagaaagagagaaaaaagaaaaaaaaactaaatgtagggctattattcaccatggaggcccgaaccagtataaaatctctttgtccgccttctttttatttttcgtgtgattgataatttgtggaaaaaccccaaggcaaacgcctgatcagcgaaaaaggccaggggggcgaaatgaatcggccgaagcattgctcgccgaacgttgaaaccgcaacagcttgtctcggaaaataaatagccgaacgatcagcataaaagcaaaagcgtttctctcgacacagaacgctacagatcgaaaacgaacgacgaaaagctaaaaagtcagtacacctatttcgctaatatatgcaaaggggccagcatgttctgacctaacaaaagcacaaaatgtgacgatgcaaacaatagcgaaaaggaaataaaacacgtctttattaacttcgaaaaaaataatcgaagaatagaagtttcacaacacgatacaattcaccttacaagtaaattacatctttgtccccataatcactatccctccctaaggaatgatcaggcgaactaggttcatcatcactactaataccgtacacaaccttaagaggagtagggggcgaaacacagactaaactgtaacgacgctgaaagatcgtttcctggcgtttagtcttctgatggtttcgccaaaagcgagccatatcctccaaatgtcttgaatgaacaagatcgtaatcttctaaggttcgcccggggtgcgcccgcagccagtcggcaaccttgaaagccttatagttgcgaccgtttatctccatttcgcgataaacaggccgaaatggacatcgcactttcggcagacccttcactgccacaaatttctcgttttgacttcgccagctcccggaagagggccggatgcacgactttcggcgaaccccctgatggacagtgcagaaaaagcaaaacacagcttacatagtaagaataggcggaagaagggggaggtatggcataatgcgagatgagcgaaataataatatgccaaagacttcgatcatcaaaaagtaattaagattgtcatatattccaaatgtacaaaaaagcctttttttaaggtttggcggtagcctgccgaatgtacatcattcgcctctccaggcaaacgcaaaagagggaggaaaactacaaaaatctaaggaaagggcagagggcctcacacctctaggtgatcctgggcagcgcctccaacctcttcgcccaccgcgccctcttcttcgcaccgatctgccgcctccgccttcgccagttgctccagaaggcgcgccttggcagcggaccggccgtctttctgccagaactgttttcgccacgcgcgaagagcgggcgaaatgttctgcgcactaatctcccagtcccccttcgcataggtagggaactcggcaatgtgctcgcagccgaactgctgcaaaaggcctaaggtgaaggccgccgatacacgtgcacagcaatcgccgtacacggtggcgcagtccgaaaccaatccgccagcctgctgggtccactcggagaagtcgaaggctgaggcatcctcggcagggacccctcgcaccttcgtgcctatgtcggtaagggcgaggcggagcgtttggcaagccattctcgcggattcggtggtcttcgccatctcccgcgaaaaccgctgcgactcctccgtggcgctcgcttcggccctgctagccttctggcgaagagcctccatcttcggctcagtaaggttgtagtaatcgatgagcaccgccgaatgggccttctccttctccagttcggccttgaggcgatcaacctcggccctggcctctttccccttatctaattcggactgaaggcgtttgacttcagtcttcgcctccttgaaggtgtgggccagggcctccacctccaagttcttgcggcttatttcatcatccttggcccaaagacggtttttgaaaccgtcaaaacgggcccgcacggttcgctccatcgaacagtgagccgcaagaatctagatgaaagataggagcaggcgaaaagaacaaaaggttaattgtgagacgtaaaaaaaagagggaagaggaaaacgaagaaggaagaaaaggcatactcgaaccgccaaacttttaatggtggaacacccctcgtcgaactcattaagttcggtgaacaggctcggggtgccggcaggcaagacaaggttgctcacaccctccacaaagggaataaggtccgcccgagtctcgaaatcaccaggggtaaagtggggcgccgcaagggaatactccgaggcagatgcttcggcggccgcacacttccccttcgccttgaccagcggcgaaatagctggctcacgcatagggctcccgaaaaccatcgccgcggccgacacgatccgtttggcggaggcggaagccctggcggcggcactaccgcctgcaccagcaacgccgagcggagcaaggggagcagtcgagaggtccaaactgcggccagcaggcgaggtcggagtctcgtcagaagactcatcgtcgctgaaaacgcgggcgatgtcgacgagtcctttctttttggagatcttcttcaccggacctcccttcgccaccgtgcccgaggagaacgcaactagagccttcgctccttccaaatccttccgtcgaacgggggagctgttcgactccaccccagtctcgttgtgaccgggacttggggtaggagtgtagctaggggtgtcgacgcggtcttcgatcgcctcgttcacggccttatcggccatggcctcctcctcttcctcctcctcgccgtcgcgttcttcggcatcgtcctcgtcgtcggcgtcggagtccgacgaagcaggaacccttcgcttcctaggggcaagcttcacttgtccgcgcattcgttttcacgaaggccctacatcgtcgtcagctttgtgggtgtttacccgaggaggcaattcgccgttgtaaacccggttcgcccgtccagccgcttgtcgtgttaacaactggctatactcgacgaccgacacgtcgccgatcatcctacgggcctcgttttcagcctggtcgagggtcaacgctgcaaaagtgtgtagatatgttaacagtcagacaaggcaagataacaaagcacaacagtgtatagcaagagaacagtcttactgttcatcccctcaggaagaaccaggtttggcaaaccgtcaacctcttcgccttgatcaactctgacttgccatgactgggagaggggaaagatacgaagcatacagaattcctccaccaagtcaaggcagctaaggcgggagcaaaccttccacagaagaacgaaccgcgcctccatagcgccgtccacggcgatcttgggtttctggttaggcgcgatcgccctacgtcggcaatagagggctttcgccgagtcagtgccagcctcaaaggggatggtgtgatagaaccacctagccatccattggcggtcccacttcgacatgccagcgttcaccggccagagatcggaccgctcgggacgaacgttaaagttcacgctcccgaacactgtcttcttcgtcccagccggggtaatcaccttcttcgagttcacggtgacgaaaaatatggcgccgaagagctcggcgttaggctcaaacccggaagtccggcacgcccagtcgaagatagcgatctaaacaagcgccgacggactcagctgtggaagttccacctggaagaggcgaaggatctccggcaacaacacgttgcagggaaaccgtagccctgcctcaaaaaagacggcgaataccaccgtccgattgtcgataggtttcggcaccacggctttccctggggcgaaagcctgccccgcgaccaacgccccagagctgaccagcttcgccagctcgacgtcgtctacaagagagacccccaaaaaggcggtgctgtcgtcatcgactcggccgggatccggccctttcgccgaagcagggtttggcttgcgagaggccatggtgaatggtgcgtttgcggtggcgaagaaaaagaatgggcgaaacgcttgaggggtcgagagatgctgtggaagaaagagacggaggaagagagcgcacgcggtaaaatggcaagtgtggcggtgaaaaggaaagagcggtgggaatatatagctcacccgggcgaccgttcgcctacccaccaataataaagcgccacgtgtcgcaagggtaggcgaaacggtaaattcccaccgaccgagcggcacagtcaaaagcccacgaagggaaagcccaatactgttcggttcggcccgggaaaagaaaataataataaccaccaatcgcaggaggcgaagtgcggcaaaataataatagccgcacaagtaacaaacttcattcgcaggaataatataggtttcagcaggagcatcggtcaaaagggggtgccgcataccataccacatggtttgcacggtctcggccaaagctccaatctcacccttgcccgtgaggggcttgttggcggatggcatgaggcccttcgaccaaatctgccgaaacccgtggcgaaggctatggagcaagaacggcgtgaggcgaagagtcgtacgagtgccttgccaggccagaggcgtctcaggcgaagggttcaaggcaaagactatctgccgaaggaagacgacttcgccatggcaagttcgccctcgcgagggccgaagaagcctttccggcccatcaagcctaggggctatagggccggcgatcaccagacggcccatcaggggcccatgagcccctataacattatgtacccctgtaaatgtccctttcgttaggataatcatgtaaattcccctgtataacctaaaccctagtagtaagaacctgtaatggggctataaatagtcccctagggccatgtaatggggggagaaaaaaaggaagaaattcaagattcaatacacttcgtttccttccaaccactgttgagtaaccacgtctttcgacgtatgcagttgtcatttcgataacacttaaccataaactttgtttcaaataattcgtggtactgccattgctctgctttgtacatttgagaacttagcacttgttgcacccaagtactttcatcacgtgcaccttgttggtatcgctgattttgagcgccactcatacctgtcattgcaaacacaaaaacaataacaaacaatgaaggttatccctaataatctgctacgcggtgtagtggtgcccctcaacaactcagccaaatggagcaccttaccaagctcttacaagtgtcttaccagcaatgctgaggacggtacaaccggtggctggttcgtgacaccttgaaggacgtgatgtggcgattgcaaggatcaaagcggtgctgaccagaagtatatatgtgtagcttgggaggcacaatatatagtagcaaaaaaacgcaattgtgttaatcagaaaatgcaaagttgaataatagttcaaagtactagtcaatgtgctggcctagcctagactcaactctagctcaagcaagcacccgacaccactaaagactagatatgaatcaatgcacaactctgcactcagataacatactcaaaggatgaatgatttttttttctttcttggtgcggctttttttaagcacctttctgccttcttttttctttttttaggtgtggcttttttctcttttttttctttgcacctttctgccttttctttctttctttattcttttttttactttttttttcaataaaaactgaccactgacctcgaatagggactcaaatgtaaatatgaatattacagggactcaaacgcaaagtgcaaaactaaaattggatcatctcaaaaatggattgctcatatcatgtaggttccgtttttataaaaatatctcaaatccgctacttaacaattctataaagagggaaatacggacagctacggatagatctgatacggagtctctcctcatgcgcacacagtactccccacacgcgcacagtacacatgcacagtacggcaactctaaaaccatttgataaaaatttctccaaatcacaaaaacggaaacccgacgacgagacgattcaatttttcaagatcccggcaacaactaacgagatgaaaaactgaacccaaaactgacgtacaactcacacacttgagtgatgtaccctagacctaagtgatgaacagatgcaatactcaaaactaaaaattaaatctaaaactaaaccagtactcgacacgacgatgcaacctagaattcaacaaagtttagagtcgggttcttgacggaataatctaagcaaaacccgactctaaacgatgacggctactgaataaatgtgattagggacgtcctagggttgccctagggtgcacaccctcttgggctaagcccacaacacaattacaaggcccaaaacccaagtcagattcggactggatgagatatatggcttgttttgtagattcccggcagctcggtaggaattttgacatgggaccaaaaccatctgaaagtagactccataagctttctaacaagtactcatgggccccaaaattccttctagatcagcggctaggtccgtttgaagttgatgctgtcacgaggcccgaatccgaatccaaaacgtgtggaactttatctcttgtcttctatggaccaaaagtgacgtggtgaaatgaaagaagacttggagaaggtcttgatatggtccccaatcaacttctttgatcatccatgaattctttacgctcggtctcttttccttcgcccaagcaagtacctctgcaaacaaaaacacataaaactcattgtgtagcaacgtttgttcaaatatatagcatgtaaatctaatgtagaacatatgcacctttggttgattaatacataaggtagtcatagttatatccgagctagttgtgtcctcatcaggcgagcgccatcttaccggtcccaccggctccgacgacgcccgccaccttcagcccccactcctcgccgccgacgtccgtcgcccacctggcgacctcatccgtcgccgcgacttcgacgtcggcgccgaaccgcggtggcggccgcctggtggtgatggacgtcgacgagcatctccggcggctgctccgcctgctcgtaggatggtggcagaggccgtacctggtgcgccgccgccgctgtctcgcctcctgcgcgcgttcccggaacttggataccttgccggcgatgagtatggcgtcggcgttgtcggcggcggcgagggcgatctcgtccaagaagtcgtcgacgtcgtaggacagctcgcgcacctccttcatccagcacttgtccgccatggtcgtctcctccagctgcgacagcttgcggaggaatccatggctctcttcgatgtcgtctctgaacgagtggatcccgtcgtaggccgcttccatgtgaccaccatcaccagcctgtggcggcgaatcgagcttccggagaagagagcccatggcccccgtccaagcactgaaccccatctccatggctgcggctgcctgcctcaagcaaagcacaccaaaaatacgtgcgacgaaaggatacagataccgctggttggtttgacttcttcttacgaaacttttcagaatttaagttacgagaaaattcaagaaataccatcgacacaccaaaatccaatacatgtcatcaatgagtgcgagttatataaaatatcattgtacaagcgattttatactagaaatgtcatcgctgttagggttacatccatcccgcgtcgtttaatgcaccacttaaaaccctaacagtgattatatttctgggataaagtcgcttgtatgagaactcgtatttgttgatggtatttttttttgaaatttggtatttgtcaattgtatttcttgaatttttctttttataagttatcttatggtagatagtgtactactccctccgtcttaaaatatatcaacttttaacaattaggatttgttccaaaatatagcaacttctccatcaacattctcttcccaacaatcgcaaccctccaccattcacttttcctacctacctctccttctcaaccgatcacaactcctttttatttagttctacctactttctttgtccaactctataaactttttatattctaggcggagggagcagttgaaagcgaagcgcttaggatgactttataacaaactatgtcagctcagcccaatatcttgtgcttcctccgtcaaaaaaaagacgaaccctggatttctgtgtccaacgtttaactgtccgtcttatatgaatttttttataattagtattttcattgttgttagatgataaaacatgattaagagcaagtacaatagcaagctattagccagctgtaaacatattttaataagataaaggatgagagagaagagcagcaggctacatatctgtaggtagctgcagcgcggactccaagacaagatgtgtgtatgacaggtgggaccatatattaatagtatagtaagtaccttttgtatgaattgactattagattggctatagatatattggagctaatagtgggctatactattaaacttgctctcatactttatgcgtgacttgtctttttaattttttccatatttttttcaaataagacggacgatcaaacattggatacggaaactcagggtttgtctttttttggacgggggagtacgtgttttcctaacttttctacgattaaaggtcagggtgagcatctatatttttgctgatttttcgttaannnaataaancntnaattnaatttttttcttgagagcaaatactagctagttcaacaaaggtttccgtaattaagcttattataacaccttcccaaaaaaagaaaagcttattatcacaccttactgtcacaactcaacagcactcaactattgtaaaaaaaatccctatgtcgctaacaacagcaaccggtatattcatatatcgtaagacacacggcgcacacatcggtacatcaaataattaggaatatttgtcaacatacaagacgaatatattaagaagccagaagattgagatagcaccacacaacaagctaccggctctaacaacaacaacgtctaattatttttctttcttgcgtgtgtcgacactttgctcagaacccagacactttcttttgcataatataatctcgatcacattatatatcaaagaaacgagttgtgctgtgtacatccgttgtgaaagtagaggccggattttaatccattttctgaaaaaaaattgaaagaaacgagttattactcagtcttaattaattattttttttttgggatttgtaatccagctactacgcgtcttggcgaactcaaggagctcaaaggcgaagcggactacgttcatttgtggatagcatagctgaaggacgaactttgcactgctacacaaaaagattttactggacgccggctccgtttggttccaggtgggccataagtcgcgccgcctagaaaaactggaggaccggctccgggccggcgcccgcacgggaagatgcattatctcgtgcgggcgtcttaacccaaccgcacaggataatgcgattatcccgtgcggttgaattaagaggcccgcacgggataatgcatcttcctgtgcaggccgtttaatccgactgcgtggcattttctgtctcctaaacttacaaaaattaggggggtttcgacctgacatgatccatataaaaggtgtaatgcttgttcaactccttcatttgcttctatttttgtcggttcttatcggtgcaatatgaagaaatttgcacttttataaatggagtagtgtaggcactttttgtgtattgtgtcatttttgagctaactagaaaaatgcctgtgcgttgcaacgggtgaaagctattttaatcttattattgttcactctgaaatcactactggagaaacgactattaacgaccagaaatttggtcgttaaaagtccaaatgtggtcgttaaaggtcattaacgactacagaagtgtggtcgtcagtggtcgttaaaggctttgtcgttaatagtattaacgtccgaccgatttttttccagtcgttaattttattaacgacggtgttcttctgccatcgttgttttcattaacgacggtgatatcctgccatagttaatctcattaacgaccgtgataatatgccatcgtttttcatttttcttttaacgaccgtgcttttccgtcgtcgctatttttattaacgaccgtgaaactataccattgttattttatagactaccgagaaactgtagcctcctaatttttttagtgaccatgataatgcatcatataattattcacgatggcataatgtgttaccattagcaatacatcaataacactcacggatcagtttaaacaaccacaccttgtaatatattgattcccacagttgtcctgtagcagccacgtgtttactcggtgcaaatacaaaataataatgttcactgcatccaactagataaattattcagacagcaccaacatgatgcctaattaa

SEQ ID NO: 60659 - DNA, 905 bp, Oryza sativa
cggccgcccctcggtttccgccgtcgaccaccggagcgccgccgtcgctgctaacccgagccgccgcgccgcctttgctcgtcgccggccgccgtcgtgcatcctttgactacgtggtgagtaccaacgggttcgtctcgttgccctctacgcgtaggtggtctccgtttccgccgccgaagtccctagcgccggcgagatcgcggtcccgagccggccgtcgtgctgacgtcatgccgacgtcaaccctagggctgacgtcatcagggccagggctgacgtcatctctctctctttttcctttttctcgattttctaatagattaaaactttgaaaaatcataactaaataaccgtagatccgttttaggtggttcaagtttctaaattcttctaaaatcaagatctacatgataaaaatatccacatgtactgtttatgcttgtttttgtactgttttgttgattttgtttatttgctttagtttccgacgttccggaggagagcgtttccgttgaggaaggttccgaagcgtttgtggaggctcaaggcaagtcacacagatcccaaacaaccctttgagcatgttgatcccgtttaaagctattgttttatttcaactatgcattgttttcgaatgtcatcgggtggtgagccgttccctattatttaatggccgaagatgactttattttcctatgggttataatttgattagcatgaaccttatatattggattggttcagctaaatgctatatataggtttgcttagtcatgcttagaaacattagctaattaaaaggggttaaatataaattatattacataattattactgttaataatggttttatataatggtagctcacgatggtcaatcgtgtgatgttaattgattgataa

SEQ ID NO: 60660 - DNA, 6090 bp, Oryza sativa
tccgccaaagggaaacccgaagaagtttctttcagcttgattcttgcattggcctattcaaataatacaaataattatggtgggtaactgaaaatcaaatgacataattacataaaaggcagtgattacacaaacaaatcagggagatgattcaaaataaactcctcctgtaagacaggcatattccacaggttatcatgacccaaggcataatagatgatttctctaataatgtttggcagtacaaccagcattagtacaatcgataattcaatatagattaagcccaccagctgtcaatctatggctgacagggcaacccaataggcctaacatacccatcacacagtttaataaatatatataaattttctaatacgccacatagtttatgtaatggagattaccatggtcacctccaagaaaacaaattggtatcatcttgatctgtttattggttgcatctcaagagaaaaaaaaagaaacaatatttactaataaaccacggaagttacaactacaatgaaatcaatatatggatttatcatatttgacatggataggatataattgcaatgtagaacagagaatatacttttgagaatacctacttcacatgaataaacaactttcatccaggtaaaactaaaaggcagtttgaaaaagaaccacgcacaattgtcactatatgagaataaataagattgaccgaccttatgactataaatgtctgatgaagccacaccaatttcggaaggatcatgacttctttggttcactaactgttgagtacttttggcaccagtttctctttgctgctcaaattccctgtggtaagaaagcattaataagagtcggaaccaataattcaaaataatctcattgttgcatagtaactcaacctgaagccagttttagttgtaaggagttgtgctgtgacctgcagtggtacttgttaaagaataacttaaaggaaaatcagaaggcaataaaaacaaggggcaattgcgtttttgaccctattttaaggtctaactaccaatttgaccctactttcttaagtttgctctttggaccctcttttttgaaaatgaacgttacgtctggccctattccgttaagccaacataacggtgttaattcagagaaaaatggcttttatgccctcactcatttgactcaactttttcaaagtttttgcttgtctaatttcgtgtatttttatctaaaaatgtgatattttttttattacgataagtgacaaatttaacttaggtttgagggatttgacgagtttttaatagatttaactttttttttgacaaaattcacttagatttcacttaatccctccagcaccaacagcatgcagtcctcctgaccggctccgtctacctccagccaggcaagaacaaagagaggccagagagaaacggagagcagcagcaacagcaaaaacaaagcagcagccaaacacctgctggcgagctcccgcaccatcctcgacccgcgccgcgcgcctgcttcggcgccccgcggcggcggcgagctcccgcgccgcgcgcctccctcgcgcccggcggcggcgagctcctgcgcctcccttcttccatgcggagcactgctgtgctgccctctgctcaccggcgccgagagagatggggttgaggcgaatggatagggttgagtcctcaagggtatttttgtccgtttgaataataatttgaattttttttcttttcctaaatgaaaccctaacggtataatagaaatagggtcagacggcagcttcattttttaaaagcaaggtcaaatgagcaaactaaaaaaagtagggtcagattggtagttaggctctgaaatagggtcaaataagcaattgtccctaaaaacaaagaactgttaagatcactttctcaacaacatcagactagattatgataatactgtgttaaaaccatacatgtaatattgtcccaaattcacaaccacgaagaggaagtgctattgagacaggcttcagtgcttctgcaaattcggcaagattcacgtcaagctctccaagaatactagatcgagaagtaccctggtttttcaagaaacagcgaaaaagggtaaacattacttaatgaatcatgtgtccgatgtgcttatgtttgatagatgatgatataggagaagggaaaacaatgtctagaacacaccatggccacgacaatcttatagagtttgtcatcatatgtcttggtcctagaatcctgaagaagccgtgttgcttcatatatagggtctggccatttgcaacttccattcctcacatttgctttatttgtctttgcagatacctttcccgtatcagcagaaatgaaggacaaaaatagcttgtcccaccctgttgatggaatctacaaaagaaacaagaacacatgtcaagattattcaagcatggatgaaacaaatattgaacaaacaccaagaaagaacataaatgacttcaacaaaaatgtattgcaacttacatttgtagcgtggaattgtagccggaagactaccttgactttcgctttttcgatcttccatttaggtacccttgacattgtgccagtatcaaggcaattcccagaaaggggaaactttataatttaaacatatctcagttctagaagggtcagatttcttttccctgcaaagcaaacagcaaagaataaataaagtccttaaacaacattcatgcaaaaacaaatgtgaaaatgaacttttcatgcaggtgaggtcgtgaggtacaaaaggaaaaatactggactttggtcctgcttcatataagttacacttcccacaatgggattgatcctataatagctttcaaaaacatcaatgcacccaactatcattaaagcatatctaatttcctaatgaaggcaaaagatatgcacagatacatataagttcacaaatatccattatcccgtgtaacaaggaattttcatggctataatgtatagctggttcagcggcatagaaaccagtaggcaataatgctatatcccacaaaggagatgaagtgataattgctgttcaggaaggggagggggcacatattcctctgcaacaaacctttttgttgagttcgcaaatgaaactgatacaaggttcagtataatggaaatatatcctggaagaactcagataacagaaatacaagcacgacacactgttgcatgtgctaccgaattcgctaaagggatcattcatacttaatcaacaatttaacacacctcatacaatgtacaaggctaccagtttctaaaacgtaaaaaaatagtgaaaaaatggcacatgtaaggacagactgacaaaaaaattaactttttagctagttagtgacttagttcagatccaataaaaagcagaagagacacaagcataaataagattccacaattatctgcaaagttcccactttccacaaaacagaatcctaacactacgctacccataaagagtctaaatgcaagaattctaaaaggctgcattcaaaaaaaaaacaatctaccattctgcttcccacggaagtaaacaaaatctcagcattacctccaaaaggcctccatctttccactaaagattaatacggtaccatatccaaaggccccatgaataatagaggccatcagcactgtacaaacaaccaaccaaaagcatatccaactaaccgaaaaggctctgaaatttaatcaagaagcaaaccccagccaactcagatccaccagaccctctaaaaaaagctccaataccttgcgatttaccagcaaagacccgcacccgcgcaccaagtacaagatttaatgctaaaaacgtataatgcaccgcaatcaaaccccctgatccacttaaggacgtagctgaccgaagattgagctgttagtacagggaaatttcatcagcattggcaagatttcaccacaaagttcacaagacttggccccagacatctataattaagagtagctaagctccttcgctgtaaatcaagatccccaagaacatccaccagcattggctgaacaatcccaaaaggaaaaaagaaaaaacaatcacaccaactaaagcaccgaatctaaccactaacaacaaccccatgacccccacacaaattgagaaggccgtaaaattagtccaaaaaacttgcacctttctgcactaaacagtttcacccccaacaactcccaagtagtacgcatacatctgtaaccaaaattcacttccttgatgcaaaatgctctggtatatatatttcactgattaaatcgattaaatgcagtcagatccatccaaaaaaaaaacccgggcttgcgcgaaaattccccggagacggcgaaccgtggggtggaaagaatcaagatttgggcgggaatctccccggatctactaaagtaaaggagggatcgagcgctactgttcatccattcctctccccttatcccctcctccccccattgcaagaatccccacgagcagcagcagcagcaacaacaacaacaacaacaatccggggggagaaggagaagtgccccccaccccaccgacaccaccaccgggcaaaaggacggagatggcattgggcacgaacctctcgctccactgacgccgacgccgaactcgccggagagtggccccccgctccctctcctccgcgtccacgccgccgccgccgccgcagcggcagcggacaagaagacgtacggcggccgcggtcgccccacgcgtcgcgacgccgcacccgtgactccggcgaggaagagagagtggtggtgggctactggagcgggtgatctagctgcagctgcttgctgctgctgctgtagtagttgctagtgagagagagaagagaaagatgtagagagagaaagagtgaggagagagagagaggtgaggtgaggtggtttggggttttgattagggaggaaatgaacgagggaggggagggagctttgcttaccgggcagggaacgacacccgccacagcataatcatgcctgtttgtgtgtttggtcgcttatattaatcaattcattaccccaatcaacatttttctttcagtacatcccctaattaaggctttaatctattgagatatgatagactgatatgcattgttcttgggtttctaaccgctgcagttttttattgaatttctaactcattaaacagtctacattatcatctacattatgaaatctagaaaataaactagagtcagaaactagaaaaacctagcttctctatattctcagaagctagctactccctccgtttcaagttataagacgttttgaccagggtttataattccgacaggcccttccgtttcgagcactggcggaatttggaatttcgtgaaattcggtggaaaaccggtaaattccgaacaaatttcataaaccaaaatttggatacaaattccctgagtttgccgacaagttctcgaaaaccgatcggttttggcgaaattccaatcgaaatcatcgaaatttcgatcagtaatttataatagaggtaatttactgaaattatttctttcctgatgtaagtttcagtaaatatacacaatacaacattttttttgaaaatctatatcccaatatgttctatgaatatcatagtatttataagattttatttgactttttttctttttttatcaattcaaatttgaatttggatgaaactccttgaaatctcagacggtttctactttcgagcctcgtcgaaatgttgaaatttcgcgaaatccgaccggatttcgtcggaatcgtaaaccctggttttgactgcttaaagtttgaccaagtttatagaaaaaagtagtaacattttcaacccaagaaaaacttattataaaaatatattcaattattgatttttatgacactatttagtattataaatattattatatttgtctataaacttagtcaaacttgaaccagttaccaaagtcaaaacgttttataacatgaaatagagatggagggagtatcaaacagggtgcttaagaaaaattaatgaagcaacccaaaagataaaaaa

SEQ ID NO: 60661 - DNA, 1452 bp, Oryza sativa
aatgtcgaggacaactgtatttattcaaagtttaagaatgggagatttattttcctaactctgtatgtggatgacattctactggctagtagtgatgtcagtctactgcagaaacaaagaatttaaattcttgtcctcaaactttgacatgaaagacctcggtgaggcttcatatgttttgggcatagaaattcaccgagatagaacaaagtatgcattgggactttctcaaaagacatatatagaaaaggtgttgaagaaattcaacatgtacagatgcagtgctacacctgctcctatagtgaaaggcgaaaagtatggggcatcgcaatgtcctagaaatcagtatgagctcaatgaaatgaaaacaaagccatatgcgtcagctgtaggaagcctacagtacgcgcaagtgtgcacatgacctaacttggcatttgttaccaggttacttggcagatttcaaagtaatccaggcccagagcactgaaaattggtaaagaaagtcttgtgtgcctcatgctgtcttacagaagatcagaatcgctccagatagtggggtattcagattctgattttgcaaaagataatacaaagtcaacatcgtgatatatgttcaccctggcaggaggagctatttcatggaaaagctcaaaacagactatcattgcagggtctactatgtatgccgagtttatagcatgctatgaggcaacggggcaggtgaactggctaaagaagttcatacctggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaataatcagtctcgagcacattagaatagaaaggatgctcgcggatccgctcacgaaaggcctaccacccaacatgttcaaggaacatgtagccggcataggtttaagggaagccttatgaatcctggactatagggcccaaaagtaaagtatctgtttctgaatagagatgtgtatagtggctgtcgaatccatcggtgattgaccgtgacgatgaaacatgctctatttacaaatctgtgatggaatagaaaaagctaaaagaaatagtgagatcaaggaggggaatgttaaattgatctctcacccgtcggacccaacggcacaatggaccttgaccgcgccctgatcaggggcgcccagcccaatggctggtgagcccccgtcacactgcgccatataaaagaggggtggaggccggcacggcacaaggtacgaggttcgctgccgccgccaactccaccccacaaaccctaatccgatcgagagggggcgcagccagtgacgagaaacgccaccggcgcgccacgcctcatcatcgggacatcta

SEQ ID NO: 60662 - DNA, 5903 bp, Oryza sativa
  unsure (1)..(5903): unsure at all n locations
gggatcctaaacctcgacaagttctcgagggctctaagactccgttagagtggaaattgccagaaaaagcgttggcagggatggagatgccgtgtgaccaaaacgacaaactcctcttcacggctgtttcgaaaattatgatcggtaatgggggcacaataagattctgggacaatgtatggcttgatggtcgttggctgaaggacgtggcaccactcgtgtactcgatatccaggcggaagaattgcacatcggaccgactagtaacccgaggctggcagaacaacagcgtttgcccgctatgttggcacactgacgagaccgctatatacctgttggtggaatgcagatacactaagaaaatctgggatgccattgccagctggatagcctatgcacccatggcgccgacagattggacacaagcaaccacggttcatgaatggtgggaatatcttgccgcatgccacggcgtaccaaaacttgggactatatccctaatcctcataatgtcctgggaaatctggaacgagcaaaaccgacgaatcttccgaaacaaggagctaagcacggcagccctcatcacgaagataaaggaagagtcaaaaactggggctacggcgggagccaaatacctagcggagatgttgccttagtgcctggtcgccttttgtaaatattaccttttcatcttgtaaatattgctcccttctttattcaatgaaatggcaagctctgccgtagttcaaaaaaaaaaatctggtttgcagcatgtgcatactcactttggaagataagaaacgtcaggattttcgacaggcaacaagccagactatcggatacaatccagcaaattatcgactgtcttgaactttgaaaacaccgggccaacgcagccattaaagagaaactttcactctggtgtaactcaatcacacagagttaatgtaaatacaaactagaatgttttttgtttttaggtttcttgtatattctactttcaactcctacttctcctgtatccccactctgtatctctattcctctccattttgttaatgaaatggctataaggtagagccggctctaccttcttatgtcaaaaaaaaaaaactatgaaatatcaatgtcgcaatagttattctgccattctgctgtcttggtgtgctgtttagctgtttcttctgcaatgtagtattgtattgtttcttcttttcgtcaatgatgtgaaggttatgttttatacttggaatactctttcattatctttcataataaataaataaatgtatgattgggactctaccaataataattataacagttgggctaactaggttgtttcctttgccgagtacaccagtacaggtgcagattattcttggctatatgaatgttgtgtgctcactgatcaaagttccatttcacagctggtttcttcgcagaatccccaaatcaactcccatcaatcgggctctttgcctcttggaggtgcagtgcaagtgcgtgatggatccaacacccatcgtgatcagtctgttagattgatctccaacctgtcgggcccaacggcacaacggaccttgaccgcgccctgatcgggggcacccagcccaatggctggtgggccctcgtcacactgcgccatataaaagaggggtggaggccggcacggcacaaggtacgaggttcgctgccgccgccaactctaccccacaaaccctaatctgatcgagagggggcgcagccagtgacgggaaacgccaccgccgcgccacgcctcatcgtcgggacatctacgaccgtcactgccgcagccgtcatcgccgtcgaccttaccggcgccgcatccacgacaaccgagcgccaacgacgacgatggccggcacttcttcatcctccaacacctcaaccggtcggtatctaaacccctctccctttcatctattgttcaaacatcaacccaaatagaatcacccgacctagacctaacctaggtgatcctagtgcaaagtctaacacagtctactgaccacgatcatccctaagctgtacacgctcatcagtgggcagtacaatctggaggagaccatccggcaagacatccgatccatcaagaacgagctggacatgatgttgagcgccatccaagattacagcagcttgctgatgacaacgcgaagcggagatggccgtcatcatcatcagctgggagcaggagctgtgcaggcgacatggatcgagaaagtgcgcaccctggctcatcagatggaggactgcatcgacagctacatctacgatcagatggctcctcatggctcccggaggcaaggccctgctcggtttgcatccgaggtcagggagctcaggagcagatcagctgaactatcccagctgaaccagcagtacggagcagctgttctcagccgggagtaaatcatcatcggtgacggtggtggtggtagtactctatcctctgccgcaccgttgtcgacttctccagatgagctcgttggcatggaggctcgccggggggagctcctggagctggtaaacggcgaggggcagccggagcagcagcgcaaggtgatctccatcgtcagcttcggtgggctagggaagactgtccttgccaatcaagtgtattgcgacactgacgagctgaatttcagtcctcgggcatgggttagcgcggcagagaagacagctggggaggttctcatggagatattgcagagatttgaggtgcgagtaagggacatgccttatttcgaccaactcagcaagcgtctcagggaacaccttcgcaacaaaaggtaaggctaattaatcggttttgcatttttttttcgttggtcgtttcgtcattcacctaaaacttgcatagagtgtagactaaacctttttataaggtgtatgatatataaaaactgcaattttttatacataacaactgcaacttcttgtttgctttattttttttatttttctagattaatctagaatagttttatgcttatatagtgaggataaacaacaaagtgtattctctttacagtttagtttagaacattttttttcacaatagcgacaaaaaaaatatgcatgagttattggatattgatttggtgttaaagaaaaaaagagctatcggtagacaaggaaaaaataaatcagtcacttcacaaataaacagtcccaattactatacactgcttctagaacaaatagtgctcgggcactttatttacattaggcatatgctctgtatgaatgtgcacacaattttttttttctaggagtgaagtttagcctgttaatctatagactagttcaaataagtttggattgaacttgaaactatcgatgtctttcatttgccttttttagtgcatcatattgtgagatgttcagtgcaagagtcaacaggtgggtttagggatggggttagctcagtttgtcagaatcttgttctaaaattcccaagttaagttccaggattatatttaatcagcaaagaatgtgatacaaactaatcagttctacctaatctttttgtatttgagtgttacctaaattcagaagttgttgttagtgctaaagctaaactcatagatcaatttttccccctctatgattgggaaattattctcgcaggtatctcatcgtaattgatgatataagggtagaacagtggtgtaatatggagcctgctttccctgccgatcatggtatcagcagcagaatagtggtgaccacgagtattcaatcaattgccaatgcatgcagcatcccaaaaggctacatctacaaaatggaaaaactagatgctgaatgctccaaaaacctgttcttcagaagcgcctctatcgaggaatgctcacctgacatagagagaggttcagaatcactttcggaaagaaaatgttgaattggggccncctttccccccaacccttgggggccttcctttgggaattcccttggggcctaggccagttcttgcgcacagaaggagctctaacagggcatgcaattacatctgcagcaaactactccttcgtccaaaagaaaaaaaaaaaacaaaccctgggttttcatgtccaactttgactatccgttttatatgaaatttttttataattcgtattttcattgttgttagatgataaaatatgattaatattttatgcgtgacttgtctttttattttttttcataattttttcaaataagacggacggtcaaacgtttggcacggaaaccagggtttgtctttttttgggacggagggagtaggttactatctggagaacgacaacaatgcattagcaagaatgcaagggttgcttgccaggagctatgcctgcctgccatgccatgatgccaaggcctgcttgttgtacctaggcatgtttcccagcaactacccgattcggaggagaagattgttgatgcgatggctggctgaagggcttgtcagaaaacggcctcaccctcggcttggcgacgcggcggtcaacaacttcaggacgttcatggaccggaacatcgttcatcctgtcggtgtgagcaccaacgacgaggtgaagacatgccagctgcccgggatgatgctcgagttcatcttgcacaggtccatatcggagggtttcatcacactggtttctgatgagaatgtgatgcccaggtatgcccctcgtcgtctcgctgtccaacttagcactgctgctgtgaaggacaggctaggaccaagaagtgatctctcttttgtccggtctctcatggtctccggcatagcatcccaatgtgttctggatttcagcaggtacaaactgctcaaagtcttggatctggaacaatgtgacggattgacggatcaacatctcgaaggcgtatccaatttgttgttgctcaagtatcttagcctcgggggagaagttaccatgctccccaagaagattggaacactaagtttcttggagacacttgatgttaggagagccaaggttgatgtgatggtgttcccggtcgaagcaatagtgcttcccaaattaattcacctctttgggaagtttaaacttttcggtaaggtatcggataaaatacttaagtttttcgatgcgggaaaaagtaaactacaaactttagccggatttgtcacagacagtaaccaaggttttctgcaactaattggtcatatgaagaacctgaaaaaaattaagatatggtgccggtctataccagatggaaacaactttcatttgatttcaaatgccattcaaaactagattgaagacggcgatgacttgaacgatgcccgttctctgtctgtccatttcaacgaatgctctgaagacatcatgaatttttccctgcaaggagcctgcaatctttccacgctgaagctccaaggtgacctgcaccaaatacctccatttgttccctcattggtagctctcacagagctatctctgacatcgactactcttcggcaggaactcttaactagcttgactgaattgagatgtctagtttatctcaaacttgtcgcgcaaaatctcgagggttttgtcataaaagttggggcattccaaagccttcaacgactatgcatggtggttcagaatccatcattccttgaaatccaggatggagctctgccacagcttgtgtctctccagctgatgtatgaaaatttggcaaaccttcctttaatcaacattgggggcatcaagcgtcttagggaagtggtgcttgattctgcggtaaatggaagatcacggaaaaactgggcgaagaagcacgcaaatagacccagaattttgttcatcgaaaggacgagaagggccagatcagaacattctgttgcacaggcagaaaaaccttctacacttcatcgg

SEQ ID NO: 60663 - DNA, 3434 bp, Oryza sativa
cgcggcgggcgcgaaggtcgccggcgacggcgacgccgctccgtgcggtcgcgcaagagagaaaagaagagaggctagggttcggtcggccggaggctggggtcggggttttgtccccccgatctcggcgcccggccgtcggatctaaaccctagccgatcggacggcgacggcggctgggccgaaagcggcccaagaggggcgcgcgcgcggcggtttcccagcccaggcccacgttgcggcctagggggtaaaaagggggagcgcccgcgcggggccgaccgggaaaagtccatttgaggtccctcgggggccgaaaataaagaaaagagaacagtagcaatttttcctttaaattttgttaattttcatgcaaatttcaatagaatttgaatagatttttgcatgttttacctctgtttaaatttgaaccaacgggagaatttttacagagagtaaattacagagttttgctactgttcatatgaattttatatagtttttccgttgcaaatagataaaattgatgaaaattagtgtttctaaaattaaatttcaaaccaacgggagaatttaattttaggaacattaattatgtgctatgatgttgtaattttctgaccaacgttgataattgcaatgttatagttatggttatatgtgttatgtctatttctgcccaacggtgatgtaggcttaatgcataatattttaatgttaattttgttctcaccgcacatgattatttcaggtggctactccttgatgggttgcattaaagatattctgaccctaaaaggagataactacgcagaatggaaaagaaaactcgaccttgcttttatcttgggagatgtggactgggtgttgactaccccatgtcctatagaacctgctgaacttattagaggtgaaaatgagtcagatgctgattggcaaaagagacagagggacaatgctcctctcgtcatgtcgtatgacattgaacaaaagaaatggtccttagccaacaagaaatgtttggctgtggtaaagaatacgattgagccaaccatattgggctcaatcccagagtgtgacgctgtctcagagtaccttgaaagaataaagagccagtttactggctcttcaaagacttatgctacacagctgatcaagcagcttgtgacagaaaggtaccatggaggtggtgttagagaccacatacttagaatgagcaacatggcttccaagttgaagccaatggatttgggcataacagatgactttctggtccatctggttatggcctcattgccaaagcaatttgacaattttattgtcaactacaacataagtccagagaaatggaactttgagaagctcattgccaattgtgtgcaagaggaggagagaatcaaagagtcaaatggttgttcaattaactatgttaaagataacaaaaaaaagaaccacaagtcgtctcccacctcaaaagctaaacagtctcagcatctgcctcagcaacaacagttcgctgttgagaaagatcagtgtctccactgcaagaagacaggacattacaagaaagactgtcctgacttcttgaaaatgatcatggcaaggaaaggtgagaacattattacatttgtaaatgaatctcattatattggttactctagatacacatggtggattgattctggagcaactattcatgcttgtaattgtttaaaggcattccgttcaacgaggactacgcaaagaagagaaagctccattagagttgccaatggagttgaagaaaaagttgaagctgttggagatcttcctctagagctcgcgaatggcttcacacttttacttcgagatgtcttttatgttccttcttagcaaagaaacttaataagtgtatcaaagttggattttgatggatatgattgccactttggaagtggcaaatgtgaactatggtataataatgcatgtattggtcttgttgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcacaggaattttagagatcattcatacagatatttgtggttcatttcctgtgaaaagtgtggatggctatgactcgttcataacattcacagatcattacttccgctatggttatatttatccaattaaagagcgatcagaagcattggataaatttaagatattcaaagctgaagttgaaaatcaacatgatataaagattaaagtagtaagatctaaccgtgggggggagtactatgtcgacatacaccttatgggcaagtccatggaccttttgcaaggttcttgctagagaatggaatagtagcccagtattcaacaccaggcgaacctcaacagaatggggtagctgaaaggcgcaaccgtacccttatggatatggtgcgcagcatgatgagctactccacactaccactgggtttatggatggaggcgttaaaaaccgccattcatattctcaatagagttccaagcaaatcgatgcccaaaacaccgtatgagctatggacaggaagagtaccctccctagctcacctccgtgtgtgggggagtcctgcagaggccaaagtatttaacccaaatattgggaagttggatcccaaaacagtcagctgccattttattggctatcctgaaagatcaaaaggctatcgtttctactgtccaaacagttatacaaagtttgtagaaacgagacatgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatacctgtcattgatgtaccagcacctgttgttacctctcctgtggcaacaatgaatgaaaatgaggaacctgttatacaggattcaacagaaatggttgccacaccagaggaggagctgcaacagcctcaaatagataatgtgccagtacaggagactcaacaagagcctcaggtacaggatgtgccaaatgtgcaggcccctagaaggtctgaaagagtcaaaagatcggctatccgtgatgactataaagtttataatatagaagagttgcatatggaggatgatcccacctcatatgaagaggccatgagaagcgctcgctcatctgaatggttggaagccatg

SEQ ID NO: 60664 - DNA, 2048 bp, Oryza sativa
aagcaaggaaactgctatacaaggagttccctgaacactaccgttggataaccggacagaatgtgtgacagaaaaggaaaacggagagacgccaagttggacggattgtgtacactcaccctgcagaggaggagagatactacttgagagtgcttctcaaccacatgcgaggtgcaacctgaagatttgaggacagtgtcaggtacaacgtactttacctttagagaggcatgcgagaagagagggcttgtggagacggataagtcacatgacgattgtttgaatgaggcatccactttccaaatgccatctgctctgcatcgattatttgcaaccatattggtattttgcgaagtcactgatatccgtgcactatgggacaatcacaaggctgcaatgtctgaagattacagccgagggaacactaaccctgcagcagtagagcagatggtgctacgagacatacgtgatttgctttattccatggggaaggatatcacggagtatggtcttcccgaggtcattgatataggtttttttatactatcacatctttttcttattggtttacatttgcaccacccaccaatagtttcatgatgcatatatttgttttcactaatctcaggtgaacgttgcaatgacgtaatgacagagattatagaggaacttaacgtgctagtggaccaagaccatttagacatatacacaacccttaatgatgagcagcgtgcaggatttgatgagatcattgatcatgtaactaataagaagagccaggtattttttatcgacggcccaggtggcactggcaaaatatttatgtaaaaggcacttcttgctagagtgcggtctgagggattaatagccattgcaactgcgacgtcaggtatagcagcgtcgattttgcccggaggacgtaccgcacactcgagattcaaaatccctattaatattgctcacaacagtatgtgcaacttcacgaagcaaagtggcaccatggaattgcttcgcatggcatccttaattatttgggatgaagctgcaatgatgaagcgtcaagccgtagagacacttgataggtatcttcaagatattatgggttgttcattgccatttggaggaaaggttattgtttttggcggtgatttcagacaggtacttcccatggttacacgtgggacaagggcccagataactgatgcaacattgcagaggtcgtatttatgggaaaaatattaggaagatcagattgtcgcgtaacatgagggctcaatctgatccatggttttcggaatatctccttagaattggaaatggcactgaaaatactattagagatgattacgttcgcttgcctgatgaaattgtgattgcttatggggatagcgaggattcagtacacaaattgattaatcatgtgtttccctcgcttgatgatgaaaagaatgcaagctctgcatcttatatgagcacacgtgccattctatccactaaaaatgattatgtggacaagctgaatgcaaatatgattgatagatttccagggcaggccaaggtttatcacagttttgactctgttgatgatgaccctcacaacagttatcctctagactacctgaactctatcactccaaatggtctcccaccacacgagctaatagtaaaaatcaattgtcccgtgattcttcttcgcaaccttgacccaaataatggattgtgcaatgggactagactaatggttagagcttttcaagataatgcaattgatgctaagattgttggtagacaacatgccagcaaaagggtgttcatcccatggatccctttgtctccctccgatgatatatctctacctttcaaattcaagaggaagcaatttccaatacgtctcagtttcgcaatgactattaacaaatcacaaggacaaaccatcccaaatgttgggatctatcttccatagcccgtgttttcacatggtcagctatatgtcgcattgtcaaggggtgtgtcaagtctaacaacaaggattttggcaaagccaaaga

SEQ ID NO: 60665 - DNA, 2293 bp, Oryza sativa
ttagatgtatagaaatactatatatatagaaaatatttgaattcaaattcaaatttgaaacgggtatataaacttttgacttataaactttaggtctataaacttaggtgtataaactttagatgtatagaaatactatatatataaaaaatatttgaattcaaattcaaatttgaatcggatatataaacttttgatctctaaactttagatgtgtaaacttgatgtgtataaatttactaaaataagaaagtaatgcggtgccaaaaaagaaaaagggaggagggaggggatcgatcgctacccccgtctccagaggatcgatcgcccattagggtttatcgattacggacggaaccactcccattaacgttatcgttatcttgatctaaccaaacgccaccccagttgcaagctgctcctcacaccgatttctcccggccgcgtcaccaaccaacgtggcgtcgtcgatctcctccgcgcatccgccggacctccctcaccaatctgctctgtccgtgtcaccaacgacggccgcgtcaagtacttgcgccgccgacgccggatcggcgggaatcgtgctcgaatgggccaggggcaaacggcgccggccggctcttctcctcgtcctcccggtctagccaaaggtgccaccctaatcatctcctatgacggacaacggtgccacacctcctctgatccaagctgacttgacctgttgagattgccccaatgtcaccgccgtggtcactgctgggatgggaagcacgggtcacgacgcggaggtcacctgggccaacttcgacggctcgtctttggcgtcgccttcttcgtttatcaggtactgcttgccagcctcccactccctcccaattgccaaccgccttgcagcgcatagtatctgcttgctgcccttcgaaagtaggagtagtgttctgtacatgtatcgagttaagttagaaccttggctgctattttgcctcttgtagaaatttgatattataccattgcaaaaagggaaaaaagttggttttgctaaaactgtcattgtggagatgggtttcgctaaattatccttttcaaccggtgcatcattgctaaaatgctatctcggacgaaaataccctttaacttcttccaagcttctcccttgtttgctcgccggtgacgaccagaaaaggggtggcacgggatggaggcaacgagccggtgagcagtggcacgcacgatctgcgacgccggtttggctcaacgccaagccgccgtcgaccacgagtcccaccgccttgctatcccgcgcctcaccggatcgccggctcctacacaacgacctgctgcacactaccgcacgcatcctgacgaattcaccccaaacaccctgctcgactccgacatactcctccggcgctaccaagatttgcaaactagtacaagcgtgtatccatctcagggacagagaaagcaagcacaaccgttcttattgatcccactgtttacacccaaatttggcacctagagataaaataggagaaattgccaaaatttgaaagtctgctggttttcctctgtggggccgatctgaccgtcgtgtgtgggccggtcagaccgctggttgatggccggtcaaaccggcggtatgtggccggtctgatcggcaaagtccgagtccgggtctgtttcgccgggtcttgaagtttccttactcgggaaggcatgtttcaggtttcctctggattctatcccgagttggacgtggaggagggcttgtagagggcaagaccaacccctgtataagggatatggccggttcaattgtaactaaccaatctacaatcaatcgaatcatttttcatattgcttttagttttctcttagtttgtccatctttgtcgatttgtgccgtaaaccatccgctgacgctgcgagagtgcgacacctctttatagatttgtcctgaaaaccttccgttttgcccacgagacgggtagttacctagaaatcggcttcgctagccggtttagttatcaaaacctatcttggtctagtttttgctagattgaggtggttgacaactctaggatcaccacaaggcattaggtgttgtgatcgtggttgtcaacttgtcacaaaaagttaccaatacgattttttgacacctctttgtaggtttatcctgaaaaccttccatttttcccacgagacgggtagttacctagaaatcggcttcgctagccgtttagttattaaaacccatcttgatctagtttttgctagattgaggtggttggcgact

SEQ ID NO: 60666 - DNA, 2295 bp, Oryza sativa
  unsure (1)..(2295): unsure at all n locations
gggcagcgcgaagggccgggcggctggcggccttgctgcggtgcgccggcgggcggagggccgggtggcctcacagcggcgcggagggacgggcgacctcgcagcggcggtcggcgctccggcgggtggagggccgggcggcctcgcagcgggtggcgcagcagcagcagcaggcgtttctttgtttttttttgagaattcgtgattcggatctgagatgtatttgatttgtgtgtgatgtgaatatgtgatgtatttgtgatgaattttgtagaagttgtgatgtaattttttttaagattttgtgatgtattttatatgatcgatttgaggatttgaggatttggggatgattgatttaggattttgggatagggatggagtgaaatcaatatattaaaaacaacgaagaaaagaatagaataatggagcaaccggatctagctagcctagctctattgttagtactaaaaatgttctatctttagttccggttggtaaccccaaccgggattaaaaatggatttttacccccggttatttcacccgggactaaagataacgatctttagtcccggattcgtagtcccggttggaaaaccgggactataaagggttatgaaccggtagtaaaaagcacttctccaccagtgttactctcttagattggaaattatgcatgagaatcttctactgtatagattgaggggcgagatggggagggaggcaaaagaggtaaatggaggttttcacagaaaacaaaggtttttttttatgatctaggttcatgatgttcttggtgcctattgatttaattaggtaatgtttaaaagtttgtgctctcaggacatatcttagatgggagcagtggataaagaagttgcagttcattaccattggttcaaggtaacaacactagtttttttttcctatggaacgtattctaaacaaacattaatcctttctctcatttcagacanannaatnctcttnaagnnnaaattcccacttcagtatttttgtgcaatgcggttttcattgggaccaccggaaatcacttaattatgtaggaaagagatgtggaaatcctatgatatatgcaactganaatagtaatgcttccgtacctcctaaagtgaatgtgatgcaacatagatttttcgaatatttatcaatatggccctttgttctacataattagagtaggttgtatatttaacagttattattcatcgtttagacaataattgtttggtcgactattatgtagtaaagaattcacagctctacctctttgccaactactatatttggtcgaccatagatatcaacctggcacttcacttgattaaccactaagggagcctcccatgtgatgtttcataaagaggttgaattgttacccatttgcaaacaaatacgtatagattgagataattttcatgcatttttttttacttttgttctcctactgattttcctattataatattacacggtttcttttagatgaccacatttgctggaggtgtatcatccatgcaggcgcatggaccaactgaccaccatatacatcctcctttcaaggatggatttggtccctctatgaaccaaacaagttttttttgttcgagaacaactttctcaactatatgcccttataacttctctcatggttagtatcatgcttcggttcttgcatgcgccatatttcatggattggaagtagaaattgtgcttagatagggttattgatgcttaatttttaccttggcgtgcttaggccgatttaagtcctattgtatccttatatgtatcaccgtatcaatgaaagatgacaggcggagagctcctgcaggcaataaatttcctatggtaggatgagcctatcaagttctaacgggatgaaatacaccgagtttctggtaagataattggtttgccagtcatgatggatctgcaagcaatattactgcagtccttcttggctgaaaataaaaatgttgaattgctgcttcatgctttttcaggagtaaagccagagaggctggtacagggtctatctcctagatattgtgcattatctctggttgtggaaccaaatatgtatccagagataaatgttctgattgttgatctacaccgtaggcacatatctacatttcttgtcagtaatgcacagtttcctgataagattaagacattgaaaccaatcaatcatgtcatattcgaattaagatatgttttggcatttaagtgctcaaagcaacaagctttaaagatatctgtttatat

SEQ ID NO: 60667 - DNA, 9032 bp, Oryza sativa
tttttccagactttttaggtcattaaaatgcaaattaattttatttttttctactatggctactcatggagttgctattcgaaaattaatcaacttgtgtggactggttttcgttgcggttagagtgtaattgggaaatggttttgtttttacctactataatatgtgctttggattaagaaactgcgtatgctgccatgttgtccccctgggttacgtgtcattaatatgatgccatctccttttaccttcgttgtactgaaacatacagaacacttgttttggcaggtataatagtagattttctgttagcatatataggagtagtacactagatgcatgagaaaaagcaatatttttataaataccatattgttttgtcttctctgttgatttttgcaggacttctatggttggaattgatttcaggactccattcaaaaaatgtgtggcataaatggaatgatttatggtagttgcagagtcactaacaagtaacacccccccccccccccccgccgcggcccccctccttcaaatctgaacttgattggttgacatcgatgaggggagtacactttatttgtctttttagaatgattctttgctccttttttaaaagagtccaaatcagccaatccatatcatttgtatgaatccaatacagacgcatgaagtaaagttgtttagtgactcaccagcccaggttattttgagccccggaggatttgcactgtcattactttatatgtttagtacactatatattgatgaagaattggagactagatagttaatttacattctgacattaaacattgcatcacaacattgcaatgattttagtttccatacatgctacatttcacattgttaaatgccaggtcgatcaacacattggagaaataagaaatatatgtgacaatttgcgcttgaggcaagctcatttttgtacccatgtcattgttgcctgcagtagagtgacttcacatggacctaataggcaaaataagctgacaagacttatcatcttctgttggaaacatggaatattgagcaaatggcatgatacttctgttaccatgtttaaagacacttgcattacctctgttatgtaatcttgatgatgataactatttgtatattcatgttttggcaaaaacaagtcatcgttgtagtgtatgttttgatcaaaattgtggtgtatattttgcaaaaatatgtcactgtatcgattggtaatttgttgattatgtgtgctcattttaggttatatacgcactgttaattttattaagtacatttctgttcgagtggtgataactatgatttttatcaaaaccatcagaacccgtattatgccattatgttatgtccttctagtctgaactaactgatcaaaaaaaaaatcatatttgatattcatcacaagtatatctatcttgggcacgccctatttgaagtcacgtatatatgcttttcactttctgcgatgtctttttgatcgatcgcactaaacacattactcgcgcacgtgtcgcagctcgtgatcctttctacttacctgtcaagaccgcattctagagttatttgaagagagctacacagcatatcgagccaaacactctacacatcagctccaactccaactccaacataaagcggccttacaagttgcagttggagctggacccctgccataacatatattgaaccaaagggtaaggagaagaacaaaccaagcatacctagtaaaagaattagggtgtatttcgttgcaagccacactttgccacagtttgccatgcctaaagttaggcaaatttgacaggtgtttggttgtagccacagttgtggcaagattcccctccaataaattaggtcccacgtgtcaatggctcaaaaaagtgtggcaaggttctattaggcttagtagttgtggctaacaatttgatcacttcaccttagacaaagtgtggcaacttttattggcaagtaatggcaaagtatggccgagaaccaaaacatccccttactgctactcctggggagaaagtagtaaacagaaaaatagaaacagctgaatttcagagtagccagcatgcgacatttagaaaaacacatccaatatttcagtatcaacacaaacttaaaatgctgccatcagacctacaccagtgaccataataagagtcaaagttaattagtcgctgcctgctaatttgggctactcagttgcgcaagcatcatcattaatcataaacaacaaacagattaaactagcaactaggacgcgaccacgtctgatgttgtgatgaatttttaaccatctgaacaagatgatggccccttggcatggtccctggcatggtcaaagtagaagaaatcttcttgcaccgcacccctgaaattagagaccaagaggccattgttgaagacgctctcgatgctattggtcaaaacgtgcttccggcgtgccatcttctcgaagtctgtgtcgcacccatggtagttcccatcagccgggtgaatgatattaatgcctttatactcacagtagaagcaccggaccttctctgcaatgaatgagaggaagattaagcgaacattcaagagacaactgttgcaaagcaagcacatgtgtaagctagaacatgcaggtggacttcttttctgggtgtgtgtgtggggggggggggggggggtaccagttgcagttcagttactagcaacattccttggcaaatgagactagttaaagacatgtcaaaccaaaagcaccgatcaccgataagcgaatgagagacgcaccagcatttgttggtggcacgacaacagggtagcaattgttcttcctggcacggtcgctttcttcattgtgatttacgcactctgcaaagaaaagggttggcaacacacccacagcacttggcccagtagggctcgccaagaagttaatgtgggaatagtgaaatttgttgtgcgatcttggccagttaatcctgctaagctctgggccattgcggtccgcgacactttcgttcgcaccacagatgacatggatcacatactgagggccctgcaaacatacaaaacagttcaattttgtaagcacaaaaaaaaaaaaaaaaaaaaaaaaactagtgatgagaacacagaatcagagaaaaaagtgagccataccccgttctccagaacatagctttccaatgcggccttcgccttgctgtggaaagagctcatgtcagcccagaagcgcttggtagcatcagggaactggtcaatggtccgttctgccgccaggctcaaacgtaccagctccggtggcatcccaagtgacggtggtggttcatgtaacagtgactcgatgacggaatgcacatcctctcgggagaatctgcgatactccatcggcagcatagcacgagtgcgctcagatatgaggaactcttgtagtccatcagcgctcgggtgctgagcagcaatggccatcacgctgtacagctgcaagcgcttagccataacatccatgaagcggcacagctcggagtcagacagcattgtacgttcttggttcaggagtgcttgctgcagtacgctcatggcagtggcaaagtccccgttggcgtagaggaggcacctgatggcttggagttcagagaggttgtagtccccggcaaaggcaatgaggccagcgacgaggccagcaacggaatagcgctcagcacggaccagcgcccacctgccaatcatgtccaagtctaggtgctgctccttggggaccgggaacgcggcgtcgtaccagatggtgttgaggatgatgttggagacggggtcgagtgggccgtagcagtggccggccatgacaacgctgcggtggtaacggccgcggagaaggtgttgaggtaggagagcgagtgcctcgaggtagaagccgtggattttgtcgacgagcacgcattgcagagacttggtgcatcgttcgagtgttctctcgtccttgacggtgacaccttgcggggcgagtggggagaaggtggcggcagcgtcggcgagctcgggtggcaaccttggaggcacaagagccatcagttgttgagtacaaatttggtcattggttccttcttctaggagaaggtagctgaggtggtccacgtctgagcaggtgagacgacccttcctagacaagagatgggcgatcttgtgggctttggaagagagcgagagcatcgccgtggccaatctgtccgggtcggggtgacccgaggcccctgcggcgcaccggagggcggtcttggtggtgcaggagccgatgtcgaacgcgctcgtgcaacgttctgcctccacgaggtggacggcggcgaggaggtcccccttggcggcgcgcaggaagtgcatcgcctccatagtgggcagatagcggaagtaggaggtcatgaaccccacgagggctttgagagacccccgcgccatcgtcttcaagcactgccgcatctcaacctaataaacatgttcgctagaatcctcaccggtgctgaggtgccagatggcgttggcgacgatgttggagacgggatccagggggccgaagcacaaaccgccgtcgaggatggcggccagcagcgccggcttctcttccaccgggaggcgctcaatcgcccttgtgtagaacccaatgatgcatcgtttcagcaccgatttgtcgcctccgccgccggcatcgggcaccggctgaccggggccaactcgtttgctggccataggacggcgtccgcggcgagagattggcggatttggattcggggggtttcggtttgcctacggatttgggaagaggcccttttctccagtttgtatgggcgacgaatccgcaagtgtgctttgtgtgtgcctgttgatgagccgagctcgagctggacctagacttgagccgagcctctacaatggtggtccagcttgggattgggctcagcttgagtttcgtggagtatttgctcagcttggggtgtgattggttggtgggatatacccggatagaacatggccgccgctttttggaggttgtttggttgctgggcgaaagtgggatagggcggcccggaggggaatattcccctcagatgctggatagagggatccggccgatttggccggatgcagccgcccgaggctcgggcgagccgggcgagcgagtcatgtgactcgcgtcacccctcaccacgacgacgcgagcgagacggcggatagggtggccggcgcgggcgccggcgcgggcgacgagagaggaggcgagcacggcggttgtcgggggtgacgagcgcggcgaccggcgagagagaaggagagctcggcaaccggtgtgggcgacaagagaggaggcgagctcggcggccggtgtgggtgacgagcgcggcggtcggcgagagagaaggggagctcagcagccgccgcgggcgacaagagaggagacgagctcgacagccgctacgacgacgacgacaacgatgcggacggcgagcgccgcgtcggcgtgaggaggtggcggcggccaccgccagcgggaggaggcggctggcgggaggaagcgacggtgagaggaggcgagcggcgggaagaggcggcggcgacgagccccagatccggccgtgtttttttttcttttttcttttctctttttttcttttttctacgtgtatttataatggaaatagtggtgtaaaattgtattatgtattaatttgatggagtatattcaccatctcaagtggagaggtgaccacacactaaaaaattggatcaccaaatccaccttcgtccctacaaccaaataaaaaactggattgccatattcacacaaccaaataaaaaactggaccgccatatccaacaaaatatggaccaccatatcccatccaaccttgaccaggaaccaaacaaacccttgatgaaccgatattgtcgtttcgtggagtatttgctccatatcctccatctgctactaaaaatacaaatacgatttctcgcaaaaaaaactttttctattacattattattgtttaaaggcccctcgtttgttctatttttttgagttctaaattattacatttattaattcggaattgctaaacttcagttgacagaaaacatacctccaaatcttgcaaattttggttcactagatatgcttcgcgattcgtgctccagctgctgcttctccagcgctggcgacaccctaggatgttgagttgtgatccaaattcatttgcacttaataaatgacaacttctgccgtagcaaagcggaagcccatcgccggaggcttgggccttgaagctggcccattgggttgtgcacctagagacgcccaggggtgcgggtgtggagcccccgcggtacggatcgtcttcccttttagggttccacctcatatatatatatctcttgtaagccgccgtgcgacgttgtaacctcaccccgatatagtgaagatattttgttggctagcgcccatggttttttctctcctaatttggaagggttttccacgttaaaatctcgtgtcttctgttattgatctattattctttatcgtttgtttgcctatcgtttcctaacataggaccctacgggctagggtctcgtggtagggtgggggtgggaggggtgggagggggaggaggaagaggaggagttcgctggttttagagggatggccgtgggaggcggcagcccagcggtgggcggtagatcgggcaggcggcggcggcggagccacgggatggaggagggtagtgggccggcgttggtggcaggggcaagcaagcatttggttaggaggcagcgggcgatggttgcggatccggcagatccggcagcggatagctgccggagacggggaaggcggcgggcggtggttgcggattcggcggcggggagccaccggagatggggaagacagcagggcgggggcacctcgccatcgccgccttgaggagaaagagacgggggagggggagagaggatggggagggggctcgccggtgccgttgactctttccggccaaccgacgaggcgagtggcggcacgatggggtggtggcggagggggatcgcgcgagggacaggaggagtggtggcagtgtgatctggacgggggaggaggagaggagttagggttaaggggtctacacgaatcttgaagcatatccaatggtccaaaatttgaaagataggaggtggattttctgtcaacagatatgtagacaatcccttattaattttacttcctaaaatattcaatttatccttatagtatgcatataatccttatggctttgccacttgtttctccccgtagcttccatccatgctcgatctaagggagtggtagacaaaattagaacaagttaaaaagatcaggatcgagagaaaaataaaccgcaaccaagaaacacggttagggcatgttcaatggtagagatgagtatggtctcttaaacaatacaagattatttagagaccatgtctttacaatagttgagacgacaaaggttccaatcattaactcaaaaaatatttatttttttaatattctttccattcttttaccctcatacaaccatatttctatattatattatagtgattaagagtcgttgttaagctattgttatgcatgacaacgatgttttgtctctccttttttctttcttccatgtcaacaagtattcttaattagcaatgtattgacaaccatcgtacatgtccttaatagtttggtcctagctgctaagtgaccgaatgttattccgttaattcggccaccacccttggttaaccgaataaactaaattcggccaaataggcccaatacaatatacagaagacatcagcctaactagcagaaccctaggcatgcactgcatggggattcctaatcagcgcgtacgcgcgaggagcggaaccggcatgcactccccacaccggcacgtggcccgtacgtcaagtacgaatctattaatagtgtgattagcgttaataatagtgttattaaggaatttgtataataaaaaaataaataataattgagttgaaaattttaaaatatcagttaaaagtattcatagtttaagttgaaagttttcaaatttagacttgaaagttttcaaatttaactaaaagttttcaaattttgagttgaaagttttaaatttgagttcaaagtttgcaaatttagagttgaaagtttttaaaatttaactgaaagttttaaaattttgacttgaaagttttcaagtttgtcttgaaagtttttaatttgagttaaaagtttttaaattttaagttgaaagttttcaaattcatgttgaaacttttaaatttggatataaagttttaagtttcaggtagagttttttttaaaaattctaattgaaagtgcaacggaatgaaaaaggaaaaaaaatacaacgtgattagtctaattctgatacggattaaaaagcgaaaaattagactaatcatgacgtgcgtttcctattaccgtgctaatcgcgttttttttcctcgaactccgattttgaccaccgcgctaacgacacgtggatccggtcagtggcggatgcagctttaaaaaaagaaggagcaaaaatattcactcgataaaaacaatcgaacacaatacgtaccacgtactatatttatattgcaattgcataagaagcatagtacattcaataatttaagggcaacaaagaaattcaggatggtacctttcattttaaaagaaagaaatgacctttccaccatttataattcatcacacaccaagctgataacagaaaacctgtcaatttgcaaacacaagtccattgataagacatgggagatagtgaaataatcatcaaatctctttaaaaattggttgatatataactatataaggagatgcacctctaataaatcactaggcaaatctattattcaccgttcgtccataaacttcatgatataccttagaaattaggataaaa

SEQ ID NO: 60668 - DNA, 14454 bp, Oryza sativa
  unsure (1)..(14454): unsure at all n locations
taatgggtggttccgcccctggtggacgtatgcgcgcataagctatctggcgtgtatgcgctaactagcaaaaccgcactgcatccccttagtcctcctcactccttatcccgatcggccgatcccctcattcgccaccctcaggcaccgccttagcgtcaacccaccatgtgctcctcctcgtgcttgatgtcatccttgcctccttggctctgcaacacctgtcacaccctgacttttgtgtcttccgttttttttagcctgtttgtgaaaattcacatttgatttgttcgtcttaaatagcttaatgaaaacttcattaaatcaaaatggtttaatatgattaattaattaattacatcgttggctttgttgtttttcattggagttaattggatttaatttttttaaaagtggagctcaatacctaatcaaaattccacccaaattcaattcctaatatcctaaattctccttaaaaatttcaaatattccagaaaagtctccagacttttcccttattcctttttccttcctttctctccctttaccacttctcttcttcttcttcttcttcttcttcttcttcttctcctcctcctcctcttcttcccttttctgttttcttccacctttttcctttggccatggagccaaagctacctctctccctttccagcccgtcccggggaggccaagccccgagcccgggcatcctaaataggcccaataccattcaaagcaatctcaaccatccaattcccttgatcgagtcctagcgatgggatctacgaaatcccatccatctcagccctagatctatccacatcatcaccatgtcatccatctcatccccacgtggcatccacatcagccggtccatcatacaccgagtccaccgtgagccataccactgactaatgggcccacatatattctctttcacaaaagtaattaaatttctgaaattaaatatccagagaatattattgggatattctttttcttatccaaagattttctccaaattcaaacttcaggaggtcacaacttttctgtccgaactccgattcaaccagtcttctttcttaattcttctaaaattgagatatacctcctggttacatttgttgttttgtttgatgttaattagttagtcttttctttttttttatttgtttctcgtttgtcatcatgtagacgttggaccaaaggtgttgttcgttgcagaagacgcagtgtagggacagtttttggatgcaaggcaagtgcactctttgaacgtattgaacctagtttataaaatattttgttttgaacatgcatgattttatttataacttcttgatgacctaatcgttataatatcccgtatttgattaatattgactcactatgatacctctatcttgggctcaactcaagatagagtagctatgcttagccactctctaggttgttttataagcaaaatctaattttgattaatcatatacttatagttatttttatatgaactatgtgattgtgtgatatcttcccgttttatgtgttgcgccgtgtaataaacaataggtggataaaatgatttggactaggctgatgggtggttctgtgtgtgaacctagttaggtgatgatgtatatgtgtgatcattatcaagtatggtccctgtgtgagtctactatcaagctatgtgctatttagttgctcaaagggtcaacttcgtgttcttaagccgttaccttatattgtgtgctattatagttttggcaagttgtcttgtcaatttaggacttcacttcataagccattaatccgagcctaacatgcaaccacattgttctcatggaaagaaactggctcaataagattccgagtcttggcactgtctgcccaggtggctagatgataggcgttaatgttagacataggtacttttttgtctgtgtgagggaaactgtctcatgggggaaggtagtgttaagacggagtttcttgttccagactccacacacaacctgaacatagttttccaatgcggccttcgccttgctgtggaaagagctcatgtcagcccagaagcgcttggtagcaccagggaactggtcaatggtgcgttagccaccagccccaaacgtaccagctccgatggcatcccaagcgacggtggaggttcctgtaacagcgactcgatgacggaacgcacatcctctcgggagaatctgcgagactccctcggcagcatagcacgagcacgctcagacacgaggaaatcaagtagtccatcagcgctcgggtgctgagccgcgatggccatcacgctgtacagctccaagcgcttattagccataacatccatcaagcggcacagctcggagtcagacagcattctagttcttggttcaggagtgcttgctgcagtacgctcatggcagtggcaaagtccccgttggcgtagaggaggcaccggatggcttggagttcagagaggttgtagtccccggcaaaggcaatgaggccagcgacgaggccagcaacggaatagcgctcagcacggaccagcgcccacctgccaatcatgtccaagtctaggtgctgctccttggggaccgggaacgcggcatcgtaccagatggtgttgaggatgatgttggagacggggtcgagtgggccgtagcagtggccggccatgacaacgctgcggtggtaacggccgcggagaaggtgttgaggtaggagagcgagtgcctcgaggtagaagccgtggattttgtcgacgagcacgctttggagagacttggtgcatcgttcgagtgttctctcgtccttgacggtgacacctaatgaggcaagtggggagaaggcggcgagctcgggtggcaaccgtggagggacgagaaccaatatctgtcgttgagtacaaatttggtcattgctttcttttctaggagcaagtggcggagatgctcgacggctgagcaggtgagacgatccgccgtcctagagaggagatgggaggcgatcttgtacgccttggagaagagcgagagcatctccgaggccactctgctcgggtcgcggtgacccgcggcccccgcggcgcaccggagggcagtcctggcggtgcatgagccgatgtcgaacgcgcacgacatgcaacgttctgcctcgacgaggtggacagcggcgaggaggtccccctcagcggcgcacaggaagtttagcgcctctagtgtgggtaggtagcggaagcaggaggtcatgaaccccacgagggccttgagtgacccccgcgccttagtcttcaagcctcgccgcatctcaatctcatccacatctgcaccggaatcctcaccggtggtgaggtgcctgatggcgttggtgatgatgttggagacgggatccagggggccgaagcagaagccgccgtcaaggacggcgggcagcagctccggcttctcgtccacgggggaggcgctcaattgcagcgctgtagaacccaacgatgcgtcgtctcagcaccgatttgtcgcttccgcctccaccgccggcagagctcacatcgggcaccggccgatggggcgaactcgtttgctagccattggacggcggcgtctacaatggcggagtcaggatctcagtacgcttagggctcaaatcgaagtaatatccatgataattcatatgctgaagtacaaagtacagaaaaaataaaagagcaaaatcaaaactaattcaattaagagatatatatatatatatatatcaatggaaaaactcgtgtctatcacttcttaccatcttcgcaataaggctaccaaggtcagagcagcttgagaaatccaaatcagatctcccgtcacagataaatgtgtcagttggtctctaatgactgtacaatcatatttagaaaagtgacataaatcttagcaagttcaataagcttatcttcatcataattggcgaaagaattccctagatcaaggcaaacaatgcatctcaatagctgagtaaacctttcagcacgatggtttaaatcaacaataatttgatcaagtaccacattaaatatttcattgctgaaatgatcaacctgttaacatggacccaacaacaaatactcccttgtagcagcatccctaatgtttacatccaattgttcgattggagtgagaatcccagggtcagcaacaatcacatttggagcaagcacaacattattttgccaattgttactagcctcggttcctgctgtttctaggggttggatggactcactgcaccggacttggtagaaaataatggtattaatgttcaggtcctcttcatctaggaaatcaaacaaatttctaattgactaattgctatgaaatgcagaataagaatgcaggtcgaaggttagagaggagactcacctggatttgaggaatcaggctcttctggctgctgccgtcggcccatcgccggctcgatgccaatgcgcgccaccgccgcccccttccaccgatgtgatcgatgctgcgagaggagagggaaggacgaggcagcgtgatgcaacgctcgtgtgaatggtggtgcgtgaatcgtgataggcggcagggggagaggagaggatgtgggagacaaagtgttggcttctgggctgtgacctatgatgggctgctcggccatgggtgtttgcgaaagtaataagttcatttcaggtctctcaatttatcaccgagtttgaaatttggtcccttcactacaaggtataacacatctcgcaacatacaaaacctggtcacatttagttccaaggtagtattactctctattttggctgacgtggtggctgaatcagtgtgaaacccatatgtcagggcgttttggtctttaaaaacaaataaaatttggtcgatcccatgtcagtgacacaacctctccttctcctccctctgtttcaacgttctccaacccggaggacacatgctgccgacgagacgggcggtgaccagactccctccaacccgaagctccacaccgcaccggccatgaaccacaagggagccaccgcctccaccagcgccactgccgccaattattattgctcgcactccatcggcgtcgctgccaacgcatctcggataagatcgatgctgcctcctccccctctccaccaggggaaacacaagcgaggccaactccgacgtggtgctcctcttggagcgtgtaaagccgacccactacaggggcataacattctgaaaattcctgacaataaaaatcactaaaatttcgaacattttaatacttttgcatcatgttggttgttaagattgcgattgcctaccaaaccatgaattgtcaaaatgaggaatcaaattaaagatatactcccagcaataattatgacttacaattatatttattattaatcatttgtgcacaagacatgaagccaaataaagtacaagttaattaataattcttgtgatacaaattacaaataaaatattaaatacttggattatgtgatgtgtgtcatgacatctaagtgcatatgaaataaccattcaaataagtggatctctatctatgaaatagtttcactaggaataattaatttgatattacatatattatatgagttccaaatattaaattataatgagctgtatagaggtcaaaccaatttaaaaaggacaacccatccacatgaaatgaaatgatgatcaccactataatgatcctatttgtaaatgagtatttcattggaatatgtaagttaatatttggaacatttcatcaagtcccttgtgacataaaatcaactcatgtaaaatagttggtcacactaataaattgagcaaatatatcactatatttataatggacttttggataaaatctagattttggacactaaatattaatttgggtagcttggtaaattttcatattaatgccttcatttttccattcttccttctcttctttttcttttctttttctaggcgcactgttcattatccgccatctgttcgagttggtcccccaccctagccgtgccgctccagccgctgtgcgaaccgcacacgtgcaaccatgcgccgcattgcgcccgaccaagccagcccgtccgcacccgcgcctctcccacgcccgcattgagccccgcgcccccgcaccgaatcgcgcgcgtgcatcgcgcttagccaagaccccgtgccgcgccaatgtcccgtcgtcctgccacaccacggccgccgtaccccaacccccctccagctcacctgccagctagggcatcttgccgaacgccctacccgacgccattatgccctctcgccccccctcctccctccccccccatttctaaccctctctggctcagcctcatccctctcaaccctctccctcactcgcaccctcctgtccctcccacttcacgcgagcaatcgccgggccgcgccgcacgcccggcgtcgagcacgtggagtgcgtgcgccgtgctgtcatcatgtgactccatcaaccgaagccggtggcggggtagggtggaggcatccacacgagctcgctgccactgaggaaggagaccgaagaccgttggattccaaggaccgcacgtcgaacacctccggcagccaccgtcgtcgttcgcccctgcgttgaccgcaccacaaccgtgcgccaccacccttcgctgttgctccacttcggggtaagccctcgcgccctgagcacctcctagtgacctagtagctggcggcctcctcaatttggggtgcgtgccaccgtggctatgccatccccggccgccaccatgccgccgttgagctcaccgtgggcaaggcatcccgggggctatcccctttccatctagttagcaaaaccgaaaccccagccgtcgtagatgctcccgcgcccatcaatttggccggagaccgtccctttcgccctagccacacggtagccttgatgttaccaaagatgatttttagtcccggttatttcaaccgggactaaaaatatccatcattagccttgattgagcatcccggttgcacaatcaggatgcaaaagggttgctaactgggactaatgtccctttccccagcggtgtattttgcttacgatgacagacctgatcagtgacgctcacccgttcatcatcaaccagaggcaatacatttgtgcatcaccatttaaatcatttatgcatgactcatacgtgctactggaatgatggtttgttgtttcacatatcagcagcaatgcacgggatgcacttcatgcaccggccacttcgaatcagcagctagcgacgtacgcaaaagtcttggttctccgttatttagtcccacatcggggagcctggcgcacgggcgcggggtcataagagcgacagtccggatgtgaggcgtgccgaaacgaagggcacacccggcggtaggcatatgtagcgatcccaaaaacaaatataaccggaagaaatcaagcccaccgcagttgcgacatgcgtgcgagcgtgtgacacatacgcttggcaaaaaactatcatttttttttctaaaactggcttgaccagaattatgagcgtccagtacagtctggtagcataccacgaaaaaaccatcattttttttctaaaactggtttgaccagaattatgagcgtcgagtacagtctggtagcataccaccagttggttttagtttgacttacagaatttgaattcgtagttcaaaactctgacacctaacataacgttttggctagcttagagtttggatccgtattgtcgtaactcgtaagaggatgtttggttggtgttacattttaatttggacctgtttagttcacaaacaaaattttttaacgctatcatatcgaatgtttggacacatatatggagtattaaatatagacagttctccaggaaattacgagatgaatcttttaaatgtaattacgtcatgatttaacaatgtggtgctacagtaaacatttgctaatgacgaattaattaggcttaataaattcgtctcacagtttcttcccgaaatctatagtttgttttattattagactatatttaatattttaaatgtatatctgtatatccgatgtggcatgcaggggcaaagttaaatcataacttggctaacatagagtttggatccgtattgtcgtaactcgtaagaggatgtttggttggtgttacattctaatttggacctgtttagttcacaaacaaaatttttcacgctatcatatcaaatgtttagacacatatatggagtattaaatatagacagttcaccaagaaattacgagatgaatcttttaaacgtaattgcgtcatgatttaacaatgtggtgctccagtaaacatttgctaatgacgaattaattaggcttaataaattcgtctcacagtttcttaccgaaatctataatttgttttgttattagactatatttaatattttaaatgtatgtccgtatatccgatgtgacatggaggggcaaagttttttttctaactaaacaagcccctggtcacacttgagatatgttttgagtagctgtgtcacatactctcggcatagtagaaaaaactggaccggacactgaaccgcttaagctcttggttcactgggtcaccggttggaccgataggtcgaacggttcaattgttgaaccggaaagtatatctatcatacataattttacttaaacaaggtgaccaacttagcttggtggtgtggttgatgctcttatagcccatcagccaaggatcaatccccattgtcgaagagtaatcctctctagcgggcggtcgtgagaccccccccctttgtgagttcggccgggggaaatggcgcgatgatcaagggtcaacttccgcttggccatctaatcactagatcacttgcgtggctgtgtgggagatcaaggattatacaggttcgggccgctctcgagcgtaataccctacttctgtgtgtgggattatggtgaattcttacaagaggttttgagctccagagggaaacctagctgtccttcctcccgagctcaagttgtctgagagtcgtcccttttttcggtagacaaggtcctccttttatagttcaaaaggataccacatgcaccgtttgcacctacccctccaagggaggggggcccacatggccctattcataccgctatcctttgcttcaaccggaagcaacatggtcgcctggcttcaagtggggcccggcgccgccccccgcctgacacgggagacatccctatcattccctattaattgtatgaagactttggcggctcaccacgcgcatgcggcgtccctggcagcgtgccgatgggacagggcatacccgcccccactccgcctgacacagggcagatcgtgggggcactgcccccgtcccgtcgcctgtgaccggtcacaggccggtcatgctcgattgacatgggtcaatcgagcggcgccgcacgtccctccacgccgcggttggggcgccgcgtattgaaggcgtggagcagcgcctttcgcctcgcccgctctccccgccacgtggtggtcaggcgagggcctcggggtagcacaccccgaaagcccgaggggtgcgacgtggcaccccaaggccccctggccacctcagcgctaaccgaggggcggggggaggcgaggtcgcatgggggccccccaaaactgnccactaagaatgcggaagaacacttccccttctactgtgcgtaccctcgggcccatttcaccgacacccatgtgacgcaccattttcccattttatggaataaaagggatcggtccccatgtgacgcaccatttttcctattttaaggaataaaaggtaattgggccacaataatccaagtgggcattagcgaaccggcagttcaatatagccttgttcatccggttcacaccggatcgattgcatgagcggtccttaaagcaaaccgaaccggtgggagtgctggttccggtttctttcggttggaccgccggtccggtccggttttttataccacgactcttagccatagaataactggaacgaacagtatatattcatctgccgtagaaacggataaacagagcagccacaagaaacacagagcggcaagaacagaatatatatatatatatatatatatatatatatatatatatgtatatatgtatatatatatatatatatatgtgcgccttggattattaatccgactcacataccaagtcaaccaaaaccaatcagcagcagcagctaatttaatttaatcgatcaacctccactactgtttcctagcgataaccacattactcctccggagcctcgtctccaggtactcgaccacgtcgccgacggccgggagcaccttcctggcggcgtcgagctcgccgaaccgctccgcccacgccgccagcagcggcgtcctggcggcgtcgagcaccctggtccccgtgagcgcctcgttcgccctcgtccgcgggatcaccgaccccagcgtgacgtcgacgagccccggggcgtcgccgccgaagaagggcttcccctccgcggcggcgagggccccctccagcgcccccaccgcggcggccatccgcgccatcccctccgccctctccccctccgtgctccccaggtacgccggcctccacgacgccacgaactcgtcgtcgacgtgggcggcccagaagcgggcggcggcgcgggcgagggggtcgtcggcgggggggaggagcggggcgccgccgccgccggggaaggggaaggcgtcgtcgatgtactcgaggatgacccgggactcgcagacggggcggccgcggtggatgaggacggggaccttggcgtggacggggttggcggcgaggaggaggtcggtcttgcggtcgaggtcgacggcgacgaggtcgtaggtgaggcctcgcagggcgagggcgagctccaccctggtgacgaacgggctagggttcgtgctgccgagcagcttcagctcgtgatccggtgatcctcctcctccggcggcggcggcggccatcgtcgtcgcgcctctgccgatcgagcgatcacgtgttgggcggattggatttttagttatagacgggtgctggatcgagatggttgttctggagtgggaagtccgcgggtggattgcgtcatccgtgatgtcaggacaggcgaatgtatcttccaatgcgtcactgtcgtcatcatcatcatcttacaggaatgctgcaatgcacgtggtgcattttggctttgtgcaatctccgtttgttatcttaaaatggttagaggttgaatggctctcaaaatggttaggggattgggcctctaggggtttgaaatcacaatgttctaacttctaaactgagggtgtgtttagttcacaccaaaattagaagtttggttgaaattagaacgatgtgatagaaaaattgaaagttcatgtgtctacaaaagttttgatgtgatgaaaaagttggaaatttgaagaaaaagtttggaactaaacaaggcatgagaactgagatttggaaagggaaaggtccattctacaacgttcaactcttaaaccgagtccaattagcatataaacggtgaaggaaaatgttcattttaacccctcatcctatcatcgagtttaaactatgtttttaaaccataataccaaatataatgcgtccctcatctttcaaaaacagtataaatatagtcccaagtagtaggcattttttttggccgcagacgtggcaccagaaacaaaaaccaataataaaatatcttacgagccccacatgcgggtgatacaatgttttcttcctcctctctcaccctctcccctctcttccccatctctgtccaggtctccagctcgtagaatggaccgggtggtggccggcaacaggcggggaggagatgggtgacggccccaacatctacgagctcgaccaccacgaggaggtccagcgacctccgctcccgcctcgccgccgcatagtggatgatgcattgctgaaatcagtacatcttggtcctagctaacgtgttcctctacataatggatgacacattgctgaaatctgaatcagtttgtgtactctgcataatgcaagtggagaacagattattcaatcacgaatacagtaatcacccaaaaaaatttgtaaaaccaatcaactggccgaaaatttgtttgaaacaaaaaatcaatcatcccaaattagttcctaactaggagaaaaccaaaataatcaaagattaagaaagcgcagtggcggttcacaggaaattcggagcaaaaaactgaatcatctgactgttcttgatgcaacgacgatgctacttgccttcaaattcatactactaaacgatttttcatgggctcatggcgccatccttttatttttacttacggattaaaaaacaagtgctttaaaaaatttatcacagggatttagggcacgagcagctagcaaaaatagattttcgctcgtggtcattaagcaaccgccaacgaaaattgagtatctaaagagctatctttgcaaaattattatcgccttactataaatgggccatggcccaccacccattacccacccgccggcatcaccttgacctaggagacgagcccctatagcttcggaaacagcgggtggtcgtcgacaaggatgtagttgcaggcgagcatcatgaacgcatcgttcaaatgttgacggtggttcttggaggacgagcaatgggagcggaggtccctgacctccccgcggcgatagagctcggtgaagttattgctgccggtcagctcttctccaccaaccgtcgcccttctaccaaccagcaaccgccccccgtcagttttgcacgccggagaactggagagatggggaagagagaggagaatgtgagagacgaggaagaagatgtttcatccccataaggttttttattatttgcttctacttctgatgccgtgtcagccaaaaccacctatacaatacttcctccgttccaaaaaaatcttaacatagacaaaacatgcccctcctaggttgagttatttttgggacggagggagtaccgccttgggactatatttgtaccggctttaaaaaatgaggggcatgttttgtctggtttcgtggttcaaggaaacttattcaaattcgacgtcaaggtgagagacctagagtaaacttattcaaacggtgaaagacacgtgaaagtccaagaaatacgaactgggccggcctgctaacacactcgcaggccctcttgcatcctttgcaagtacacagctacggcaatcgcgaaaccgccaccgcggtgtctcatcgtcctcgccgccgcctcgtcagtcgtcgccgccactgcgccaccccgccgcgcacggcaggtcgtcgctgtggcttggacggcgaactctctcgacgtttccaccgttctcgttcggggcctacgggccgagggggcttaggtagaatgaagccaatgcgcactcgggatcatggtgcggccgaggtgttcgacgaaatgcctccccggctggggtggggggggggggggggtcagtccgtcccagagcggcgcgttgcagcgacggagtgattcggggagacatccagggcgctgctgctccgccggtgccggtcccttgacgcccttgtcgcattcctgcgtgcctactacgcaccgtcctacctgtcggctgaggacgccatgcggatgatcgacgagcacgccgggatcccactctgctcatagctgcagctcatccttgcgctcagtacctcatcactgatttgatgctatgctgcccagtgccattgtccaaagcacctagtatgtagtacatgtttatctcctctaatcgatttcatccagtttagattatggagttggctgatctaatcaatgacagcgacttggttccatgttcttcctcttctcctgcaattaggtggctgctatggctgtgagattgaagggtttaatctggtgcaccctgacaccgaagatttctatgggcacctggctcaacatgaaggtgatgcctatttctgtaagagaattcctgctcaagagttcagcaatccattatatgaggattgtgtactctttgagccttgaacactaaatattgtgtagcttttcgtagataacttactctggtagggatcatgatgagattgacttctcttttggctattctgctctggttcgacattctgtacagattttagttctccctttgatttcacaatgtctgtcaatagcgtgtttaagatacagtgatctagcttagtagtagattcttgtaaaatatgcaaatataaatgacttggatgaataagaattatattgttcgtgtacattcgttgcaacatggtaatatgttcttattcatgttgttggttacttt

SEQ ID NO: 60669 - DNA, 1769 bp, Oryza sativa
ttggatttttagataatgaaatgaggattggatttttagataatgaaatgaggattggatgcctaacaaacactatgagactgcaagtttcttggagacaacttttactgctagcaattgtcaaaatgacattgacctatcttttggctgttttaggtcagtttggagatttataacctgaagtcatctgtattgtaggtgattgtaaatattgtagaagcccatgtagaggcacaaactactttatttttggcttttggaaatctaatttgaccttatggagaaagttaggccatccttagcttataatattgctattgtagtccaatgcatgttcaaaagtagcatcagtatactaaacagaacagatacttattctactgctttgtatttttcaggtaagatccaccttggactagtccatgctatatggctacaacaacgcaggcattgcagtagttctctgatagggaaaccaacttattagttctattctgttaatgttcttcagagttcaaataccttaatgaagagctttcttataaagagggagaatttttactattcattttgttattattcatgtcaactatggaggtgatgaggaaaatataccctggccaggatataggatgaacctgtcccacttttttatctttagtgtacctctccaaccactaccaaggctaacatggtggcctagtatatatcagaccaggaaatgggggaggagtgttctaaggaaatacacctagtacaggtaccaacaaaaatgtgttagtgggcccatatgtcagtgaaaggtgggttctatactttaaagggtgctaaacactagagggaagaacaaacttagtgtttgtactgtggcacttctttgcattggtacattgagtacaacattgtgcatgccatgtaagcccttttcaatgatcaaagcacacctcaagttcatttcattggaaaatgatcattaaatcttcagcatttaatttgtcaatatttttatcatgcatatctgtctttcatagttattgatgcatgtgtaactgattatgataacttgcaatctgtttagtttaaaaacttacaatttcttatgcacaagatgtttggcagggtgcgccaggctggtgagcacgcaagttaacaacacaactgctatattttcaaacatatctttcaggtaagtatctgtcagagtgcttagtgcttaattaattcacatgatgtagaattaattgaacgcctttttcttcttatatatgtgatcctttttttttgtaggcatcaactctgctgactgcctgatcagctctaccaaaatatggatctgcaaacgcaaatgtcatatgttggcagttcttttaaagaaaaacagatgtgcaggaaaattgtgagcaaactcgtaaggtaaatagcagtctctgcttctccggtaaatgtagttgattttctcatggaaatatggcaaaatgatgtttacattgttttacgctggaggtctagtctccagctttaataaaatcaaatggtgcattcttctaatgagatggattgttttccatctccagattcacatatactacattaagcttttagctcaatgctttctcgttcccaaactgtttatgcttttatgtatttcaccatatatactccaaatccttaagaaggtgattgtgttggggacccaatgaaggctttttgtgattctatgaagttttagtaatacacttggtacgaattataatgtagttcatgacata

SEQ ID NO: 60670 - DNA, 1190 bp, Oryza sativa
ctaggcgatttattacccaaggttgacaaagaacagatatcaagtaaacatggcacaagcgagcagataggtaatacccagatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacggattctacacgctggcacgcaaaatgaggaaaaactctaataaaaaccaaggaaacagtacataaaaactaaacaaacatgtagagctcaattttagatgaattttgcaagttgaacggctcaattcggagttcgaatgaattagatatgaattttagaagttttgagccatttaaatgaatttctagaattattaacgaattatgacgcaaatattatttatttttccaaaggaaaagagggttgctgacatcatcaaaggggaggggcggcgccggcaagcgggccctaccggtcagtggcacaagggcgccggtccaccgtggaccgggaccaccgaggcggtccaccgccggtccacgggaaccgacggcccggattggccccagccgatcggacggccacggggcgcgcggctggggcacggtcacggctcaaagccggccagccgagtgatggcgcacggcagcgcggccaccggcgacgacggccgacgacggcgcgggaagcggcagcgcatgcgggcggtggcggcgcacgctagggagcggcggcacgggctcctcgggaagacggcgcgatggagctccggcgacgggcgtcgctcatgaaggggcggacgggctcggcctcggtttgaggaaaatcaaggaggggctagggaggtgagaactggtgcgaggtaaatggaaacgactgccgaccacgacaatacgaggaggagctcaccggcgacgagggaggtggagctcgggcggatttccggcgaagagggccagtggccgaggatctccccgtccctgtggagccgagggaggcgacgacgcgggtcggcgaggaccgaagcggcgttgcgacgcggctggaggtggccatggtgagggagaaaggtggtgcgcctggcggcggcgttcccgaggcgaaatgggaaaatggagtagggaccggggt

SEQ ID NO: 60671 - DNA, 4571 bp, Oryza sativa
caaaccgcttgtctctccagaagaaagcacgtcaaccacaccctgcaatcattaaataacactatgatcaaataaccagtatgttgaatcatagatgggagacaatgtcaatagttgtggaaatatgttataccatttacctggtatagctcagcccgaatctttttttggttctcaggttttgagtaccaatcgagcctcatagactcgattttgatgtacatggcaacaacccattgttggaaaagtcgtcctccaaacaaaatgatgtttagaagtccccttctaaactgcagcctgaagcaatagtactccctcgctgtgacaaacttgtcctttttccctttgccagatttactactatcgtcattatcatcttcattgtctagataattgtcaacaacctcgttctctgcgtccaaacttacatattaatatacataaacaatgcataaggacataaagtttagaaattattcgataaaagccacgagtgtacgtacccggaagatcatcaaaagtgctttcttcgttggtacgtacatcacctaaagttgatgtctcacaatgttcatccatttccacatcacacggaatctggttgggatcgttgtatggcattttcaggttccactcagtctcccattagggttaaataaaggatacgctaaagggtcataacaaccatggtatacttggatgtaacagggcttatcaccttttgcatgtaccaagacatgtctatcaaaagttctcattggattatccccctctaaccaaattgcagcaacctgggatgcggtgggtgcattatatcttcgttgggatgcggtgggtgcattatatcttcgttggtcaggtgttacattagtgttgagctcaatcatgtagtcatctatattgggcatggatccaactctgctgaaggtttgtacgtacgggttttgcgccaaaatacatagaatgacccgaacaaggttgatatcaaggtcaggagacctgcgaaccctatgggctagtgcatcagcatcttttgtataataaaagtaaagctgcatatggcgcggcccttgagaacctggaaccaaattatccaggcgatggtacaacgcaccatgcacacgaaatgtatacacaccagttcctgctgcagtgctgacttgttggtcaagggtaactccaaggctcgtgaatgagaaatgggagttgaaataccgtatgtgctttctgaaatattttgcatcattatgcacttggctggtaaacaaccgtattaactcggcaaggatttttggaacatgtacatttattttctcttgcctgcaacagaatccaggagactcatactgaaaccttatcgcgtcgcaaaactgacaatcaggtactttctttaaaatgtggtgtgtcttgggcagttttttgtatacacggtcgtgtggatcattggcttcaatactattaacacccttaacatccacacgatatgactcgtacccatcatttatagaggaaaaatgtttggtattaaaatttgatgatgcatagataataaggataaagtgaacaatattggtaacttactttgctggaattgcatatctaactcatcaacattatctgcgatgtcatggatttctgcggtcacaccatgatctaattcacagtaggttattgtaaatgagatcaaatggttcatgggttaataaataataaaatgatatctcacaactcaccttcatcgacaaaatcaattagtggaggttcaaataatccactatcgaattcaacgtaagtgtcatctgggatatgcacttttgcatcttgcacatggatagtttcttcttgcgtaactccatctggtcagaaaaggtattatttattaaattatatgtaattataagaaatatcaggcacacttataaacaatacccgacacactcaaccgtgtttacctatggtaggggagtctttatcttcttcaatgatcactggtttcctcttgcattgtcgtttgtaggtaacatttctatgaagccagtccgttggatcatctatgttgccatttttattatcagtaacactcgatgcttgcaaaatggtagaatacgtagtcccaaatgatgaccctaggacaaaataattgttagaacaatatataaagatatagtgttgtttgtgatagtaaactttaccaataataggggtggttgcatcaaaatttgctaagatagcattgtttgactcagccttcttccttgcgcgatattcacgttgcttccggtttctatcttctctttgtttctcgcgcttttcgtctcgacagatgttgccaccatcactttgcatggaactggaaattgttaccggttgcattgggatgtttgataatacacttatgtcaacattgttcatctcatccatcttccatttgcgatattcatgttgttttctgttcctttcttctcgttgttcatttgacattttagttggctgggaattgccagtttcatgatttacagaaacacaagcagttggctccgttggttttgccggtgtgattgggttgtgagcatcttctataacggaattctttcttgcgcggtattcacgttgctttatgttcctttctgctatgtgtttgtcaggtattggcacttctgaaattaggagtatgttgtaattgacatatacatgtacatattacaaaagaaaactatataaacagatagttcaatgtaccatgatatggattatttgcttctacctttttccttgcacggtattcacgttttttgctgctagtttctcccttcttgttttctacctcattacaaggtgttgtttgccttacatttaatctgttagttatatctccgaatacaaagcggccttcgacaggtgatccatttgcatccatacctagtcagtaaattatgctattattgagtgcccttgcatgtatattaaataacacttatgataattaaaacattattttccaccgaaacaagaaagtaatggaaaacatcagccacgtgcaaggcattataatgacaaggtttatatatacacgtacgcacgtcacacacaagaaggacgcacatgaaatgaatagatatttttatcaaaaccgttgtaaaatgttatgcatgacatatgcaagaaaaaatatgtgtattgtatagaatatatcgtgagacaccaatagtgcctttggttcacataattattaaaatatttgggatgtcaattattttgtaggaataactatatcggtaaatagaaggtgtaaaagaataattaatatttgagggaacagagaatcaagagaataattacataataattagtggaaaatagcatgctgatgaaatcaaaactcattcagctaccatactgtctagtctcaattttttgccaaaaagaaaaaactaaaggcatttcatcacttctgctcctttctatacatgtttataattaaagctaccacaaaagaaatgctccatatatttacaaaatatgtccactcataattgttttcagtgttcatgtacgagggaataacagattaaatgtcacgcccggaatttctatccaaaattccaaacgcttacatgtgtgttaagccctcgtccaggaatcaaccgaggcacacaatgacaatattgataatagagtataaatatttaactatagaatattcgcaaataataaattattacagaggtggatagttcctctcaaagaaaaacattctacgcagcggaaaaaaaaaactataacaaactacggaacagctatggcaactccactccacaggcatcttaaccgagaacaagcctaatcctccagatcatcaccttcactgagaaactcctcttctgatgaatgaatattgcaagaatgagcatataacatactcaacaagccacacagcaaatatgcaagtgcacaagataacaaaggatggcataatatagttcatttgcagaaaacagcttttttaataatatttaagagaataataaaacagttgtataattgatcaatattaaataaacaccatacaacacacccgtgttgcataggcccaaccccatttgaacaaccaaccccagttgaacaaatgaaaccctccaaaccaggaattaaccattccaaaccaggaattaaattaattaacacattattaccattaatgagtagtgtgagactaatcacgaaaaacattgctcaactcacccataaccgcgggtacggctattcgaatagattaaactttgatcagagatgtaccactgtacccacaagacacaaccccacatcatgttaccatgtgcctcaataccaccacggtacctcggaaaggaattgtgacaatacccctcgcataacacaattcaccacagtgcacctttcctggatcataatcaccccctttaaaacaaggtatggactccccagcgacccccatggacttctcgccacttctcagtctggcacactataatgaatcatgctatacaaaagataaagccgttgcccacgctggcttgtggttggcacgataa

SEQ ID NO: 60672 - DNA, 1037 bp, Oryza sativa
ggataccgatagggggagagtgtgcctagacttcactcaatgtcagttcatttcgtatatagtacaaccacatgtgctagtatgggatagcccaagcttagtaaattattgatggtttagccttacattctggtaggccggtgtgtatcagttcggataactcaaaggaacttcatatttaccccgacgtggtagtttaggtgactaagtctttccaatacaacatggtgggttcccgttgtgtccgccaccacgttgttaagtttaaggcatgggcccgccacttaacggctcgaggtcatatttccagtatgactaggatggaggaacacatatcgtgctggtgtaaggctaaatcatgaattttggaaaagctttgttgtgagtaataaatcggatacttatgtatcgcatgccatgcttttgcatgattattatttcgcatcatgtgggtaaagtgtacaaactctacagagttaaaactaatcgattagccgtgctcgcggtcatgagcggcgtgtagatatgtattgagtatagacttgtatttattcttctaaatgctgaaatttaccattaaattatgttgaaatttgagaatgaactccttgctgccatgcatggcaatgaggtgtatatttatacatgattaatgactactttgatgcccaatatgtcaagtactagcttgctgaaatttttttgaaagcaaaatccgatttggaaatttttatgtaaataaaactcgctttatgctaaaaagatccatattatgccttccttgattatatgccttacatagttacatgtagagtgttaggcttgtcgtggtgcttgccagtatattatttctaataatgtactaactcttgctattggattaactatttgattgcaggtcttagacttagtcttttgagtgatgcgggtgatcgaatgcttcttctaggacttgaacttaatggggtaaacccctagtcggtgtgcttgaggattgggtagtcaagcttccgctgttctctgatatatttatttgg

SEQ ID NO: 60673 - DNA, 1554 bp, Oryza sativa
gatctagtttttgctagattgaggtggttggcgactctaggatcaccgcaaagcattaggtgctgcgatcgtggttgtcaacttgtcacaaaaagttgccaacacgattttttgacacctctttatagatttatcctgaaaaccttccgttttgcccacgagacgggtagttacctagaaatcggctttgctagccggtttagttatcaaaacccatcttggtctagtttttgctagattgaggtggttgatgactctaggatcaccgcaaggcattagcattaggtgctgcgatcgtggttgtcaacttgtcacaaaaagttgccaccacccactagagacaaaagaaacaccaaccaaacaattgagcaagaacaacatcatgcgaggtgatttggagattgacaaaaaaaaattaaggaagagcaaagggagatggggactgtgattttcgaggaggaaaagacggtgccactgtggcggagcacaagtgccggcgggatcgtcgggaatcacgcggtggctggccaaagttcttgccccgttcatgtcgtggttgctggccagcgagcaaagttgaaggagtcagatggaagggaagaagatgtggatggaggggtaatttcgtctaaaatggcattctagtgtttggtcactgtttaaaaatggaattttagcgaacacatctcccgaggatggcattttggtgaaacccaattctaataatggcataatcttaattttctagcctatggtggtctctctctctctggctcagaatcatgtagtatttgtgtttattgttgcttggttggactgtaggtcctggtgttctgacagcgccatcactttggatcttttgcctttcatcttccggtttctacttgccggccagcctagctatggaaaagtatggatttgttttactatggcagcttggctgttcactctaatcatgaggacggattgaacgcgttatacgacctcaatcgaagtaataactcttgtgagagatgtaatgttcattgttttcccttgcttttggtcatatactcaatgaccaggtggttgggttagaaagatacttgagaaaaaaatcgaagtttgtagacaaaatagaattggtgtgcaagctttagttgaaaatggtaaatgcaggctatagcatgggagaatttcaacttaatcattgtattttactttgactcactaaagagaagagaaggaacatttaataaataagtttgttcgcccggcgagaataaagaaatgtatttcattgttgtttcatttcatggaaggaagaagaacatcctgctatttacactggtggagaaaccatctttggtcggtcggacagatttcacaatagtcctggttgtattaaaaaccgggactaaaaatatctttagtcccggtttaaaatctcagaggtacttttttgatctttattcccggttggtgttaccaaccgggactaaaaatctatttatagtcccgattggtgttacaaaccgggaaaaaagatcgacatacactttactctcggttggt

SEQ ID NO: 60674 - DNA, 1217 bp, Oryza sativa
  unsure (1)..(1217): unsure at all n locations
gcaagatgaactgcgatctagtgatgataatttgctaagagaaaaaaggctgatggaagagcttcagtctaccctcgcaagtctgacgtcacaacttggtcacaaggatcaggccctgctttcctttgatgagcacaaaacggagttaaatcgtctgagggaccaagttttggacatggaaagggcaaacagtttgatgcaagatgctctttcacaaagtgaacaaatccagatggatctcaattgtaaaaatatctcactccagtcccagctttccaatgttgaagaccggttagcaacagttatgaaggatacagtcgccactgaaactgaagctagttatatgagaaatctggttgaggagcttactgggcaacttgattccttgagaaatgaccatgaaaaactccagcttaagaacaaagatgctgatgatttactaagggtacacatgtcaactgaagcagaattagctgatagagttgctgcactcgaagcagctatccattctttagaaattgaccttgctagggtcaatgaagagaaggaagaaactgagngagctataaaaagtaacgaagaacaatttgttcaagttggtcccgacaagtctcgatatatagtagaatcaattgatagcagtgagagagttttgaagtatcaagatgacattttgcagcttaaagtcttactgacaaatcttgaagagcaagttgatgatctgaggttcacaaaagatgaggttgaaattctaaacatggttctagaatcaaaattggaggcacaacgtactgaaatattgtcattgctccagaactctggacacgaaagagtgtcatttgggccccaaacttttttaaaagacactagaaccaaggatcttactcaaaaacttgctgaacaaactctgaaggcagaagagttcaagaatttgtctatccatttgagagagctaaaagagaaggctgaagctggaaggaaggagaaagagggatcattgtttgccatgcaagaatccctcagaattgcattcattaaagagcagtacgaaacaaaggttcaagaactgaaaggtcaggtgtttgtttccaaaaagtatgctgaagagatgttactgaagctacaaagtgctttggatgaggttgaaactgggcggaaaaatgagattgctcttgctaaaagaattgaagagctatcaatgagaatttctgaaatgg

SEQ ID NO: 60675 - DNA, 1153 bp, Oryza sativa
gggcggccgatctccactagtggatccccttgaaaactcttgtgacaaggtctggtcgatcttgaggttgctggccgggttcgagatgttctgttatctgtcacgcccagaaatttaacccaaatttccagactattttgcgtattaaatccctgtccaggaccagccagggtacacaaaacgataagtaatatacagttccaaacgtaaataaagcgtaaaatacttacggaagaggcacttagtcctcacaccgaaacagaacgacagcagcggaaaaaggtgatcctagcggggcttcagctccactccacaggcaaaactcaactggggtctgagccttggtcctctaactccatcttcagctcagaagcactacacctctgaaaagggggaataatagcaagactgagtacaaccaccgtactcagcaagccacaccaacgatgcagacgtgcaaggggatacaaggaggggtttgaggctatttgcataaaggcagttgtaaaacattttattgagcaaaacagtaaaactgttgagtaattaaagtaatattgaatctccactgatcaacgctacaccacgttgaacaggcccaaccaacccacctgaactacagtgtattgagtcgatttattaaggtgggactaatcatggtgaatctggtcaaccgcccataaccgcgggcacggctattcgaatagctttactctgatcagaggtgtacaactgtacccacaagacacagccccacggcacatttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccaaggcatcccgcgaaccggtccttaattgcctgggtgcgactagcaaaaccatgcacccacagcccaccattcagtcgcattttagttggataattac

SEQ ID NO: 60676 - DNA, 2440 bp, Oryza sativa
tttcacatgcatgaatcttttgaacacctagagagaatggacatatcaatttcttcgcttgatatgtgttcctcggcagcaggtgatgcggacatcactacctcggatacacacaacaatcctccaacggtcattcaaggaccaataacaagagctcgtgcacgacaattgaatttagaggtgagctcgatcctatgttcttctttgtatgaattcgagaatagattgctacctaatgattatattgtgattaggaacaatgaagggggcaaggagacacttggagaaggacttagagccatggaggatcatcgaggatgtccaagtcaaggtggaggcccaaaccaagtcgaccttcgggtgcaattcggagtccaggaccagtctgcactaaaacgggcgcccaggtcgcatacgtgctaggattggggcgttctttatatggatggaaacctaagaagataacttttccaatggttttggtcccacgtccaaattctttccgagtcaatgggaatcgaccaaacaagttgacattcagaatctgtcccgttgttgcgtcaccgtatttgggcctttgggccgtgtatcgtgtggaacccattagggttgcgtcgagagggggttgcacgaccctaaactctatatattagtaccgccgccatctttaggtttttgggttttgcttagattattccgtcgagaatagtttcgccgctagatcgatttgtaagaccccaactcgtgagcttaatcattcatctgcaattttggttattttctatctcgttcttgtttgtgttcttcgattggcaaatagggattagccttctcggcgaggtcatccgcgtttctacacgggtgataaccagaggagacatggtgctgcgattgcggggctcaagagcgtgcgtgttcaagaagccggatcgatttgtgtcgtgactccgcccaaatcattgtttatcagaacctttcagaagatcgggaaccctagtgcacatcagcaggttcggtttaggaagcataactctcagaagatccatcaaatcattgaagctagtgtccgaccatccatgtctggccttcaatttgagaagttcaagcacaaagcacaacaccgtataatccttgtcacatcctttcgattcgtcgtaaagaagttccttcgctgctttttccaactcttcccaattgttgaaccctcgtcttgtactagttagaacctctggttcaacgtgctgcaacatatcctctagatcaaaatcaatacctgcatcatctataccaaagccaccacattccgggatcgttccctgtgacatgtcttcgattataaaattttctgccgcatcaaagcaaaaatcatcagcctcttcgttacgatcggtgacttctccatgcaaagtccatatcttgtaatcatccataaacccacgctctacaatgtgccccaaaatatcattcgggttttgcatcatctttttcgttcttgcaatcaaagaatggacaaaaaatgtcccttctattctccctcaaagcatgtgcctttgcctgatcaacaaatttatttggatgcttccttcaagaacgccggatgagttcttttttgtcgtacatctatgcccgatccatctaccaaaaaacatctttcatgagtcgaattatactatatttaacatatgaaaaaaggatacaacttaaacagacattatattaatattcatggtctagtggttccaataacattaaattaataaattaaaaattacttagaattactagatttgcaaacctaatatatttttcgaagtccactgaaaaaatttgaaataaatggagggaactaaacaaaaattaaatttaagttctacggaaaatttaaacatgcatacgatatttttaatcattaataaaaagaatgtccatttccagaaatgaaaattttcttagcttttatccgatgacaaattaaactaatggagacaaacctaaaaaagaatcggactactaaatactttaaaaatcatgtgatacaaacaatatatatatttacctattataaaagtttaagatgtttttgctggtaaatttcgtatgtcaccttgtccgactgcgtcccgtacgatttttttttgtccatggtcacgttgtccgtttcgctgccctccgcatccgattgcaattcccgcattccacgctgcgcaccgcgtccgggccatgcgctagccttgacgcatgcacgtgcgcacaaccctgacgcatgcacgtatgccctccagttcccgtgaaagcaagactgtttctgagttttatgttcacacacaactttaatttttatagcacctacctaagattcttctgttcctatataatttcaatttttaagacatgtaccctaaagttattctcttatgtttgtgcatgatttttagagaac

SEQ ID NO: 60677 - DNA, 5571 bp, Oryza sativa
aaacttttatatatgtgtttttagttacttaaaagccaatgctgaaaaagaaactacgttgaaaatatctcaaaatcaatctcaaaattaagtttgaaaatttaaattttggcttattctttggttgtttaggctatccgatgggagccgtataagaaatctatgtaaaaaaactcgcatgctaacttgatatgattttctagagaaatatatatctaagcgaattctcacagtgaattcactactagaatagtgaatgtcaacgaccaaaaactaacgacggctgcataatcttggtcgttgatactgctttgggccgatttctggtatccgacgacgctagttttttgtggtcgctaatgtgtagtgggctgcggtcgttgttgttatttactcaggttggatgggcaattgcaaatggtcgttattactcagcgacctgtgtcctcagctctccggccactgcagccgccgccgcactcggcttcggccaccgccgccgccgctgccctcggcttcggccaccgccttcgattcgctccacagctgcaagcctgcagctgctgcccatgctccctataactttgctctttgctgctctttgccatacaaaggaggtagcggcacagcgggaggaagaatccccatcattggcataggaacagtctatcagatcccctccaatccgctgctcccttccaaatccgaaatcccctcttttccccaaacatatttcgccccaaatcaatatgaatcaacagtttttgattccaaatccgagatcccctctgctacccccacatatttcgccccaaatcagtataaatcatgaggttgagagatgagagaagtgttgattcaccgccatgtctcgtagccgcagtttatcaccggaggtgacaactaggggctgcatcgaatggcctacatggtctcctcagggctcccaaatgtcaatccttcccaccaatgaacatcttgatgccaagctccaccatgagtacatctctccacctgatctgcccagccactctgttatttgttccagttcacttgggactcatcaatcgacgaaaatagtcacaacaggtattcttcaatctcctaatgtaaacatttgcatatgatttgtgaaacatattgaattatgtgctaggttaaatgttaaatcttgccaggttaaagtgttggttgtattgtccacttcgaaactaataaaagctgcaaagtttgctaggtggatactgattatttctatgctgccctcaacctgaaatgtttgatatggtcctgacaatttattgttgtggtagctatggcactttcattagcattaggctgtgtttagttggatccaaagtttggattttggttgaaattggagatgatgtgactgaaaagttgtgtgtgtatgacatgttgatgtgatggaaaaggactgaagtttggatccaaattttggatctaaacacagccttagtaatagaggaatgtaggcaatttgtttgtttgtaggcaagaacagcaagtgttctagctttattcatagaatgaattcataattatattttataaacagaaacattaggtgtgacttctgtgcaattaacaattatagttacatgtgcattagttcttcctaatttgacatatattcttctcctagactgtttttcatgatggtactactagtttgttgattttaattgtaatttgaaataattatagtatcagcagtgctttacttaaatggtgtacatctcttgttttcacctctgctataatgctagcaatacaagttatttctatttacttaaaattgagttctgcatccagctaactctatacatacttcaattgaagggtctgaagaccatagcttctccttggattcagttgggtccaaagaccatagctactcctttgtttcagttgttgaggacactatgggtgatgctgtcgaggacaagatgtaccaagttgtaaatgaagatgaaccaaaggaattacttagagactccaaggttaatttgatggcaaacgttgttgaagacaccatgaaagagaaagagattaatgaagatgaccatatgggttggtactccttagcttcagttgttgaggacaccatggatcagcaagtgggagcagacatcatggaccagcaggttgtagaagactccttggtaacagacaccatggaagagagtgatgaagatgaatacttgaaggcagaatatgaaaagggtgcattaatcttcgctagagatgaggcaaatgcgttggaaagaaaagaagctgaagctcgttatgaaaaatcacttgaagagattagagatgaatttttgaaaatttatgtccctttgtattttactctaagaaaaaagtaaattcagttagatagataatatataaattcgatcagcatccagttcatggccagttatttgttagcaaagaataactcatgcatctgtgactctgctatcactttagtatcttcaatgaagactatatattgtcttattgtggggtctgacttgattgatctatgttcactgtgtgcattcttgtttcagtttatagtatcattctctgcagcagtaagatagtactttgctggacaatatatagtctgaaagtttcacttcaactggaactttaagttatgctagacaccacagggactgggactctaccaatgatttgtttgttctatcccttttaaactttgtatccattgtacagtgcaatatgatttgttcaacaaagttgtaaagtattcaagtacaggtctagatgaagggtgctcgatttgttcaaggaagttgtacatgatttaagtgcagcctgtacactgctatgtgtatttcaagggtatgctaatgctgtaagcctgtaaatctgtaagcataacatcgaaatatttttgtacatgagctatgctttacagctcagaaaatgcatcttaccttttttttctgctctaaacatgatgtgttcgattttctggtcgtccttttatttcagttagtatatgtataaagtagcaatacaataaaataaacatcaaactagcttttcccagttggatattgtgttgtaccttaagttagaaaggtgctggtgctgggtttgagtcccctgaacaaaagtttttctaatgattttactttcttttccatacgttttttttttaaaaaaatacatctactatatgttccaaaatcattctatgtgaacaagatatttttttattaattacaatgttaacaccaaatttagtatagtttatggatttgtcgctatcctgcgtatctttgttcttgggttaagaggtttagacaaccaatccaacactgtcgtctagttataaaaatgtactctttagtataaggtcataaccgatccaacaccatcgggtgtatattcggcatagttcatcaaggcattaggtgttagaggatcgaccgttcaaactagttatcatagtagaagaaaacaaccattatatttctttcaaaaaagacaataaaatatatgccgtgaaatatattgtactaaaatagtgtatattgtaaatgaattttaaggtaaaaaagaacagagaaaatgtattgtccgattatgacaaaaatgagtatagttacaaagtttactccttcgtacaaggtcataaccgatctaacgccatcgggtatatcggcatagttcaagaagccattaggtgttagaggattgactgttccaacaagattattacaatagaagaagacaaccattatatatagtgcataaaactttgaataaacacaataaaatatattgtactaaaataatatatattgtaaatgaattttgagttaaaaagaacagagaaaatgtgttgtgagattatgaaaaaaatgagtctaaaaaaattattagtacaatttcacatcagggacattaaagaaaataagttgtggctttttaaaaaaatttcagatgaatggaaaaaattatggcgggtgattacataccttttttattttttttggcgctcaaaggaggagttttaggcatatgtccatgtacatatctcctcctccattcataatagacccaatatcttctcccctctcacatcccctccctcactagattgagagaaccacggatggagcgctaatcattggtgccgatcggctgatcctctacttctccagcgcggcaccgtgccgcgtggcctcatcgcgctactgatccggtggttcccgtccgagtgcttcttcaatcaaaccctagaaagttctactacaggtcactacttctccctttgcattgaaatcatgtcgtttctgatctggtgcctgtcctctatccttaatcaatccatgatgtttggattctatccttaatcaatctgttgcatgtccgcatttgttagacatttctgaattgttgttttttgaatcaaacatattttatagcgctgggctgtcactttttttgtgtatgaattatttcatctatagtcaactaaaaacagaatgcagtgcaattaatcatattgccaaataataatttatatgatatctatctagtcttgacattttacctaacagtgtatcgtaactctcctttgacattaattatatatacagggtcatataaaacttaatatcaactagcaattagaggggatggctccaagcaaggcacggatgggccttgtggacgatcggctaaatcacgagtacttagagggtgtagagaagttcatagattatgcattcagtaaattagatggtgtccaggttatacgttgcccatgcatcaagtgctgcaatacatattctttgcctcatcacatagtgtcttctcacctgaaagcgtatggaatactgaggagctacacattttggtaccatcatggtgaagtcttagcagaacaagagaatgacatagaagttgatgagtatgattcacaggaatttaatggggaaggatataatggaatgcaagacctgatggaagatttatttcctcagtgcaacacccctggtggagacgaagcgacacatgaatctactgatcagggacctgaagaggagccaaacactgatgcggccaagttctatgctttgcttgacaaatacaaccaaccactgtatgaagggtccagaatctctaaattatctgccttagttaatttgcttcatgttaagaatttggggaaatggagtaataagtccttcaccgcattgttggaattgctgcgcaaggactttctacctcatgactctacactgccaaattcttattatgaagcaaaaaaaactattcgtgaactaggactaagttacataaaaattgatgcttgcaagaatgattgcatgctgtactggaaagaagatatagatgctgaatcctgcaaggtatgtggatcatctaggtggaaagaaaaacacacacgggaaattaagcactcttcagctgggaagaagattccacataaaactatgcggtactttcctataaaacctagattgcagaggttatttatgtgtaggaaaacggccgcatggg

SEQ ID NO: 60678 - DNA, 1276 bp, Oryza sativa
  unsure (1)..(1276): unsure at all n locations
gggagataactggaagaaaaggagcattttttttgagttaccatattttaaaactctattgctacgtcataatcttgatgtgatgcatatagaaaaaaatatatgtgatagcattattggaacactaatgaatgttccaaagggaagaccaaggacaatattaatacccgtagtgacttaaaactcatgaacctgaggccagacttgcatccagtagatgatggaggaaaggtggttttgccacctgcgccttacacgttatctccagatcaaaaaaaagcactgcttagtttttttaaagaattgaaagttcctgatggattttcttcaaatataagtcgttgcgttaatatgaaagagcggaaaatgtcaggattgaagagccacgactgtcatgttattttaaatcatatactccctcttgctctgcgtggactgctccctgaaaatatttatgaaccacttgtggagctatcccagttctttaagaaattaaattcgaaggcattgtcagttgaacagcttgaagaaatggatgctcaaataccagtaattctttgtaagcttgaaaaggaatttccaccatccttctttgatgtcatgatgcatttgcctgttcatttggctagagaagctctaattggtggaccaaccatgtatcgatggatgtatttatttgagagacaaattcactacctaaaatcactagttcggaatatggctcgcccagagggttcaattgctgagggatacattgcagatgagtttatgacattaagctctaggtacttggatgatgtcgagacaaaacacaatcgtccaggaagaatacatgacacatctattggtaacaaatttaatttatcaatcttctcctgtgctggaaggccgaattttttggggggtttcttcggtaaaacnntcgcagatccttgatatgcttgaatcagaacaagctcatatttatattctgcggaattgcgatgaagtccaagcatatatcaggtatcccttgataaaaatggcatttatttatgtcatgtttcttacgattcatttcacaagcttatgtaatttctaatttaaaatgttgcagtgagtactgcaacagtacagagggttcttcaatggtacaatttacctcaacatggaacaaaaaattcatcaactggtttaaagagaaggtaatatttatataattacatatatggaataaactgtttcaaatatgtatatttgttgatgttattttttttaatctttttgccctgtagat

SEQ ID NO: 60679 - DNA, 705 bp, Oryza sativa
tcagtttgtcagaatcttgtctaaaattcccagttaagttccaggattatatttaatcagcaaagaatgtgatacaaactaatcagttctacctaatctttttgtatttgagtgttacctaaattcagaagttgttgttagtgctaaagctaaactcatagatcaatttttccccctctatgattgggaaattattctcgcaggtatctcatcgtaattgatgatataagggtagaacagtggtgtaatatggagcctgctttccctgccgatcatggtatcagcagcagaatagtggtgaccacgagtattcaatcaattgccaatgcatgcagcatcccaaaaggctacatctacaaaatggaaaaactagatgctgaatgctccaaaaacctgttcttcagaagcgcctctatcgaggaatgctcacctgacatagagagaggttcagaatcacttcggaagaaatgtgatggcctcccactggctctgatctgcgtaggccagttcttgcgcacagaaggagctctaacagggcatgcaattacatctgcagcaaactactccttccgtccaaaaaaaaaaaaaaaaaaacaaaccctgggttttcatgtccaactttgactatccgttttatatgaaatttttttataattcgtattttcattgttgttagatgataaaatatgattaatattttatgcg

SEQ ID NO: 60680 - DNA, 720 bp, Oryza sativa
gattccggcctccgtacggtccataacagtttgtccggaatgggattctggcccacccttcgtaaggtctggacgggattacggcctgcgtgcggtccacataagttgctccgttatcaaaactagtaatatgcccgtgctaaacgctacggtgtatgtctttaataatttttagaatttcatgttagaaaaagtttatatgatctatgcatttgaactttaattcaattcatatcctacataaaatatatttcatgtaaagtgcagtactatgatattgcgcgggcacaataaaactttacaagataaggcctacatgtaagtgataggagaaaaactaaaaagcgtagggcccacttgtctgccctattctccctctctgtctttccccccaaaaaaacagcagagcaagcagcggcgacagcgatggtgatggtgatggtagtggtgcaggctatatgcggtggatggcgatggcggtggtgcgggctatctgcggtgcattatccatttaagttgtatgatgaaccatatagaaaaataataatccagaacaattttgtaagcatatgtatccctttatataatacaaaccatatttacaatctcaaatgacagcctggtgaaaactgacgcatctagtgtgagatagtatgtagaagataatcacacggcattccatataaaaggtgatggcgtgctgtaccaaacaagaggtcg

SEQ ID NO: 60681 - DNA, 3530 bp, Oryza sativa
  unsure (1)..(3530): unsure at all n locations
aagccaagattaggagtgtgaactaaatatcttagaattctcttgacggcaatcaaatggcactctttaggctccgcttgaaaacgggcacacatgcaaacactaagcatgatgtcgagacgagatgcacataagtaaagtaaagatcctatcatggagcgatataccttttggtccacacatttaccattatcgtcgaggtctaggtgtccattagtaggcatgggcatcttgataggtttggcatcctccatcccaaacttcttgagtatgtctttcacgtacttggtttgagagataaaggtgccctctagtgcttgcttcacttgtagcccgaagaagaaggtcaactcgcccatcatagacatctcgaaccttttagtcatgatactactaaattcttcacaaaaagaggcattagtagaaccaaatattatgtcatcgacataaatttggcatatgaataaatcactcttaaatttttttagtgaagagagtagtatctgcctttccaatttcaaaaccatttttcaaaagaaaatctcggagacattcataccaagctctaggggcttgtttgagcccgtagagcgccttgtggagcttgtacacatggtttgccaactttggatcctcgaaccccggactttgattttgtactttttgaggggtctccaagcatccatctttcacaccttggactaatgcacctgaaagctactcaatgagctcattagacccttaaccacatttgtcattaatcaccaaaacccactaggaggattaatgcactttcacccatgaccccctgggaaacagtattggtgttgtctgaaagctgcttctcaatgttttcttgtccagaaactgggttcacctcaatgcctgcaattttcatcgcacggggagctattctaaacaattctctagaaattctatataatggacaatatataaatttttgaatacgaagtttttggcctgtttaggggagcttaagattctgataagtagctggttggtagcagcttctgagaatctggaaaagctaggttttccaacttctgacttctagttcattatctggattctacaactacagcttctcaaaatttggaccaaaagctggactgtttgggggagcttttaattatgggagaagctgcagcagctagaagctccccaaacatgcccaaatgtgtgttctggtagaaaagtttggctgttttgagaaaagagttcaataaccgatctttttggagaaacaactgtacaatactaattgtggtgaaagcttgacaaacatatttatacttgagtttgctatgtatatccctgattgtgagttcatcacttttcctcaccagtaatatatccgtgctaatacaacagatacgatcaatattgtaaatgagcaaccacaaagttggtcatatgtaatacattgaagccgtgaactccagcattccagcataatataatcagttcgagtgcaaaggtaatcaccgaggagtacgatgtggccgattaagttcatctgatccatggacaatcgctatcaccatataaaccctctaatgtaatatcgtcttcttccctcatagatcaaatggcttcttgtggcgactattgtggagacgacaactttagtgtgtatcgaggctggtaaagttgttagaggtgtatattgaagctgattaatagaggcagtgcggagcagagttcaccaaaccgttttgggtggggttaccgtcaccccacggtttggtggttatcacggtaaccacgcggttaccgcgatgcataccgtgattttaaaaactgagaagcttactgcacgcgataaccatggtgatcgcacatttttgtaaaccttagcgtggagtagataggttgtggaatggagctccaccacaactaggaaaaagcgaatggagaatggtgtcgcaatagatatgtaaggtggaatatagaggacaggaggagaggtagatatgcaaattgaccgaaaggaatagcggtggatatgggatttgagagcaacaccttaaactagtataaggcaaactttcatacttttatatgtcattgatatgcgggacctacatgacgtgaaggaatctttgataagcgccatcattagacnttaaacgaaaacctctttaaccttccaanaaatttncccaactagattaacttgacaaggtaataagtgacatgaagtaaactcttggagacgaccttaaactaatcaattggatcctttataaaaataaggaaaaaaaatcaaataccccttataagtcacggtctttctaccctctccctacatcttacttttgtataaaacttcccctacaagttcaatttttcttccagtttctcaacttccattacttttcaatgatcttatcatcattggctcaatccctcgtgacgcgtgggcttctagcaagacgagatgaggttaccccatgtcacctctaaagggcacctatctccttaccaaccatgaatcgcactgcgctgtatatgtttcgaacaccaccattgtgttttgcatcgaggtttgccgccatgctcgcgggaggtaggtggaacccacccttgcaaaagatgacacgaggtaaatctattatttttccatgtcggttgcccactaaggcacgagaaattggaaaaaaacaagtgaaaactagcggcaagtggaaagcaagaagagatggatcaaacttgggggggaggggagtcttttgtccaaaagtgaattttataggggtatttggatttattttttatgagaaaataaaaactaatcgattggggaccacttgccagctccacgtcagcccccatccccgggcccacaacccgacaaagataaaccccatgacggagaggaatcaatcatcaagataacgaagagtcgaggagaagagcaaaaaagcaaaacagcaaagcgaggagagagatggcggcgaggcgaggtcgagggcgcgggcgcgagtgggaggacgacgacctcggcgtcggcggcgggcagcccccgcacctcgccgcgcccgtcgtctgcctcgcccgctccgccggggacctcgccgccggcgccttcgtcggctccctcgtcggatacggtctctctcttctcttcttgccatatcctctttgtttgttgatgacttgatatagtctaactagcggttagttttgagatgttagctcgagttttattataggaagaattctggctttgtttctttcttcttcttcttcttgtttttttttttgggggggggggggggattttttgggatgaacagcgaatctgttcttggtactgggggttaactgtagatggcatggaaaatgtacttctttttatattatctggaggttctagtgccgttgcctggacacggattctcaattgaaatggataaaagcttggaaatgacaatgcgagtttttttctttcccccaaagaacattgtcataggtctgttcttagtctatctgaaatgtcctgacaa

SEQ ID NO: 60682 - DNA, 1004 bp, Oryza sativa
acatatttgctcatatagtaaggctttggtctctttctatcaaacctttccatcatctagcagatcattttctcccgcaaggatacctctaaaacctgatttatcatcatcaagtagccattcagcttgcctggatactaattccaggagtactgtctgtaagtattcaatgtaacgggttggaagttaaattccaactgagcaggcaatgaatgcgtacatgataaaacaggcttgtgaagaaaacaagctaacaaatgcacagaagaaatgggaaaataaataaacctatcacaaacctttgacagttttgcctcagtccatggcttcaaatattctggatcctttcctcttcctcttgtatagattttatcacctgcagaacataaaactcatgacaaagaataagtggtatgctagattacagagaatattgcaaggacttaacgtagataccttgaccaaatatttagaacaagaaccacgggacacccaagcttgggcctttcttcagtaatgttctgctgtgtttttgaggaacacttcttcgaaaccttcataaacatccattccattaccacctctaccaagttcagcttagacactgagagtcatcttgatcaaattgcaatccataaccttccctgccctgtcctcctcaatctggtaaatcaatgcaccagcaccattgtaacatccttttatgcatcttggacaatcggtcagaaaacgaaacaagcaggaggaagatattaccatttcgatgatgatttgtcattttcttatttaactcttcgaaaacctacaaccaagggcagtaggcagcatgggtttagctgaaatcttttgcacagcagaatacaccgtgtaaacttcagaatatgcttcttaccacgttcttgaacaaattcagagcaatatccattataggtggaagtgacctctgattagtgaatgccaatcgcaagtacatgcagacggatttgagccatttcatcaacacc

SEQ ID NO: 60683 - DNA, 2533 bp, Oryza sativa
aacagattaacagatatcgatcgatgcaactgagaatacttcacacattgattaggtgcgcagaataaaaattgatgataatcgcgggggcagggggaaccggaaaaggcggcacatacctgataaacgatgtgatgcctgattgtcttatcccaccgatcatacatctccgcggcgtgaccggcaggactctcgtaacacagtttatatgtgatcctacgccgcggaagacgccccatgtcaatgtgtgttagattaaaccccaaagagaacagaaaaaagcaaaaggaagtcgagaagaacagcgttccatactggagaagctcactgtactcggcacccgagaaggatagcctttcctccccgtcgagaatgcgcaacagtttctggaacccggccgctagccggcgccagccgtcctcgatgtccatcggaggcggccgcgctatcgccgtccttgtcattgatccgagagaatgaaacctaggcagccgcgaaggaggggagagtgtcgtgggattggggatttgggcttggggattgtgtcaatatggggtaaaggagagttgtaaaattggaacttggaactggagatggtgcttgatattgctcgtgcacagcgagtgactgaacaaagccagctgtctagagcaaactcaccgctttcgtgggctgaatgcgcggacaaatcactcacgggcccgaatccccacatctcgggctgtggtcggaaactcggaatctgaggacttgtgcacttttcttaactcgccgttacaacttcgtttttcattcgcatattatttaaattattaaatgatgttttctttaattttactatatattttagatctattttaaaattttataataattaacacttaattattgggactctctgtatagcgaatccctaattattaatgtgctagtattttactttattctacgtgcaactaaaaagttaaatctaagtcggagattccaacagatcgcccaatacgtcaactgatgaacattgatgtatgaaatactaatgggctatatctgtaggctgtagccaaacattctttttgtgccccaagggttctagggctgttctcgatcgaagaacttgtagaaattaattattagtagtactatctcaatttcatattataattactccctccgtttcacaatgtaaatcatttaatctagacatatatatatatctatctagatttattaacatcaatatgaatctagaaaatactagaatgatttatattgtgaaacggataaagtagttttgacttttcttaagtcaaacttttttttagatttgatcaaatttataaaaaaaatatagcaatatttttagaaaaaatatgttcaatattaaatgtaatgaaactaatttggtgctataactgtttttatatttttctataataaatttgattaaactttgaagtagtttgacttaaaaaaagtcgaaacaaagtacaaatttcaacgaccgagatcatcaattacgccggataaccctattgccttcatggtatttctctgagactatgacctcgtttagggaaagctgaagataagaagtttctccatggctccgttctaagaagcagctgatgaatagagccagttggtgacaatccaaacatctggaaacagctgatgagtatctaaaaatctaggtttcaattagctagtgctaatctcactgtctgcatcatatagcaatgcggctgacagagtgagaatctaccttatcaaagagggctagagattatgagtgtcaaaagctttctaaacagttcctatgcagctatgcttctttcccatacttcaaattctagtcaaatagacctttccaacttcaaaaaatctaaattcatccaaggcaagaggggaaaccaaacaaaatcctacccaaaagtaaaatcgaaaatactagaagaggacagtgaccctttatggaaactccgtgcattgctatgaaaagttacgtgaaaaatggtaggataaggtagataaacatgagcggcaatgtagatttgctttgtacctcctaggcatttgacaagagaattcttgacaaaccaaaccacaagtatggatcatggcacattatctcccaactagaaaatgagaaaagtacaggagcggtctaaattttgttcaaaaagtaactgtcaagtcatcatgacaggtgatgggactaactgtaaaaaaaacaataatatggtcttagtaggcattaaaacaacagatcagtttttttagatattgaaacaacagatcagttagcttggcacaaataacatattgtgttgttccttttctgaagttcgtcaacaagtccagcatcctcttcccagtgtccaaaatgcttatccaattgcactttcaagctccaaatgtagacagcttttgacatatcctgcaaagcacaaaataggttttatatttcgagacagtacagctgtttgacagtccatgtaaaaagtatgtggcaaaatatttcagaagccgcagg

SEQ ID NO: 60684 - DNA, 3826 bp, Oryza sativa
tgcaattatttaagagtccacctctatcaccctctcccctggcccggtctaggtgtttgggtctggttctaactatgcttctaatgagtctggccatccgtccctcccttcctagtcagaattggttcgatggctcatgtttaatcaagatttcatctcactgcaattgcttaagagtccacctgctatctccctttcccctggcccggtctaggtgctttgatctggtttttgtaactatgcttctaatgagtcccaaatcctaatcgagcagtgataaaaggaaagctaaacataactattagctattttcactaaacaaaatcatggaataaataatagtcatacagcaaatgacaatatggacgttggcttcaatcaacaaagcagttagcaagtatcgcaaaaatgagaagagaaattctgcataaaagtcattggttagggttacataaattagaatgatgatattcatgctgagcacatccacttgagctgagtaaatcgaatgtgcaaatctagaattcgtgcagaaatcctaagcttgacctaaaaaaataattgctaggcaactgaaaagtataacaagccatgccttattgaacattcaacattgaaaaaagcaaaacaagcaccacatcatggtccagccaacactgaaatataagttacctcatggtttagatgctaagtgatcggcgtttagggcttcttgtagagtccatgaagactcagggcatgcacaaaagttcaactcaactgtggcaccgagcatggctgcttgtaaggaagagtgtgacttgttgattactaaatcactgatctcacggtcatagaatatcgtcattttttgcagggaagggagcctctgcaataacacggatgctaagcataactcatggtcagaacctttaaaagcctcatatacaaccatcatgatcttacgatcttctattggctcaaacaagtcaataatgcgatcttctgttagatctatagtgacattgtccagtttagtactctgcaaatcaagaggcacgtgtcatttaactcaggcatgatggtaccaagcaagtaaaaaaatatgttatacctgtatgtataggttctccacagatggaaagtatttcaatagacgccgcatggtgtgaaactcattatcatgcccaaacccaagttgaactcccaaagtcctaacagacttgcaagattgcccttcactcaatagtggcacatgggagttcaggtcaatgtaacctaaaacttcaagatccatatcgatttctgagttcatagataacaccatggttcgatggtcgccaggatcagggtgctcatcatggggctgaggctcagaagtgccaacattatgcaatatgagtctgcatagttttggggccacaattctaacactgtctcttgcagaataattccagagcaccatcctcttgaggctattagactcaaagtgaatcttggtagaaaactcgagaaaagccagagataacctttcgagctttgggcactgtgcaaccatcttcatcagtgtatcatggtggaactcacaattgacaatccccaattccgcgagattcggcaaatggaaatcaatggttccagaggggtccttgaacctgatttgacataaatacagggtctcgagcctccaccacttaagaatgttttctggcacaaataaaagtttagcgttggctgagctctattgagaaagatgaacttggtcaccttcttcgagttaaagagattaaaccaagacatcagaataataaatgcagactcatcatcgtctgtacagaagagaaaattagaagaatataagtgcatgatactttaagcagcgactcatctttacaagcaaattgatgcaaaacgaccaaagcttcaagaataattacctatgcaatgtaattcctgcaccccaaatggctgaaagcacaagttggtgagcctcaccgtagggaaaggcccatcttgtgtggaaaggactgacccaaccctctcaatgagatccacttgctcgccattctgggggagcagctgttcgtcgtcaatttccataacggtggatagccaaaattcgctggcgaataagggacctaactcccgcaccatctttaccgggagatgactgagaacgtccctcatcaccggggtaccacggatatttgcagcgactggagacgagcgtgtggcaccggcataattgaggttggtgacggcggcgggggcggggtcggagacgacggccatctccatggttttcctgcgggcgagcatcttgcggtgggtgatggtggtcgccggcggcggcgggaggcaggagattagctcctcgagctgcaccatgcttacgagtttttcgatcctctctctcgaagaagcaacgtggatacgagtataggattagctttgccggcggcgggctagggaggcagcggcgaccggtaggggaggggacggtggaggcgggacagtgaggagtgaggagtgaggactgaggggggacttgggcctagggttgtgacttgtccgtgcggatcgacggcctttacgggattttcttttcgtccttccatgtcatatagcccatgaacaagcagaccggcccaagtcactgttctgaagccctgtctacaacgaataagttcactgtgagtccctcatctttgacgacgagtttaaatccatcctaaaccgtaacaccagcagacttgagtcttgaccccttaacatgcaaaattaggttaaattagttcctttaaaagtgtagatggatggttttgctaatatggtaagtttatccggggccactcgtgctgactagacgtttacgtgacaagaacaaaaataaaccccacatgtcatacagtcatactcactcccctccactcttttatctccctactctctctccccctcctctcagtcttcttcctcatctctctccgtgtctcccctctcttctcatctctctcctgcctgacaaaagcgaagggaggcggtgtatggcagcgtcacattattattattattattattattattattattattattattattattattattattattattattattattattattattattattattattattattattattattattatgctgaaaatgatgccacatccgctaaaacagccgcccatattaccaaaggacctaatttagatggtttttccaagatgagaggcgaatatttctatattgcggtttaaggatacaaaattaaactagacataaatataagggaactgcaagtgaacttattctaactggagtatgaaacaaagaggcccagcacaagcatatgacggcccaattcctattggcccagtaggcctcatcacacccttagcgcagaggaataagttcaccggatgtccctcaatttaacagcgagattttttaatatcatttacccctaaactctcacacaccgttcaccggaggtccctcggcactcggcagtatttttgcccaattttgttgacgtggcatcctagtcagcaaaaaaaattaaaagaaaatatgtggggcccacatgtcagctgcacttttttttttctctattttcttctcctttctcctcttttctccgcgtcgggctggccggacagtatccagaagaatcaggtcaacgccgacgacgggcgagcgcgggggcggagcggcgccgggctgcaggcgaagcggaggcgggcatcgaagtagagcgtgggcgagtggacgcgggagagcgacgtggtgttgacggcgccgggctgcgggcggagcgcggcgg

SEQ ID NO: 60685 - DNA, 4635 bp, Oryza sativa
  unsure (1)..(4635): unsure at all n locations
tgggaagaactccatccactttttctgcaatggcaatgaaccaatcaatcagcaaggaggcatacgtgtatatgaacgaattcattcatgggcaagatggaaaatgcttgtggcgtcgaacagcttggagaagatgctgtcgtaggttgagggtctcgcgggcgtcgccgccggacacgccaccgctggggctcttggaccagatgtgttcgcctgcctgcgcgaggcggatcagctcgtctccccgacgagccgccgctgaggaggtcaaggtctagcgcggccagcacagccgggctcgtctccccttctcccgtcgacgcgggtgacgacctctcccctttctcccgccaatgcggtcggccgcctctcccgccgacgcccccacctctcgcgtcggcgcgcctcctctcctcctctcccgccgcctcgtcacgccgaccgcctccgcttgccgctgcagccgcactcgccgacgcccgccctagcagccgcgcttcccgccgcaagccgcgctcgcccgccgcttgccctcgcagccgctccgcctgcctccgcccacgcccggagaagaaaaaagaacaacagaaaaatgtgggtcacttatatgtgggccccacatatttatttttattatttgtgctaaccagatgtcacgtcagcgaaaccgtttttgtatagtttaggggtggagatttctggttttgtggttaagcaaccttaaaaaatctcgctgttaagttgagggacctccgggtgacttnattccttagcgccgaatatgtcgggccggattagcccaggagtctcgtcctcttcccctacccccatcgacgcaggcggcgctgtacagcggttaggagttcgacagagtggggagaaagccggcgagggaagccgaagcatcgccgccttccgccagcgccccaccggcggccggcatggacgaggagacgcagaagaaggtggagtccacggttctggagatcctccggggctccgacatggagtccctcacggagttcaaggtccgcaccgccgccgccgaccgcctcggcatcgacctctccatccccgaccgcaagcgcttcgtccgccgcgtcgtcgaggggtacctcgaatccctctcccaggaggatgagcaggagcagcagcaggagcaggccggcggcgccggcgaggaggggaaggacgaacaggccgaggaggaagaggaagaggaggaggaggaggaggaggagcggggaggtggaacgaagagggagtacgatgacgagggagacctcatcctctgccgcgtgagttcttcccctcgcgtgaaatcgctgatactcctttgtttcgctagatttcgcggtgggaatcggtgtgatgaggtttgcttttgcagctttcggccaggaggagggtgactcttcaggagttcaagggcaagacgcttctgtccatccgagagtactacttcaaggacggcaaggagctgcccgccaaaggtgatgcacatattcctgatttgttagctgaaacattggatttctgctattataatagaggacttgtcttagaactgctcggttaaaatgcaccttaatattacacatatatctcgaactttaccagttttattatgggtgggactgctgcaagtcagttgggttagattttgtttagacctcagaggaaatattacactctaccaattctgacatctgtataatcgaattgcatcataactgtaaattctctgatagctcgatctgtttaatattttgatgtgttttctgtgcttatctatcctcttctttcttggtctatttgatcacactctcaaatgtcacggagcatacctaggttttgttttgcacatgtatgagctattgtttatattccagtgttgttataaggatcaagggtgagttgcttaaagacaaaggggtgatgataagaatatagggaattgtgaattgggtatgaaaatattcttccagcttatcagtcctaaaaatattaacttcgtgcaaatttccctagttttttctattgtacttgctaatatcaatcttgagtgaggccgacctgtcacttgtctgttgtcatttgccatcatgctttgattgtgtcagcgacactatttttgtagatctgtgctattgccaatttgtaactgcttgattatggttaggattctccatttgccaattctgcaaatatttatcgtacagtccctgttatggcttacaagttgttgttaccaatttgacttcttgtctttactcttagatgattcatattggtagtactaggatatctattttaccttgggtttgcaccatctaagtctttagtgtggtttggaagttgttgtgcagtttgttttcttattatttgtttagtccagctgaacgtagttgctgaaaaagttaaatatgatgtcaggttctaactagtttataggatatttgaataggtgcaatgtgattaaatcttatgcaacagctacccagctctatttatattgttgtccaaatttagttttatgggaggaacatttaagcttagatgtctagctgatcctcaaaagtatctcccaaccttatgaagctatactacaatcttaggcataagcgaaagataaaagaaaagagtcacagttactccatagcctgtacacaggatcctaatagtgtgttgatttataatgtttggaatacgacatcacccctcagattgtacttttatcacaaatccttatattgaagtctaacatctgacaattgtttcacttgggacaccttccttcctaaaggatgagcctttgtaccatgttttttattttaccaccaaagatgaaaaagttcattttcagtttgctttgtgcctattgcatcctcttcacaggcattctttgtgtagtggtgctaatgcaatgcagttttgttttactttcatgacgtaactgtacctttgcgtgtgtgttgatatgtttgatttcatgtgcttcatttcttattttgccacgctgctgaattgcagggataagtttgacagttgagcagtgggaagcatttcgtgattctgtgccagcaatagaggatgccattaaaaagcttggagaatcatcggactgaaagcatgtttcagaagccccttttgcctgtatcaaatcaagaaggcctttgttctggccctttacttagggccagtacaggctgtaagtccgctatggagggtctggaggtactagggttcctataaacttttgtaaaacttatcccttagtcaagctgcatgatgctgtgtagggtagacggttggagacttggagaagtaatttcttcatatgctcgtcttaatattggagttagtgatgtacactgacatgcatctggctactttagaaaaatcagacatgggttccagcaacaagcctcttttgtttggatcatgaggcactgtcatcggactaactcatctttatgaagaattagttctccgccgctagatgttagtgtttttcgttcatgcccttacacttgacaattgcgtctttttgtctggaagttgcaatactgatatgttttgggcaggtgatctgagccctttatcattgtttctcgaaactgatttttaattaatctcacgggtttcacaccttctgccatcctgatgccaggataaaggttgtactataaactttagttggtactccatagtttccagcactagactttgtttctgatttgagcgtcacctccctgaccaggaaagatatgctcaaaggaaacaaccaactaacatcaattatttgcgtacgaattatagggaactatgatgtgagcttatggtattgataaagactgtcctagagctagtgaaggaagaaacggttgattttatagtgtcttggtagtatcatccaactcgatagctcattatggtctatttggaggagcttaataatttgagaatctgctagttgatagttaattactgagaatattgagaagctgagttatcttgagaagctgagttatctagcttctggcttctagttcattttctgtcttttacaactgcatattcttaaaatctgggtgacaatctggactatttagaggagctgaaaattctgtgagaaattgcagctgctagaagctcttccaaacatactctatatatgatcatgtagatttggagtagcgatatgcatatagatttggagtagcaatatggggaaaacaaagttacatttctagtttttgcctaccagttcatttatctgaattttgtagctattaattctaagaccaattgttacaatatgttctcgccaagaaagtgttgcacagttataaacacatatccctagtactccctctggtaaaaaaaaaacttaaatcctaaggatgaacatagacacgtactcaaatcctagggataaatctaaacacatatgtgtatagattcatgcctaagatttatatctttttgggacaaaagagtactccctccgtcccataaaaaaccagtctagtactggatgtgacatattttagtactatgaatctggatatatatatgtcaaattcatcgtactaaaatatgtcacatccagttttagattcgttttttatt

SEQ ID NO: 60686 - DNA, 11890 bp, Oryza sativa
  unsure (1)..(11890): unsure at all n locations
tttagttatttataaatgtattcctagttgaactcttatttttatttttataatttcagaattaattttgttttttatttcgaattttaattaatcttttattgtgttctatatggtctatccttttaatattccttattttgttattttcaatttcaattgttttaaaattgtattcgtacttaaactctcttttttatttttcaaattttggattttatttcaaataaacataaaatggattaatgtgattttaaaatcaacttacctaaatttttattttaaaaaacacaccgtttaatattttagaaagtgtgctttaactttgacagccgctgcgtcactcataataagtgtaccaatatatatagcaaaccgttgtctaccatattcagaaagtatattaaacacataccgctgatgctttcagctgcaaaatagagtactgaacaatatgaaactgacatcaccataggtgttcgcccgcaagaacaagcctctaggaaaatttacgacggttcgcctgtccttgtttggattctcctccaattcactgtctctcaggtcaggtgttgcttcaatgcatagcatcagaagggacataaattatcaaattgaagtcaaattattttttgttttttttgaaaaaaaaagaggcaaacttgaagtgcagtaactgattttggaaacgcctattgcccgaagaaaaaagtacgcatgctgctcctagattccatttggccgggataagcactctccacttctccagaagaggactcgatccgtccgcaagaaacaaagctttgtgacttgctgcaatttcatccacaggatgtcaggaacgacttcgctgacagacattactcgggctgaatacgttgacagagacgcccggcgtatcccgtcgaaaatcttgtttgatgttcacagggtgtattcactacgtagtactccagaactcaatttcagcgacgcttacgtatgatgtcaaactatccaacatgtctgcaatcgttccaataaaatctgaccattttaattcagtacaataatgctaaatatgtttcatattaaatcgttgtccccgtttactcacggggataaatttaggaaacgtttttaccccccatcgtccactaacgtctttttctaggaaccatgtgtcgttgacagaacaaagttacaaatctgataatgctaatcattttaattagttggttagggtcgcagttgaaaagcaaaatctcagcacgattttttcttttgagagaaaagaaatcgaagcaaagaaaagggaaatagagatatgattaaaatgaattataacaggctgatgtcgttgcttcaactgtgaacaagaaatatttgaagaatctgttgggaaaaagacaccgcaacaaacaaatgatcgagctaactgatatattatagcagtgcacagttttcccttttttttctaaaggatctcgcggttctgttccaaccacatacgccatttttttaaaaaaaaatcaaatcaaatcaaatcagacatctaaaatattcaagcctataactgttcaggggatagagatcacctgcagttgtaatgtggactgcaactttagcagtccttacgtgaccgttagatcaaagaaaaacatctcatattcggccagaacactgtagcacgcgtatagtcctgtagcgtactgtagcatatactgtagcgttgttagcttggttatgacgtggcacagccatctgtcgttcatcagcttgatccgacggttgtgaagggatgtgactgcctaacttgcagtcaatgtaataactgtaacggatcttgattcctgttcaggtcatcaggtgcactcacaagctcacagcgcaagggttcgcatctctcatctcatgcactctatgactgataagccgcaaaaagaaaatcaacgaaacaactgaaattatgtactccctcggtcccaaaataagtgcagttttgtactatttatgtctaacgtttgatcgtttgttttatttaaattttttatgattactatttttattgttattagatgataaaacatgaataattttcaggtgtgactattttttttattttttttataaaattttcaaataagacggattgtcaaatgttggacacggatttttacggctacacttattttgggacggaggtagtataaaacttttatacttaaatttttattttttaacaattgaaaatcaatgctaaaaaataaactataataaaaaatcaaaattaactaaaattaagtataaaaattaaaatttaactgtctctgataagccaacaggcaagctattgagcaagaagagcaaactttgaaagagataacagcggatgaggagcaagagggagtatagttgcaatagtaacctgcagctcatggcgtcgctcctggaggatcctggcggcgccgaggagcatggtggtgtgtgcgtcgtggccgcaggcgtgcatcttcatggccaccttactcttgtgctcccactgcacctcctcctgacaagtttttgttgaaggcttttgcagatcagtatatgaaagatagaatgaatatcccaatattcttttggtgcattgaacaaaacccagcagaatgtatctcaagctatcttaacgcttaagtacccatgttgcaaactttgatttcaatccacaaattattgtgtcaatagaatagactgtggaaccgtgtgtataaacattttgctgttgtggagttagtttttcatcccttaagtggtcataaaaagtctaacctatcaaatagtcataaaaactcttgaaaaaaattgttaagatttatacaatagtcgtctatgatgttctttttttttaaaaaaaatcataactatgtaaataacatgtaaagtatgggaggacatccaatcagaggatacaaacttttttgtgattttgttactaaaaaataagctcaagttaaatgtaagggtgtgtttgcaagagcaagctcccaacactccactttcattttagaatcaatttagcaattctctcaacttttgagtagaagataaaatcaatcataggtacgcatatgacttatgcggtgggacattataatggttaaacattttatttttattactaaaatgaaatgaaataatgtctcaaaattgacaacattttaaaatagatgtagtcaaacataaaaacaacttacaaaaacacaatgatttgacaaaaattgttatggaaaatgttttcatatggttataagttaagcatgttatagaatgcatgattaaaaaaacatgtttattggagacttgctgttgttttagacatcgtgtaaacaaagagatggtaactcactccggccatattttggacataatttaagtaaagtaattcgatgtacaaatgtctatatttgccctgaaaagtacataatactctaatttttatcaagtttattaaacatcaacttatagaattagaaggtgtggttagatttctgtacaacctaaacataacacaactcttctaggttctatgttactgtgcctctactgctttattaaacacaagcttgcgccttgcaacggcttaacaattatagctcgttgaaacgcaataattttgtaggtgctcataattttttttattttattcttctaaaaattcctttgaaattgctccattctaaagggaggctcgatttatatgcactgatgcctctccactgaacacctgaatttttcatccaattcacttaaatttttacctgagaaaaacataacacagaaaccctacagatcgattccgtcattcttttttttccctttccttttttttttttttgaaaaggcaggcagcaggttccatcattcaaatgactactccaaccaaaacgcttaacagataaaacaagaattccaatcaatacgtgcataagaaatcaatgagccatggcaggttgcccccccgggctgtctcccacatacgttacctgcatcgggagtgcatccatgtcggcgcgcagcgcgacgaacggcgggcgcccggtgcctacggtcgcgacgacgcccgtgccggcgaccgggtgcctgtacgcgacgcccatggcgtcgagctccgccctcaccagcctgctggtctcgatctcctcgaacgccagctctggccgctcgtggatggcccacctgacgcccgccatccacgccgcgaactccggccgcctcgcccgatcgagcacgtcgacgccgccgccgccgcccgccgacgcacctcggcacgcgagacatagcgccgccgcggcgacggcgacgacgacaacgaggtcatggctacgcaggtgcggaggaggagcggcgcccatggcagacgcacgcgcacgcgccatggcgcgcggtcgcgaccgaggacgagcggtaccggccgcgggtacggtaattggtaagtatacacgcgatgcgatgtcccccggccggcgcgcgcgtgtggcgggttatatatacacgtggacgccgggcgcgcgcgagcgagagcgacgtctccgcgagacgactccgcggctccgcctcctcctcaacgtgaggcggacgctgattacgtcgcgccgatggccgcgcgcgcgcctcgcgctgggcgcacgatccgaacgttcatatataataacggcggcggcgttgtgtgcagggattacagcatgtacaataacatattattagccagctataagataaaagataagagagaatagcaacgaactacagatatgtagccatgtgttatggctccaagacacaatgtatataaaacaagtatgatcatatattaatagtatagtactccgtaaaaaacgaattagctgttagatcgactataaataaattggagatagtactggactatactactacctctgttccaaaataagttaaaccgtggatattcgtactcaacgtttgaccattcgtcttatttaaaaaatttgtgaaaaaattaaaaatatttagtcacacataaagtactatttatgttttatcatctaataacaataaaaatactaatcataaaaaaattttaaataagacgaacagtcaaacgttgaacgtgaatagtgtaaaactacacttattttgagacggagggagtattaaacttgctcttagctagcggcatataggcgaggagaaaagacgtgacgggacgcgcgcgagagaggctcggggatcgttggagtggtgttggatcgactcgatcgtgggtccttgtgtctgcgcgagtattctcgcggatgaagaattcaacggctcaggtcaggtcttgccttgacgatcatcctcgcggccggctgggccgcaagtttagaatgcaacagttttaacgttttaagcgggtatatagctctacagatcaaaaggttctaaacggggcaatttgtccattaattgttggacatggacgccctcatggatattggagtcaaccgtgtgggttcgttttcgttttctccggtactggtgtcttcgtcagatcaaggcgtgtcacacacatactggattactggtgtacagtactccagaagacacgccacgtacgatcaaatagtaataaagcaactcattagaaaaacaacgtcaacgacgggacaaatataccagtgacgtcgtatgttgtgcaaccagccagcttattattaagagtatgaccgtaagctagctataaacacattttgagaagataaaaaagaagagagaagaacaatgggctacatatttgtagccagctgcagcacagactccaagttacatatgtatatgacaggtgagaccagatattaattatgtaatactccctatgtttcaggttttaannnnnnnnnnnnnnnnnnnnngtcaaaacgctttaagtttgaccaagtttgtaaaaaaatagtaacaaatttattacgaaaatatatttaattattgatttgatgaaactaatttagtattataaatattattatactccctccgtttcaaaatgtttgacaccgttgactgtttagtacgtgtttgactattcgtcttattcaaaaaattaagtaattatttattcttttcatatcatttgattcatagttaaatatacttttatgtatacatatagttttacatatttcacaattttttttttgaataagtcgaacggtcaaacatatgctaaaaagtcaacggtgttaaacattttaaaacggatggagtatttatcaataaacttagtcaacttaaaacagtttaactttaaccaaagtcgaaacgtcttataacctaaaacggatggagtatatatttatggataactattgtattcatggttcaagaaggcgctaggcgctagttgggcggatagggggcgcctagcgcctaattggcgcctaggccccgcctaggcggcgcctaggtcgggtcaaatagttaaattcaagaaattagtaggcatattgcatagaaattagactatataacactaaaatagcaataaaatactacctaagtaatttaaccgcctaatgcaccattgaatgcctaatcgcggcggctacccggcgcctagcgcctaatgggcgcctaggcggcacctagggccgatttttagaacactgattgtattaatgggctattaagttgactatatatgatttagagccggcagctggctatactattaaacttgctctaagtaatggcttgccttggctctaggttactacttgtcaaagcaaatttttattgccaaagcactttctaataattcctatattgttaataaaaagatatggtatctccattgattcgataaatcataccgtatatccgaaattatcatcgtaggtaacgctccaaacctatttattttacacgagatgggaattgagattctaaactaaatacaacctatagtctttatttattttaaatttcagacttgtccagacaaaaataggctacaaaataatactccagaccaaatacagctcgatcggcaccagttaattataacttttaaaaaatattaaataataaattttttttatatttttatcaatagcactaatatctgtgcattggacgaagtacgagtagtatgggctggtttggtttgtgatctaaatcgaccttaccaattttggcacattttggcataattaattttggaaggcaagttatgtttggattgaagccaaaatagcctaagttaactattgaaatggcctattttcttaagcatactaaaatttggcttcaaaacaaatagacactcaacactattaaaattaaaattgctaaatattggtaagccaaatttaagccacaaaccaaaccagccctatatgtccaattgaaatcgagattgctggcgcacgcggcagcatgcgcggaactatgcgcgtcgtttcgttcaacccagcacgtgatcttattaaaacgtctcgcttatcttaactctttttaagcagtcaaaaagaagccgtcacgctccaattaagttggcgattgcatagtttgagagatcagcatgaagaaatggcgttcccttttgacggagctatcatgagacatgtcgtttcaactttgtcgtgttcggattaaacgtcggccctagtaataagcagcgcatcaaattaacctgacattgaaaacgtgcatcattcatcgtttgctacggaggagacacaggacacaccgtggagcactgccaaaaatttagtgctagtacatcacaatcactgcttcgggggtgtttagatctaaggtcggaaagttttggtgtgtaactatatagggtgtcgtataaaatgttcggatactaatagagaaacaaattgtataatccatcaataaaccgcgagatgaatttattaagactaattaatccgttattagcaaatgtttactgtatcactatattttcaaatcatagagtaattaggcttaaagattcatctcgtaaattagtcgtaatctgtacaattagtaattttttagtttatatttaatattttatatagaagttcaaacgttcgatatgatatggcgtaaagttttagcataggatctaaacctggccttcgtctgttatcgtggtacaacgattgtacgggcctgtgttttttctcgagatgaacaaattgtaccggcatgtttatctcgctcgccgttggtgtggcgtcagaatggatcacacgctgggcgcttcgcctcgcacgtgaaaatattggggtttttgcagtttcgcacgctatcatgtgggctgtggcctctgccgcctgcgtggctgcgaccgtccgtacatgcgtcgtcagctgcactaacatttggacagaatttttcgtcagggcgcactgccagttgatgccgcgcctgcaggatcatcatcaactgccccgcgtcgcgttgcggctgcgcgcgtttcaggcgttgcggctgccggttgatctcgagacgcaggaacgcagaggcgcgagcacccatcgggccagccaatacggtactactacaccagtagaagcagcaggggatccggatctagggcctcgtatagatctcggaaaatttttgctaaaaatgtcacatcaaatatttgatcacctgcataggatattaaatatggagaaaaaataattacacattttacatataaattacgagacgaatcttttgagcccaaccacaccataatttgacaatgtgatgctatagtaaacatttgctaaagacggattaattaggcttaataaattcgtcccgcggtttacagacggaatctataatttgttttattattagtttacgtttaatacttcaaatgtgtgtccgtatacttcaaaaactttacaaccaagaaactaaacacacccctacgatactcattgagtcattgttagtgtgtgtgaaacttttaagcagtagtagtactgcttatcgttgaataccgaattgaacagtctaaattaattagcacaacagtgttagttgcaatgtactaggccctatttcgaagattagcctacgactaattttaagagctaatgtttagtattgaatttataggctaaacattagtctagggtgatatgtttggatccatgagctaattcagggataaaaggtggagagagagatggagatggggctgctttttcatggtctctatagaaaattagccacattagcatctctttaagaggctaatgttttgagggggctaattcactttagccccaaattaacctagttgtttgaatccttaggggctaatttagagctcaaaggtgggggctaataattagcccatgaaaccaaacagggccctggaaaaaataccatagcacaaaatactactagtagtacaaagatagttgtgaatctagactgttgaccacataaatgagaccactatgtactagtattatataatatactagtattatatagtacagctgttagggtagctatagttccatgtaggattgtatccgatcaggattgtaggccaagggattgttggccaagtttagtttcaaactttttttttaaacttttaactttttcatcatattaaaacttttctacacacataaactttcaacttttccgtcatatcgtttcaattttaaccaaactttcaatttttgcgtgaactaaacacacccggaatgtgatggatccgaatctgctgtagttgatactgtgaatgtaacttgtaggcctcatttgattttctagaaaaaaatggaggaaaaacataggaataagaatcctatgtgaattggtactgttcatccctttgatttgtaggaattgaacaaaggaaaagcatggggaaaaaaatcctatgatcatgatttcaatggaatttcatatgaaaattaacatccacctttagcgcatttttcttttcctatgtgtaggatcaaggcaaagcactattggatgatacagtttaccctagcaaaaccattcaaattctgatttgctattcctatgtttttcctatacaccaatcaaacgatcattcctatagttttcttatgttttttttaatcctctgtttagcatatgatttcatatgctattcttgtaatgtttcctattactacgttttttcaatcttgtgattcatcacaacgatggttacgacttgagcaatgatgatattatttattcgttggacccaaattgaacggtccaaactagccgcataagattgttcattgcaatattatagcaaaaaaaattattacttcaaaaggctattcatattcatactactaccgtagttgtcaatttggaccactaatcaatggagtaaaatggaagaccaacaatgcatgcaatccttaaggctcacacatctaaaagtgctaaatagtgcgtgtgttttttaaaaaaataatatatagaagtttctttcgaaaaccaaataaatcaaaattttaaatttgtaatatttaatacttaattaatcttccgcaatggtattttttttgttacgcatgcgacaaaaaagttaggcctaaatgtgctttcaaacaaagcttggatccagatttgctcggctcgtagagttgggaactaatcctcaaacatgtaaaaacagagcaacttattaagtattatctaaagtaactttaaaaataaattaatatgattttttgaagtaactttctatagaaattattttttttcaaaacataccacgtttaatagtttgggaagtgtgtgcgtgaaaaaatgacggaggtgaagttgaaattttgacttaagaacacaacctaagtagtatacttgtttcgcttatcattggatcagaactaaatgatctgaataagtgcaaaacattgttcatgagttgtccatgcttttttatagcttccatgttgagtgctgcaattaacatagaggccggtaaggggacaatacttcatgaacatgtaaaatcattttacatgtaaaatgcagtggcggctccaggatcgattcgttgggtggtcctgcttggcgtgccaaattgtcacaatgttataaaatcaagtcaaaattatcaaatacagtggaaatataattcaaatattgcaatatagctcagaacatcacaaattgattaaaaccatcatttaagttcgaagttacgaaagttattacaacataaataattcaaatatcttacaatgtctctattccttttcatgtgccactgcaatttgcaccacaaattaatgagaaaataagtcgtattgactactaactaagttgttgctaaaaaaaaaaatctaagtttcagttttcattcacattttttcatccatatttttcattcaccatcacgatgaccgatctattcaaagtaaatacaaaagactacgaatgacttaatgagtaactcacatatgccaaattgccaatgcactaggcagacaggcagtaggcagtcggcaggcaggggccagccggccgggggcagggcggctcgccggctcgtcagtctcggccagcaggagggatcagccgtcgcgccgcaaacccgccgccgccgtgcggtgtggcggggggtcatcggctggccgccgccggccggagtgctgccgagtgccgcgccaggcccgggctgtggcggtcgacgggcggcggctgcaggcgtcaggcgagggtgggaggggcagcaggtggccagtcgatggcctccggcgcagcggcgctggccgactgatgggagagcgagaggcggcacgatttggggaggattggagagccgagcgtttgccgcctacgtgcgcctctcctctgccagctgagctaaccctaacacatttggtgggctctttttttttgtgtgggccgt

SEQ ID NO: 60687 - DNA, 4507 bp, Oryza sativa
aactccactccagacccaactcctgaagctaaattaaggagttggagctgtaccaaacaggcccagagttgctgcagtttttctgagaaactttagcaccccaaacaataattattattcagattctgagtatttatagtcgtaaaatctataaataaactagaatatagaaactgggttttctagcttcttaaccagttgttctaaaactcccaaacaaaacgtaactaagggtcgatccaacatttgcctaggccttgggctgacccaaggtgcaatctgacccacacattgaatacatgatgaaattagataggctttcatggtacatactccgaggctcaggtgtcctaggaccacccctgaatcctattcatgatggaacgtgttttgtcttgcagactttcgttcctgggcgccatggggactgagagagagaaacatcttgttttccgcgcgcacgtttcccaaactactaaatggtgtattttttataaaaaaatttctataggaaaattattttaaaaaatcatattaatctatttttgaaatttaaaatagttaatactcaactaatagttaatacgctagtggcacacctcgttttgcgtatcttctcaatattctcttctcctctcctctcaaacactcccttaaggtcatgttcatttaagcttatggacttatcgactatacttaccacgatcgtcaaaccatgatttattaaaaaaaaacttccccatcagcattgcttacataatttttctaagttatttatgtttttgagagaatccattatataccactcagtttgccacatttctacgattcgtcgctgactttatcacgttctacaatataccatcgacttttgcttaacttctacgatttaccatcgccgtcctattagcctccgttaataccgtataattttttccaaatgaccaaaattcacttgggacaaaaactttcaaaatttggataataattatgaaatgtcagattttaattttttggccaaattttggatgtttacaatattatgttcataatatgatacaaaaagcaaatagagtattgtattttggatgtttacaatcttatgtttataatatgatattacggaatttttgtctaaattttggaagtttttgtcctagaggtattttggtcatttggataaaattatatagtattagcataggctaaccggacggtgatggtaaatcgtagatgttaagcaaaagtcgatgggtatattatagaacatgacaaagttagtggcaaatcataaacctgtgacaaaatcagtggcatttaatggattctcacttttttttataagactagcaatagtgcacgtgcgttgcaacgggaaaaactaccgtttgatagtatgacatctcgagaacctcaaattggtaaaaatcaagtctaatttgatatattaccaaaattggtagaaccgagtctaatttgatgaattagcataggatttaggatttagtcttagatttatttttcaagcctacttaggagtttatctgatggactttaattttaaaaaaatctgagccatttgatcaaatttgctttcgggccaggtcttcccaagtcagcccaaacttgggccggcccgtcttcgggcttgtcggtgacatgggaccgggggaatcatgactagaggcttgggcaggagcaatcacccacgaggcctgaccccctctgggggggtcgggcccgagggtgatatggtcgcccccctctttgtctccccgaggggtcggaccgctcccgtttcggccccgagggctgaggcgccccgaccccttgtagattttgcgccgcgtgtatgggttaggtgagcgcagcggggctcacctaaccgcatttattgcgttttggacgagcgcgtcacgccgcatgtaacgcagtgcagcgcgctcgtttatccggtctgagaccagtcacagaccgatcagatcgtgggttaggtggcgacaggcggtctgacgcacgcctcgccccatcccgtcaggacgagagcctctaaacactcgtccctagccggagccggcgtgttacctcctggagatggcacgttggtcccggtcagatatatgccaggcttcatcctaaccattacaagcaagacattgtatgaagaagggcgaacatgcagattgataaactgacgcgtggtggacaagaatgaccgatttgtgaccggtctgacactggtcatgtcgtcagcagacaaccatgttcccacgtcgcgcctgcctccggcggaagtggaggtaggtatgggccgtcccatcagaaggtcattcggacggcaaccatacaagtctccgtctatttatgaaaagataggataagtccccacacaaaagagagaaatggtgcatgtggtatccccttgaggtataaaaggaggaccttgcccacttagaaaggggattggggatcgagaacgatcagagagggagagagttagagttctctggctctccagctctttgtagcttcttcatacacaaatccactaaaacacaggagtagggtattacgcttctcagcggcccgaacctgtatacatcgcccgtgtcttgtgtgtttccactctcgcgaaccttccacacaccgagagcttagaacctcacccagggcccccggccgaaccagcaaaggggggcctgcgcggtctcccagtgaggagccccaagctccgtcatctggcgcgccaggtagggggctctgcgtgtgttcttctaagctctcgcactctttcgtgtgcgccaagcttttcctgttcagcccaatggccgaacaagcaaaggctcacaacctctctccgagtgttagcggtgacgacggggagccaaacccacgccgtcgagctcgtactccaccgccccctccacgccaaagtcctaggcgggaggaggcgctcgagagggtcgaaggatccgcgacttcgacatccacgggtgatggagaagggcgccgagatggggagcgtcgcctcctcgtctacggcgacggcagcacgccccagggcgcgctccaagctgcgggcgcgctcctacgtcacccgcccgttgtccctgacccggagtctccagcccaacgttggctggacgacgtggccaacttggtcatgacggcacggcagcgctaggtgtggtgggcggtctccgccaccaagactctggcgctgctaccaccggctccgtgtcgtcaaggcggagggcgcggcgagcggcgggatgtggctcgccattcggtcgccactccttagtcagcgcctcggaccagggaagatctgcgtggggggccggatgcccgtatcagtatcgagcgccggcgtaatggccgacgtgctgcccacgcaacggagggcgcctcctcgtccggagtgtcacctcaacacggacgcggggatcagccctccgtgcccccggttggtggtgtcggctgtagagcctttgttgcgagccttcggaatgtccgttggcccccaaggttccggcccaccatcgccgaaaaatatgacgggagcgtcaaccctgccgagtttctccaggtctacacgaccgggatcgaggccgccgggggtgacgacagggttatggcgaatttctttcccatggccctgaagggacaggcgcggggttggctaatgaacttgccacccgcgtcggtccactcttgggaggatctgtgccaacagttcaccatgaactttcaaggcacatatccgcgcccaggtgaagaagcggacttacatgcagtccagcgaagcgatgatgagtcacttcgctcatacattcagcggttctgtcaagtccacaacaccataccatgcatccctgcacacgcggtgatctacgcgttcaggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaagaaggaggccggcgctcccagcagggagcgcccaaccggcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggccccccgccgaggacatcgatgacggcgatgatgacctaggtttccaagagcctggggccaccattgccactgtcgatgggggagcgtgtgctcacgtt

SEQ ID NO: 60688 - DNA, 8843 bp, Oryza sativa
ccccgcagcctttgacgccatcaaggccccggggatggtgctccggccgtcccagccgattatcggtgtgatgccggggcacacttggccgctaggtcatatcgacctcccggacaccttcggtggatccgccaacttccgcacggagcgggtgaactttgatgtggcggacctcagtctgccctacaacgcggtcctagggaggcccgcattggtgaagttcatggcggcggtccactacgcctacctccagatgaagatgtcgggccccgatggccccatctctgtccatggcgacctcaaagttgcgcttgcttgtatggagcagcgcgcggaccacctcgccgccgcgtccaagcccgagggaggcgacgagaggcttggcacctccgcccccgccgccccgaggcagcggatagtcacatgcgacgaggtcccggtcaaggaggttgccctgggcgacggcccgtccaagaccacacggatcggtggtcttttggacggcaaataggaagacgtgctcgtctccttcctgcgggcaaacgctgacgtcttcgcatggagaccggcagatatgcccggggtccccagggaggtgattgagcaccgtctcgccgtgcggccgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcttcgcatagattagattgtcgactccacagcggggtgcgaccttttgtgttttctagatgcatactctggttaccatcagattcgcatggctagggaggatgaggaaaaaactgcatttattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaagctgaaccccgataagtgcgtgttcggtgtacctgcgggcaagcttctcgggttttttgtctctgcccgaggcatcgaggccaaccccgagaagatacgagctatagagcggatgcgccccccccagcaagcttagggatgtgcaatgcgtcaccggttgcatggccgccctaagtcggttcatatcgaggctgggagagaaggcgctacccttatttaagctcctcaaacgctccgggccgtttacttggacggagaaagctgaacgtgccctcactcagttgaaggcgtatctcagctttcccccagttctggtcgccccggagccaaatgaacccttgctactctacttagcggcgacccctcaagtggttagtgcggcgttggttgtggagcgcaatgaggacaatcctcattccgcgcacccccaccctgtgctggcttggcccgggaaagagcagggaggagaggcccccgagccgaacggtggcccaaggcccccgacgaccggagcaggccctctgcccgcttgtcagacggtgccaggtgcccccgacccccaggatggcccgggggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgatgacgccaggagcccccgacccccaggacggccccgaggccactgtgggaaggccgcccctatcgtcctccgaccccgaggtcgtcggcacagaagacgagtgcgccccgcgaggccgcttggacgaagagcgccccagggatgcggcccctagcgaagaggatcggccccaccgaaaggtgcagcggcccgtctactttgttagtgaggccctccgggacgtcaagacccgataccctcaggcccagaagatgctttacgctattctgatggcttctaggaaactgcgccattatttccaggcgcatcgggtcacggtggttacgtcttaccccctcggccaaatcttgcataatcgagagggtactggacgggtggtgaaatgggcaatcgaacttttgagtttgatttgcactttgaaccacgccatgctatcaagagccaggccctcgccgattttgtggcagagtggaccccagctcccgggcccgtctcagtccccgaggctagctcgggcccctcgcagctgcctcacacgcccactgggtgatgcagttcgacggctccctgtctcttcagggcgccggtgcgggggtcacgttgacctcgccgagcggagacgtcctcagatatttggttcgccttgactttcggacgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacgattgccgacgaactctcacggctcgcttcctcgcgagcccagaccccaccgggcgcctttgaggaaaggcttgcccagccgtcggcgcgacccgaccccttaggggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcacgcggctaacggaatcctcctgaagtgcattcctcgggaacaaggcgtcgagcttcttgccgatatccatgaaggcgaatgcggagcccactccgcctcgcgcaccttggttggtaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggagggccccgggcaggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaaactctgcttcgcctcacctgcccaccccagaagcaacgaccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaggtcccctcgggtcaccatgtactgcgaggctgatcaagatcagcttcgcagagatgacctcgactacttggaggagcgaaggcggcgcgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcaatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtctcatacacacaacaaatagaattgacacaaaaaatttcctctttatttgattgcagattaaattagtttatacaagaagggggcccgaaggcctcggaagaagaaaagaagaaattatttaaagattggcgggggcctgggggctcactccgatgcgcccgggtcgccagcctcgtcgccactgtcgcccactccgccgtcatcgtcctcctcgtcggagttgagggcgaacgcgagccgaggggccgaaccctcgaagctgtggacgatatggtcggcggcgtcccggacctgcgcgcgcgccgtcctcggttccgggagggaacttgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcgacgagtctagcgcgccctgcagatcggcgatggtgtgttcagcagctgcgaggcaggcggctaagtcgctttcgcccgcggccgccccgccgctgcgcgccctcgcgtccagctccttctcccgcgcctcgagctcagcggcccgctggttcagtgcggccctctcggcgcgggcaccttccagattacggcgcgcctgctcctcccgcgctgcctcgcggaggaacaggctgtccgccagccgttgcgccgcggcctcggcctcctcgagagctcgctcccgctcggtgagcgcgtcctcgcggaggcggagcgcggactcctcttcggcgcaggcggcctcgtgcgccgccagcgttgcctcccggatggcaacggcggcctcgcaatccgccaggtccctctccacggcgcaggcacgctcttccagcgccatggcacgggcctcacgggcttcttcgcgccgccgggatgccacctcggtctccgccgcccgccgttctcgggcagcggcagcgtcaaggaccccccaggcggcgtcgagcttcttccctagctccgcctcccagctcccgtattgaaggcggagggtgtcctgcgcctcgttcatcacggtggtggcgatgagggcggccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcacccatgcggcgtcgagctccgcccgctctgcttgtagggcctccacctgggcacttaacccgtccaacaccgtggtgtttgcgatggccaaggcctgcaggaggggttctgcgctcagtggggcaacggaaggcgtggggaagagccgcctcggagaggatgccgcgcggcttggcccgccgatggacgtgccggactcggggatgtcccccggacctggtttgtcctgagcgtcgcatgagggagtgggcccaagcgatgtgcccgcggcctcgtcgcgagctgcctcggaagtcgtcgtcgcctcggcctggcgaagtctggcctcctcccgagcggtttcttcagcttgacgagctcggacggccacctgggcagcttcctcggcttcccgaaggcgatccgctgcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccacggcttctcgccggtcagattcccgcctccgggcctctgtggtcgccgggtcctcggcctcagactggccggacttggaatggcgggagggacgcgacgggatctcgctgaaacaggagaaagaccagaagacaaacaagatgggtgagtgaaaactcgcgttgagggaatgaatacagccacgatgggcgtgggacgaacctgcgagggggtcggttaaacgaccaccttggaggggaaatgaggtttccccgggatggttctgtcccccccatcttgcggagccgcttcttctttcgctccccctcaggctgcggcgtcggcgtggctccctccgggcgcctgctgctgacgcgcgccgccccgccccctcggggaggagatgggggaggggttccttcctgcttcctcttcccccgggcgtcggcagggcggctgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcctagtcccatctaactccctggtgggtcctcatgtagtcttcggacccggtgtactcccaggcgccccgggcgcgccgctggagcggcgcaatccggcgacgaaggtagtcgccgtacaccatggcccctgtgagcccctgggatcgcaggcccgccaggcggtcgaggacggcgtcatagccatctcccagatctaccggcgcccgccagctggaggcctgcgccggaggctggctcggaagtcggaggcgcgcttcgtcggcaaggggggtgtagaaccagtcgctcttccagtcatcccacttcttgcggaggacgcaggggatgtagcggttcagcaccggcccccgcggctggaagtagcagccaccaaccaccgacggcggcgacaccgactgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaaaggcggaaccagccccgccattgcaaaagggaggaagaagacggaccgccctaggtagcatggtgccgggcgtccctcgcccagcgtgactatctcctggccggtgcaagattccggcatgaagcggcgcggcagcccggcctgcctctcactcacgatgcgggaaggcggcagcacgctaccatcgagcagagcggagccccgtgccatgacgccggaagaagatatgtttgagagcgagcgtgtgtggcgaaggtagggcacaggaaacaaggagttagggcgcaagcggcgaagacaaggggaataatggcgagaggaaggaagcaaatctcttcctcggtgtctctatacccttgccagcgctgtgcccggctcctcccttctcgcgcccactatctcgctccctcgtttctcgcgcccacgcttccactaatcccattcgcccgcttgcggcgcatgaggtggatatgcggctgtggcagtcgagatggaacatatcgtgcgcgcgttaattacgctcgccaaccgaagcgccatcaccatatctccaggcaaaacgaaccggctcgtcccgattcgcgtgctactcgagtaatgtggcagtcttgaagagaccgctcattattgacagcagagttaccattgccgatgtgcgtgatttgtgaccgttgggtttctgcccaaccgtggagaccagtcccacctgtcaccaggcctttggaagtggcgtcacgcccgatcgcttcccttgaggagggcgatcgccctggcataacgccgggggctactgtcggtgacatgggaccgggggaatcatgactagaggcttgggcaggagcaatcacccacgaggcctgaccccctcgggggggggtcgggcccgatggtgatatgg

SEQ ID NO: 60689 - DNA, 3602 bp, Oryza sativa
acttccgcggcccattggcagcataatcagcggtgacggtggcccgacgttgggcgaatttgagccgtccaatctgatagatggctccgatcgtccctgcgtcggatgaagcgccgaccgggagagaggggaaaaacccctagctcccaaatccttctctcccgatcctctttctattcggcaacgagcgagcggaacgacagtggtctggcgagcgaactttgccggctggggggcgcacccgagggcagcaccaagccatgccacggcatcgatggtccggccaggcgggcgtgcaaatggtgacgagcaccgagtggcccggacctcgtcggcgggaggggcgacgccaagccgacgcttcccgtctctggcaagggatggtggaggggtgctccaggacagcgcgcgcacggggaacctgacgcgactgcgaggaggtgaaggtgcggcggtgccgtttcccggaaagctccggcgagcttaggggcttcaagttcggtaagtaacccgatcccttagcttaattgatttggattttgactcttagggttcttatacgaaattagggttctttgaatttggggaattttatcagaaaatttcaatattttttattccctcttttcgagtttggggagtttcagtatcgtttatcccctcttttaattttggaaacttcaatctaatttatccctttgctcaatttcagggaagccattgaagccgatgtctggttttgcttttggttcgtcacctcttctcaacgccttttcaccattttgtttgtaacttgtggggctcgggggcaattcagatagaattctatctcttattttcttatttgatttgatctctgatctctctctctctctcttgctttggctagcgtttcatcgcgcaggtagggacagagggtgccgcttgttccctcggaaagattatgattaagacaatatcagattttcacggacgatgaaagtaaattgaatgggattttttttaattttttcgcccttttttcgttattacggacgacggaaacatttttaattttttaagtagtatagataaagatatataagatgtaatacttaatctatcgctataagcaattgtcgtaatatgttcagtcatccaaaaagtacacggccttataaatcatgaaagaccctattaacaaagtgacgaaaaagctcctaaatttactaaaataaaatccaaaagttattaaaaatcagcaagggagtgtagtcaaaactgagcaaaactaagaattgataggagaaatgcatgcttaacttgttttagttacatatgataaggaatccgaagttgcttcaaatacactattgtcacgcccggaatttctatccaaaattccaaacgcttacatgtgtgtgaaccctcgtccaggaatcagccgaggcacacaataacaaattgataatagagtacaaatattactctaattaataagcgaataatatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagtatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttactatgatgagaggtgtgagactaatcacgaaagacattgttagacccgcccataaccgtgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcacgaaaccatcattaaataatagtgagtcattagttatcccgaatgtgtactaatgtttctaagcagggctaagcaatcatatctaatatctagttgaaccaatataaataaagctcaactagtcaaattgtaataacccaaggtatcaaggaataaggtaatcaagtacgaaagggccataacaaagaataggtcaataccacccaatgacattcgaaaatagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcatcaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagacggtttattgcgtcagcgggctagggtttggtggaccgggcgcacgggcggcggttcacacgaacggacggccgagatcgaaccaatccaaaacggacggccgagaccgatcgggtccacggcggctcacggcgaacgaccccaatgacgtcagcggtgacgtcaccgacagcggcggcggctcggcggaggagacggctcgaacggcgcacgctcgccggcgaacagcggcactaggacgcaaacggagggcaccaagacgtagaggacaacacggcgaactcaccggtgacctaaacggcggaggaagaccaacggacggcgacggccacgaggaggaagcggcgggaaccttcgggtcgacgacggcgatgctgctccggtgatctccggcgacggcgaaggggcggacgaggacggcgacgacttggcgagcacgacggtggtcttcccgagcgacggcgacggctgaaacgacggcggcgcacggctggagcggcggcggcgacggcaaagctaggg

SEQ ID NO: 60690 - DNA, 2534 bp, Oryza sativa
caaagattccaaaggagaaaaggtagaggagatcccggagatcatttcccctctattgattcggccggagaaggaaaggaacggccggatttggaaggaaacggcggcggcgcgaaactagggtttcggcggcggcggccgaaggaggacgatgggtccgacaggtgggacccacctgtcagcgaccgaacgcgcgcgcgcggcggctgcggactgggccagctgggccgaggagagagaagagaggttttgggccgactttcggcccaaagccaaaagagactttttttaaaacctttttcaatttaaattattccttaaatgcaattccatttattaaaaatacttccttagctcaaataaatcccagaaaaatctaggaattatagaattaagcaaagtatttaatgaaattttatctggccccattttatattggaatttattaattaaaattagattttcttttcaagacttttaaaattatttctaaaaattccaattaaacaacaatttatatattttgaattttcagggtgtgacaactatcgggaagcactgatcggggcattcgatatccacaggcttattagctactaaatggtaattggcacatacaatttgtccggttgcttcttgtggcttttcgtagggggtggctacctggcgactggtcgcgcctgccccatcgcacgcgagtacgcgacccgcccccactcctctatagtctctatagtactagtataatatactactagtagtactagtattactattactactacactactactatcagtactagtattatttatataaaaaatatatttttatatgtatatattgttgatgtataaaaaatatacacatatacaaactttgtatatgatgtgtacaaattttgtatacgacgtgcacaaactttgtatacgtacgtattaaaaaatcgaaaaaacaaaaaaacatcacatatacaaactttgtatacgtacgtatataaagtttgcacacatcatatataaagtttgtatacgtacgtatataaactttgtataagtatgtatgaactttatatacgtacgtatataaactagtttgtatacatatatataaactttgtatatgtacgtataaaaagtttgtatacgtatgtgttaaaaaaacgaaaacataaaaaacggaaagaaaaaaccgggaaaaaaaccagaaaaaccaaaacagaaagagaaccccaaaaaataacggaaaaactaaaacagacagagaaaaaaaagggaaaaaaccaaacagaaagagaaactgaataaaaccggagaaaaccaaacagaaagaaaaacgaaaaaaaggaaaatcctcccgtgcggcgcgccatccaccgcgccctctccgcgcgccacactagcgttttcgcttttcgtaaacctgctgcgcgaaattgggttaggcatttgaaatagaataaaaagtatactttgactcccttaactattatttgagcatgattcacgtccttgtcgacgtttgatatcgtgactacggaatttgcatagtatggagattgttagtaccagggtatatgcgagattgaggtaaaagagatggagatagggattttatacaggttcgggccccttatctgacaggtaatagccctactcctgttgaccgaagccggtgttgctcttattcatcataatcacatcagtacaataattaggataacttatgtagccgtcgttgacttagcggcatggataaccaacacgtagtcgatgacagggtagtcatccctcaagtccgcactcagcgagatcggagatagcactagatccctcttgttggcctctgcagataccatattgggtttgtctaggcttatctctgatatcgatatccggcggcttgttttggcacatgttagcttgtgaatcgtgtgtcgatatgttgttgttgttgcttgtcccatctcctcctagggggcttgtatttatacccataggtgtccccttgtccaagtagaactagggagaccaatatggatacaatccgagtagtcctgatagtttccatatataactctatttgtcattccttatccggaactccttatgtatacgaggtatgattccgtataagacatggtatgtggtgggccctaccgagcttagtcaactactattaattatgtggtatccataaccatgacagtcctccaaccacaaaaccggaaatattgactcctccaactattaaaccgatgcaaactatgtcccttggtgattttggctaacgtggcgcctacgtggcggtcccgaccgggtttttgtcctacgtggcgcttacgttacgtagcattattgtaataaaacaaaaataaaaaaattgtgggaccatatatcgtccacacaaaaatgtattgtgggggccacatgtcatcctccctctcctttctttcttcctaatccttccttcctctctccgccccacgcggccacaccagcgcgcccacaagctcggcggcaccgcctccccgt

SEQ ID NO: 60691 - DNA, 4023 bp, Oryza sativa
agcctccgccgccgccgccgccgccaccacctcctcgtccccgtcatatcctccccatgtcgcttcctgcctccctccgccaccgacgcctcctcctccacgcaaagggcagaggtggttgccggcagcgccccactcctatgtgcgtcggcgccgccaccgctcctccacaacacacgcgcgtcggtgtagccgcccaaccaccaccacttgtcttcctcatgaatcgaacatcacatcgctatccccatcctatgctcgccccatgtcgtcgcgtccgcctacgcttctgcccctgtgtttcgtctccaaatccccactcgccgcccccgtccccgtggacgcccaaagggaagagaagggggagagagagagaaaagggagaggtaggaaggaggaggaagaaggaaggaaaggagagggagggtgaaatgtgggtcccacatattttttttatttttattttattataatgccaagtaggacaaaaacccggccaagaccgccacatagacgtcacatcagctaaaaccaccaagagacatagtttacaccggttttgattgttagaggagttgatatatccagttttgtagttggaggatatgaatcatattcaggcgatagttgagggaatcgaagtatacgttttcctttgaaatacttcagacctttgttgggccttcacttcccatgtttggactctcccacaatttgggccatatcagatgggccctgtattaagcccaacaagaccgtagcccaccacgcgccgtgacgagggccccggtttgcttagcgacacggcaactactactaaatcgtgcgggcccacctcgcagtgtcccaactcacacgcacaatgcgaccgcgaagccgcctccgctaatccacctatttttattcttctctcccaccccaaaatccccaaatcccgacccgatcaaaatcgaagcttccgccgagttccccgtcgccgactcgcctggatcggcccgccgtcgagctcgcccccgaccatccgctcgattggaggccggggagctgcgtctggtggtgaatcgcatccgccgcggagcggttcgatttcggcggcggatttcgcgggggtagaggagatcgaaggggggcagagcagccatgagcgaggtgttcgagggctacgagcggcagtactgcgaggtgtccgcctccctcttccgcaagtgcaccaccgcctccgccctcgatggaggtaaccgaccgatcccctctagtctaatcccgatatgccatcgagatcttacgcggaggagtttcccccttttcttggagtacgactaatcgggtgtccgatttctgcagagaaaaagaagcagaagctgtccgagattcagtccggcgtggaggaggctgagtcgctggtaaatatcgaacccatttctttgggatccctaacctgcatcattatgaggagtaccattctagtattgacttacattctgcggtaggttagcagttaaaaaaggctggtgattttgatatgcggatgcatactttttagtagatacctgctatttataacggtgtaaatgtatgtttcatctggggtacaggtgcagtatttaacgttttatttgtatgggtttgtgcatacagattcggaagatggacctggaggcgaggagcctacaaccgagcgtgaaggccggtttgcttgcgaagctgagggagtacaaatctgacctcaacaatctcaagagtgagcttaagaggatctcggcgcccaatgcaaggcaggctacacgggaggagctccttgagtcaggcttggctgacactctcgcggtgagctccatgatttgtattactagctcaatttgaccatattgcagattttaataattggcagcatctagttttgtttgtccattgtgttgctgtagtttgtagttttaatctatatcacaataggtgttttacgtatatcacgggcacaaacgactgacaggtagcattcatgagctcataatcactgatactagctgtacttatatttttttaattgtgatacttgttattggatggttaattgaggctgaattaatggtggttgttttctttttttttccccaaatctgtaccatttatgtatgtatcactgacaatttaatggttcttaagttctgtattggtatgtgattaatagtgttatgctgaacttcagttagaataaggtatttaaatattttaatatttgtgcaatctggattttagttttttcattgtatttaaaacctttaaacaatgagagcttcattttgtaacatgttcttgccactcaaggtttttcctatatgtgttttttgtgtctgttacatggcaacgttgtaattcagtaggagtgtatatcatcagtttatttccagttgtggtttattttcagatctggacccttactgtcaccattatcaactgtactacagatttcacacaatctcaatgagttctctgtaactattttgttttgaaatttcctacataattttctcattcatttgttaatgtggacacaattgacagatgtgtattatacaagatatttccattctgatcttcatggtacaattctgtagtcgcatgagtagtgagaactgtttcttgtcaaatttgtgtggtccaatttggtccttgatgaatatccgttgttctgattaaaaaaaaatgctgatctgtcaggagaataggaaatcggagttaacaccctcagaaactgtcctttctactttcagtaatctgcttaatgtttttgcgaaatgaatacattatccagccaatgtattcctggatgttgaaaagcttttgggaatgctacctttgcattctttgtccgtcatatttttctgctgatataatatcttatatcataatgcctcagcattacattgattctgatttcttaaacattctctcaaagttaatgccgttttttcttttgttgtttttcatgttgtaactgggattattatgtaaatcaggcgtctactgatcagaggggaagattgatgatgacaacagaaagactgaatcagtccaatgataagattaaagagagccgaagaaccatattggagacagaagaacttggtgtgtcaattcttcaggatcttcatcaacaacggcagtcactgctgcacgctcatactactgtacgtattctgtcataacctttttacacatttattggatttgccttcctattaatgtcatattcattcgtcttctgggcatgtcttatgtttattatttgaaccatcctgtgttgtctggttttacaggtaaatatggcataggaatactattacttaggttctagatttgttgctttgctctatcttggagaattggctttttagcaagttaaggttgccttttgcttggcttttaaagttgacccaattaattccttgtttggtttggaggtgattctacaataggtgtggaataaatcctctccaatccctcctccctcttggggattaaccgaacaaggcctaaaggaacctaccaaccaccacatcaaaaaccacttacaagttaaaacaaaatataagtacttcattgtttatactcttgaatgcaaagagcaaacagtagacgatgcatatgcatgcaaagccatggtcgacgattcattgttgaagtgaatactggaaaattcctgtataaaaaatgtgctatccaaaatatttgcagcaagattcacatcattaacagtaatagatttagctgcaagctaatggcaacagtaatcatgcaatgcagtctacttatttcatatatgttaatggcgtcatttttctcacagttgcatggggttgatgataatgttggcaagagtaaaaagatcctggcggcaatgtcaaagaggatggacaggaacaagtggatcattggggggataattgcagctcttgttctagccatccttctcatactgtactttaagctcgcttattgagcttgctttctggtagggtcttc

SEQ ID NO: 60692 - DNA, 4514 bp, Oryza sativa
  unsure (1)..(4514): unsure at all n locations
ccatcttctgcattataaaatagaataaagctgccagttgagcctgaaaggttgaaagcagcatgagcagggaagctcataccccggaattcaaattttggggcacgtttataattcaaatccaaagacgaattggactcctataccatatatctcccgcgtgctgtatcctgtatcccccttgcgtgcaccggaaatagctaaatcgatatgcgccgcgcgaaaaatcgttggcttggacgcgaaagcgaaaccttggagcatcttggaaggaaccaaaggagccaaactcacactcttcaccagccgtgcgggacactataatttctacccctcgccgagtcgccgtataaaacacccaaactccccgccgatgtctcaccggaaagccggcggcgacacatgtcggtcggcgagaaagcggccggcgacggccagccgaagccgccgtcgcgcagcgcgcggttcgaccgcctcttgtccgggctgggcggcgggccgctcgtggacatcgagcccgacaaggtgaagggcgagctccggcggtgggccagggcggtggcgacgatggtgcgccagctgagcttcggcgcctggccggagaagggcggcggctcgtcggagcagcaggaggcgggcgacggcggatcgcctggctgagccgccgatggcgttgcttcacttcacacgcgtcaatacggaaaaggaagcactggtgcggttggcaacagttgtgacaagcagcagatgatgcacattccagttgattcgttacattgattacatttattcgttcaagcgacaggcgacggaggctgtagtatgtatctccaaatctcttctccattctgccagacataacaaatttgggttgcataaatcatggcagtcatgtgaatagaaataaacacgtgcatcgcaattctcatgtaagttgatcgaattattgtattccaaacaaaaagactctgcgcacaccttcattgaatttacctacgtatcaccatgcctgattctttctgtgctctaatctttgttagtgaaatctattctaatttcagataatacacagcacatacatggggggatacatccccagttcaactcaacaaatatatatagttagaaggaaaggaacacccttgcattcttacattgatgttgcagtcttgcaggaccttataaattatatagcgacatctacatttaccaattggaacagttagtggttgcacgatgttacctacctacaatttgtacgtgctcgcacaagacacatttgtgcactatcctaatctacaaaactactgccgccttatataaaacctggatacctcactccaatttcgcatccagttttgcaatgcttctcaggagttgtttggagcagacattctgcgcctgagctacatatcgcccacgatttgctttcacccatgcaggttcctatttgacaaattaagtcaagaaaccacatttaggtgctttagctatatagagatcagtaaaaacacaaagataacacataaagaatagaaaatcacctcgggaacaaagtgtgagaaaccaaacttgattaagaagagagcatgctccattatgaggatggctgccagtcctggctcaattttccatttaccctcctcatcatacagacaaacaagaagcaagcagtttgtacagattgccataacaaccaagaactgaaaagaatttttcacattgagtattacaaggcatgagacatgcaagtatatctatgaggaatatatattaaaaaaactgctaatgaacctggaatatgttcagccaagctccaatcgtagctgcatcacggggagcaggtcttttcaacatgaccaacaacttcaatgcatccgctctaatttcagtcacattattctgtcatgaaaataatttaagataagtttagcacacacaaatcaaacaagaacacacatgtatggcatgcgctcgacaagagggaaggacacaagaagagagagaacacaaatagctgtgatgaaccacataccagagcagcaaagcagaatatcgacggaaatgcacaagcaaacatcatgatcatcccaaactgaagagttagctcaagaaaatctgtgatggactcaacaatgtaagaacataacacagacatccaaaagaactgagaatagacaggatgattatttattgctgttaccatcaaataaaccatcttcaagttcttctccaatgcttgcagtatacgagggttttagatattctttctctactcttgtagataaccgaactgacttcccagctggcgattctttctcatgttttttcttgctacaagatggaagagatttcttacatctctgaattggtctggaaaaagaatagtaggacaaacagatttggctgcagaacttactgaacagctctatactttttatagctataattgaggtaaggaatggaattctcaatcagattttccaatacctgcaagttaatatgtatcatcaaaggaagactagcatttatgattataactaatgatggaataattacaatgcagacatgcctgggacacaatgagacgcttgattaggacttgccggagtgccataatgttgcgctgcaccgaagcatggtaaaacaatccaatatatgattgcataaagtaaagaccaaagacctgcatttgccaaaagagtaagaaacctaacataaagcgtgaaccatattcttggcatcattgtgtttaccttataaaccaaactatcagcactagactgttccccttggttgttttcatactttattagagtgacagacaccttgccacctatccttgtgtaatactgaattgcagcaagatacactgcagttaacacatacctgcataaacatcagcaataagaactgatgcttcatattttagtggtaaccataaacaacaaaataaaacataaggaatagatataaaacaattaggagaaaataagcttcaggtcaattgcacatcgttgataactcaagaatcatgaatagatcatagtgatattcctacaatcttaccttagcgcctcagtttttgtaatcgcatatagatgagcataggccaactcaaatggcagctgaagacaaatgatagccaaaacaatgatagcattattcctaattctaaggagaacaccaaaccactcatttctttgtactatacttttctccttgggagcaccaaatttcctnnnnnnnnnnnnnnnnnnnnnnntagaaaagcttaaagggtccagttcattgcccatagttttgtattccgaaaatgaataatttataccccatctgttgaaaacatcacataaaagaaaggcatgtttgtgagcacggtcttgaatatgtttcaaaggaacttaattgacttagatatatacagattgcatagaaaattgcatgctacctagcaaggacagctgaattcttccgtttccaaaattgcaaaaagaagacagcccaagaaataacgaagaaaaagaaagctggaagaaccaaccactgtaatgacctgaattcagacagcagagaaaaacatttagctgacgacaacaataaaatcccaatgatattttctagatgagaggtgcatacccaaaatctatcagctgggttgcaagtccaaaaacagctggaaagaacagccaacgtgtatacattccgaggaaagaaaaatatattgcaatctgcaattccagaattaaattttatggagtagaataaggtgatacttgatttgcttcagatagaatagttcataaattaaatatggtaggtgtaacatgtgcaatcacgctggtctacctttgttccaaagtaagagtaaatttcatcaataggttgccatgtgaaatcaaaccacttgagtgcccagcttctcaggagttgcttccttttaatttcatctgcagcaaaacagttggttatctaatactaagaatttcaaaaataattcaggttggtttaccatgcaaagggaagactagctttacgattccttcatcttccagcctggttaagagtgactcattttgagtccagtggaactctttatcgtcaaagctgagagttatatcagaatcggtcttgttcacctgcaagtctccatatctacctactgtcaaataaggaaatatgaagcacaacaagactaatcactttgtacattagctatatgttttattcatatctcatgtcaagcgaaaagaaaaactttgagacttgagagaataaccatagtataagcagaaatatactaaaccactttcctatttgcacttggcttgtttcttaaatgcaaatataatagacaggtcatctgatgcataatgaactatacttaaatctttgaatcagcagtgctgcaaaaaaaaaatcaattttgcaaaagccaggcaggacatacatgccatccgtgaaataccggtactaacaacgaagcagtgctggtctagaaaaatgccaactta

SEQ ID NO: 60693 - DNA, 2641 bp, Oryza sativa
aaacaatagattggtctgcatagttttttatttaacacgaattttcattacgatatatgataatgcacgatgacacaattcatctaatcaacgacggatcttttcgtcaaaaacaggaaattgtacagagctatctagggattacaaataatattaaaacagatctgcaggaagaatacagaataatacttcaccaggttgtagcatccaccataagggagttttttttttaaggattaaaatctgtatggagttgtttatagtatttattaaggaagctggataagagcagtacaataatggactataagctaactataaacatattttaaaattttaaagagataaaagaagagagtgaggagcagacaactgcagcacgaactctaatacgtaatgtgtatgataggtgggaccatttattaatagtgtagtaagcaactattgtataaattggttatagatgatttaaagttagttgttgcctatgttattaaacttgttataatgcgtattaatcggcggtttggccggcttggcgcgtatagttcaacaggtagtaagataaacatattataaattaaagctagctactagctagctgatacgatgaaatgtctaatcgacgaactaatctatggatcacacgcaatttgtatataaaattaatgtttgaagaactccgtgtgactacacaaaacctcatgtagatacgattttgtagagctaatttttaaaaagaatttaaaatcaatagttctaaagtgtagagataattttcagaggcactgcaaatattgcctaaaacacttttaattaatctctcgacacttttatcataatttattaaatttattttgtagatgcactttttagtactttcaaatttgcatggtatataaaggtattttttttagacattctaatctttatagaggcacttataagaattttaatctatgctaattaactagataaaagtaacatggaggacatatgtataagtaataatatgaggttgagataattagaccattcaagttggaaatggtatatttaagaggtctggagtttaaggattcgtaagtgcaaaggaagtcacattggtttgctacggttggcatagatacattctgtaaaatgcctcttcatttatagagataattcactataggatatttataaggtatttttgaaaatgtctctatagtattgtagagacagttaaaaagtgtctctatagtatctgtaccaccactacttttgaactttttctaaattagtccctgatattttttttgatgttatgtaatagtctaatatttgtttgaatcaagtggacacaatatattcaaataagcaaacaaagaatactagcatatttgataaaaaaatgttgtctatgacatattattatatattttattttactcatagcaaagcattggcattttgctacttagagaaatgtctctacaagatagtttgttggctgtgtttttgctatttactttctagtataatgccgaagtaattagataagtaagtttctaccagaagcatataacagcaaaaatgcatgtgcaacaatatatttgctgttttttatctattattttttgtacataatatgtggaaaacattttacagattaagctatagcttcaaattaataacatcatatagattctaagaaaagcactaattattttttgttgcttctaaacaataaaggtgaaatatatgcctgttaagtagctatctgactgaatttatggttaggtggcaatgatgttaagcatgtgaagacaaagtcatgtgcctcctaataaaaaagatagagtagatagtacaacaggacaaattcatgtcatctagcgagttgaattacttgctttggtgagttttttcatgcgcaagtatctcccaggaaacaaagattcggatcttctccgctgttgtttagcctctacatgtatactgtttattagttgcaagtttattttagatcaagtaaacatgagccaaatcgtagcgtgcatatgcataagaaaattactagtaactcagaaagacgactagcttttggtcactgctttgtactgttttttgggctataacctgcatcttgtaaaatatatgtaatcaaactctgaactaatcttgtaaaattggttgcctatcatcatcgatgtggtcctctacatcaccctatcatatacagatttgatgtggtctcctctatctcgttccgaaccatagaaaaaaaatcaagaaaaaatatattatgtgcattaatttcccctctctgtagttttggtctttgttttcccctctttggctccttggttgtcgtcattgttttgtcagtttatctttacttcttcagtaccaattttgcatccacttcagcacccctgctgtagcattttttttgtcatcttgctctgctgaaagcttcatctacagacctactgtttcatatcgctggagattttcagtaaagcttgttgctttacacggtttacctcatactgcttccactgaatcagtgcttctgttataggcaagagaatcaaatgtccaagaaagaagcaaccatttttcatgtgattctcctaatgtaaccaagtgcaaacaa

SEQ ID NO: 60694 - DNA, 1647 bp, Oryza sativa
gtcaaggagccctttacccttctgatgactcttcagtctgcagccaaaggcaaaaaaggctatagtattatgcatagccccagaaacaagcaggagccaagctttacaccagagaccaaaggaagccgaaacttttgcccaatccaagctattattaggagcattctgctttcagagaggagacgatctttgaacctttgatcattgcatttttaaagttatcctatcttctgcgtctaatatatataagataataagactccctgcttaatcataagaaaaatgggacatctgttaatgacagaatctaacaatggaactgttataaaaaatatatgactatacatatactcctctattttagtatttagatattacaaggcgattacagatttggacgagctagtagtatttatgagagcgcgtcagctgtgcatgcaagttcatgtgccgcccactcatcatcgtctttttcactagcgagcaaccccacaggaacagagaaagctagagagagagagagtgagaaaccttcttccattactactagtctactactctctcgctctttctcaagagggagggggagagagagagagagacagttactagctctatatattctcacacagctcacaggtgtaggagaagccatgaacatgaggaccatcatatccctcatcccagatacatgatctgtactgtctcctcctctctagcttctctcctctccctgctgtgccccttgctttgttgcttggtcaattagagctaagcagcaagctagcttcctggaagcaaggccggcgcctggctgggacaagaaccacaggaaccacagctgactgattgatcaatcaatcaatcttctgctgccctgctgcctcacagcctcagcaagacagtacgtacaggtagctctactattatacagctgtatgtatgtatgtgtgtattgctagctagctaaccactgtgtaatagcatatacaccactagtaatatgtagaagtagtactgatctaatactatatagatagctacctctctacaatcttcttctatctgtagcttttagtttaattggttcttgaactctacttctgttgcgtgttcagatcaattttggccctcttgaggctccggccggtcgccgactcgccgtcgtcgaaggtgctctccggccggcggagttaacattgagcttgatttcaagccgcgctccgatccgaccggcaaagcgccgaagctgccttccgtttgtttcactctggtctctgggggctcgccatcagccatccgtaccgagctgtaggtatgaacagaggagatatcctgttccctgtatatgcatactatttcgatacagtagttttctcgacatgagatttcatgcatgcagaatttcacgctcgaagttacctaattagaagtaatccatactctcgaaacaacctatttaagtagcactactatgtaggaacagaataactgacgtcgttgcccgggcgtgtcagttaacaaacgacaaagatgtgcaacgcacagcctgcaagttacataagcatccgctcgttcagttaagctggcagatcgaccacacactagctttgatttgcgctaacagtgtatcatatctaactagct

SEQ ID NO: 60695 - DNA, 4853 bp, Oryza sativa
gaagcggagggcgtccacgtcagcaacaagcatcacgttcggccaccagccgcaccaccaccacggcgggcgccaccaccgccgggtacgagcctgacatggaagccatggcgcaggtgaaggagatgatctaccgggcggcggccatgcgccccgtccacctcggcacggaggccgccgccgacaagccccgccgcaagaacgtgcgcatctcgagcgacccgcagacggtggcggcgcgtctccggcgggagcgcgtcagcgaccgcctccgcgtcctgcagaagctggtccccggcggcaacaagatggacacggcgtccatgctcgacgaggcggccagctacctcaagttcctcaagtcccaggtccaaaagctggaaaccctaggcaccaccaccaccacgtccaagttaccgcagcagtattacagcggcaacatcaacagcagcaataatcaccatggattcctcggattcgcagcaaataacaacaccatttcagctggctacgcaaattctaatgctggaaatgcaacgaaactgttgtagcactgtggctagcacaagtacttgatacgcacaacgtacgcgtggtctcgtcgtctatatacatgtagtaacatgctgctgttttctactgtttctaggcttggtggtgatcagtgtacgtacacacggcacataattggagtcttaattagtggtggagtgcatgctgatttagttcgtggtcatgttcttgtgcaagatttagatttataatcttccgctggcggatcagctgcatggagtgagaagttacatcaaattaaaggggccatctgatggttcgttcaaaaaaaaaaaacgggtgccatctgatagaggaaaacatgtggttcaataatggaaaagagtggcctggacgagcaatttgcgagtgaagatttttagctttcttttttttcttaatttatttatgcatgaactgagtgagtttatcgccactcgaaagtatatagacgtggatcgagtaactagtacatggatattcagatttgtatggttgttgcgcaacgagacactatatataagataatataattaattaaccgtccttaagcttcgtttctatttcacatatgtttaccccgcctccatttttagagttactgtgttagagtataattaagtgaatcgattgtcgttcttaatcaacctaaggtttcagggacgaagtgctaattgagctgttcatatataactcgatattgcgcatgcaagtgtgtcaattgtgctgtcacttactaagctactgtagctgattcgatctctccatatatgtatcattgggtgcatcatgtcatgaggctgcaaatcttgggctgttcatgcttgtgcagtagtggtgaatctttgtgcttccgattttgggcatgataaaacgcttttcctctcagcttttgtgtcaacgcaacgaaatctcaattattccaagtgcaaaagagaaatagagatgtaaaggcttatatacttttttagaccaaagaggagctatcttcttagctagatgctatactatgcctctctatccatctatctatgaataaatatcccttctttttatcttatctatatatctgtatgatggggcaggctttctgcatgctgatgataaaaagtttgggattaaattaacacggaaagggccttttgctaagcacccctttcctccttgcaaatgaccatcgatgcactgcatgcaacgagcaggggaaaaccctaggcactttgcagttctgcatgcatgcatggatctactatcattcacatttcacagccttcgtcgtcagtaaaagctgcaggtcggtgaagtagtactactagtcaatactcatgcaacggtgcatgatgtagctagaataatagtagaatcatggcaaacactccatgattaaggagcccaagctaataagctagtcatgggaatcccgaatccggacacatactttttctatctcacactagcttggtctcctccggcctcttgccttgcttggaccaaagaaagaaaaagttgacgaacacagcagaggaacagtggacgaactgtgatcgaacggaggatatggtcagcacaacagtgttacacaatccttaggtattttccacatgtttccatgtagaaacagtatacttaaattagaaaattgagttacaaatcgatgaggtttcctatgtttttcagtgtctggtccgaaacgtgccctgttttctcatattttccctatgttttttcttactacttttgtaatgtgggggttgttcacagtcacacacacacacacagacacattctgtagccgcggtagtagcttttgcgtgtgccgtgccgccgtgcgggccggccttgttccgtttattcctgcgtgttttcgctttccctttcgtgtcccggaatcaaaattctttgagcagtgtgcgcctatccgccatgagagagaaaccgagaatgcccctagccgcggtgcagcggctggcatcagcagcacgcgctttttgcagggggacgacgctttcgggcctcaggtcgcagctagcgcaggagcgcaggagcgcgcgaatggccgcacacgcacgcacgcagtcaggcgagcagcgtgtaccggtgtactcgtacgtgctgcgcggccgcgtgcagcggctgcttcggttgggctgcatgccgcgcgcgccgtcccggcggcggggcgaccgatgcggcgcgcggcgcggtggccaaaagacattccctttcttccctcgcgggtagctttggggctgaagaacctgaacgccccatgcgaggacgtactgacacggcatgcagctatgatctactacaagtatgcgctcctcctgacgtctctctctatcccctcccctggactcgtgtcgacgacatggagcgtgcgccttgataagaacacccccccgaaaagccgcctccttcctctgccagcgccctcgttcccctcccctcctctcacatgcgcgcacgaattgtattttatcttctgatagtctaaactaaagacgtgttttattatcaaccatactttttacatagaaacacaagcgtcgtaacacgcacacatacacctatttctatgagcatttctaaaagactgggctgggatatcttaatattaacaaaatcatcctaccctaaatagcatctccagaagactaggccggtatatttgagattgacgaagtcaccatggccgttgtcgactaaagattagatcggcatatattgagattgacgaaatcaccctacccctataagcacctccagaagatgaggccggtaaatcttaaaatcgatgaagtcaccacgggcgggccagcatggtgaaatcaccctacccctatagcacctccggaagacgagggcggtatatcttaagatcgacgaagtcaccacgggcgcctcgttatcgactaggccggcatatcttgagattgacgaagtcaccacagacgcctcgttgtcgactgacccgatatgaggacctccggaagactgggttgattgaggaagtcaccatgggtgtcttgctattgacaggtacattgcctaccaccgaaagagtaatgagccgtaaatgcaagtaaccatgtcaagtttataacttgaatcctggtgagctgattccaccatgtgtaacctaaccagttaaacttgttatatatcatttataaacatactgccgcatttggcttattaagttgagacgatcaaattctctgtacaccatagtaagtcttaaaaaaatattaccataattaagtagtagctaaacttcttttttttaaaaaatggaccaatatgattttttaagcaactttcatatagaaactttttttttaaaaaaaacaccgtttagtagtttgaaaagcgtgcgcgcaaaaaagagagagatgagttaggaaacctgtggtaagaacacagcctaagactacaatcaaacaattgtcaaaggcagtgtagacatggtaaattatggttggtttcccaaactgttaaacaatgcgttttttaaaaaaagtttctatggacaagtttttttttaaaaaaatcgtattaattcatttcaaaattttatagctaatacttgattaattattaattatgaatctattgtttcgttatcgctttgtttttgcgtgagaagggaggggtttccaacccctaaaaaagcacagcctttgagctctgttgaatgttgatcatcagttctatggagcgtcaaacttgcatctggactgctgaataaaaccggcaatcttgaagcgagctatcgatcgagtatgcacatggggattgcacatgcctggaaaatacaaagaacaacaagctactatttattaaacctggaccacgtacccacgaccttaattcggtccaaaattcacaataacaaacaggaagcaaagtacaccacgggatataggcatggaatttatttaaggaccatccatgttggtggcaacataattgacttttagtgtattgtattattattcagttcccttcctgatcaattattcccaggaggaatctaatttgtcaaacgctccgtttctcacgagattgagagctcgcgacttttctcgtcgtgtctcgcttgtcccggttgtaacaaacaaactcgatccatcgatcggtccgtcagttccggtgcgtacgtgcatcatccaaatcaaccggcgtgtgatcgcctgatctagctcggtcaaaggcgtacgtggactacgagtgtgaagagaatatataaaacgcgatcgagtacgagttcttttcttccttgcagctttcatggcgct

SEQ ID NO: 60696 - DNA, 3362 bp, Oryza sativa
accggcgtgtgatcgcctgatctagctcggtcaaaggcgtacgtggactacgagtgtgaagagaatatataaaacgcgatcgagtacgagttctttcttccttgcagctttcatggcgctgctagcttcctgattgcagtagcagactagctaggccgtttgatgacgacgcatgtacaggacggccggcaataattaatggacaaggccagggaccaaaaacgtttctccccatattttccagaatggtactatcaaattaagtcacactattcagagctcaggttttatttcggttcatggttaagggtgtactcttctgttttgtttttcaacttctactttctagttgttgtgcgcacgtacatttcccaaaccgttcaataacacgtttttttttttgcaaaaatgttactatataaaagttgtttagaaatagaccatggtacctttctgtttattctgcgtgccgagtagaaaagatttccaaccctcttaaaaaacacgaccttagttgtcagccatgtatccagattctagaatatagatatcaacataatgcatagtagtagtaattactccctccgtctcaaaataagtgcagttttgcactattcacgttcaacgtttgaccgttcgttttatttgaaaattttttatgattagtatttttattgctattagatgataaaacatgaatagtattttatgtgtgactaaatattttcaatattttcacaaaatttttaaataatacggacagtcaaacgttaggcacgaatatctacggctgcacttattttgggacggaggtagtaagtagtaacacgcaggttttgattggttcgtggttaaagtcgtcaggatctccacggcggcgtaggatagggtcaaacggtcggtgaccggcgttcgttcgctttgtcatcctgagctcagccctcgggactctgaatagattgggaaccgggcacgaaggctgcgagagcaggtacaatagatagccagctgcttttgtccaccgctaggcctcgtgccaaacctcaccgcacgagctagtggcagatcggcaatagccagcctgcggattgaccggttctacacgagagtccgggctaagctcgatcgatcggtcggggacgttatggttgccaatcaattcgatcaggaaccgtccgtgacgcacgcgacgcgctcgcgcgcgtttccgtttcctccctcgcttcccggcggttggatcacagtggttagttggttatacgtagtgattcagcgcgccgctcgaacgtcaggtcagcgcgagccttcgaggtcttggagagcagatagatagatgtgcaatggcgcaatgctcacgtacgtggatagcggagcgcggctgacctccggacaataaggccgtggcccgtggaaaattggggaatggctgtgctcatcatatcgtcctatcctatctccgaatgattgaggaagggtatatatgccattggccatcatgattaaaaaaaaaaaagaggctgcagaccatcagcctatagtgttgtggtctcttgtgcgccgttggattggatgagatgattcggatggatcatatactgccgcatctgttgcctaagagcatcttcaacagcctctccattctaattctcgaagctaaattttagctattttagctaaaaaaatattctccaacagcctctccaactggatggctaagccatatgtctggccaaaacattccctccactagccaaatttagctagccaaaagtgccgtttttttgacaaattgacccttttcaaaaacttaattcgaaactaacccctgccataaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgttgaggtgcccaacctcagcgccaagtaagttggcgctgaccttggctacttagagcccggccgaggccgccccagccagttcttcctccgttttttccccagccgcccgcctagggttcggtcgccaccgcattctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaagtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagttttttttttatcaataatgtgtagtatttgagtaatgtacttatttattggaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtatgcatggaagaaagatggtaggatagggaagaaagaacttatagaccttaatgaaagtccactcatagaatcacccattaactgtcacgaactgtcggagaggtgtagtaggaaggaagaattgattgaggaagacgtggaggggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagttaatgtggaggagaatgtgccggtaagagaggaagaagatgttgaggatggtcgggaggtaggagatgatgt

SEQ ID NO: 60697 - DNA, 4375 bp, Oryza sativa
aggcccagaccagcaagccttctggatggcttgcgggctgggacatcagcgccagccataatggcgctgaccgtgggacactcagcgccagcccacctggcactgaggtgggacttggccgcaacccccaaggcccagaccagcaagcctgctggatggcttgcgggctgggacctcagcgccagccataatggcgctgaccgtgggacactcagcgccagcacacctggcgctgaggtgggacttggccgcaacccccaaggcccagaccagcaagcctgctggatggcttgcgggctgggacctcagcgccagccataatggcgctgaccgtgggacactcagcgccagcccacctggcgctgaggtgggacttggccgccgtttcggccgtggcccagcccagcaagccttctggatggctgggctgggacctgcgctgagctgagtttggacatgtcagcgccatttagcatggcgctgacgtcccagccctgctaaactttagcaaaactttgcacacaacagaggcaaacatcaaatcacagaaatttacaggcagtaatatatccagagaaccatacaaaacatacatccatccatcaatcccaacatcattccatacatccatagaatgcatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggtccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtgccacatctggaactccactgcatagaagcagatcagtgggcaccgtaaggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtttccaccagagtcagggaacagaatacttccgaagatgtacagcacgtacgccctgcagtatcgctgtactatagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctatgtgtttacatgctctgctttgaggctcctgaactttgatttgagatatctctatgatggatgatctatctatacaaactaaaatcaaagaagaaaaaataaattcgatcataaaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggaggacaacagaaagtaaacattgatgcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgactggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaaaatgtccttaacttttgtgggccacttctttccacacaggatatctacagttgcctctttgtgtctatcgacaaaccaactattgcacttcgaaaatgtgtatgccccaatagctgtaaccggcagtttccgaatgcctctcaa

SEQ ID NO: 60698 - DNA, 12782 bp, Oryza sativa
  unsure (1)..(12782): unsure at all n locations
ggcaggctggaccgtcacggttttcttgtgttgccaggcctgaaaagaccaaatgaacagcacaaccagtcaagactaagagagtgccacgggagacatgcatatcaagagaagcatgccaaccaaccattaattaccagaatgcttgtaagagtggacattgtacaggtggctgggctccttgctgaactgaaccttggcattgccattgccgaactgcttgaccaggaatgaattgttcttcttgacaagctcccagaccagagaatctggaatcgtggccatttatcctaacctaaagaatccacatcaacacccggatgaaacccaaaaccgaaatgcgacacaacaggaacaaatataagactcctaatataagagctggtccttctggcagatgggaattcagacagatatcgccgccatgtctgatttggcgactcttcagagccccccctccatcccaaccaagcatttcagagttttctttcttctctgtttttgggggctatggaatcaccgccatgatgtaatttttaggggtatgcaaaagtctcttcccctttggtagccaaatgtttagatgaggcctccttatgggccgaaaggctaaatgtaagcgatcgtattgtggtttccgcctggaaggaaaccatctcttcctccctcagaacctcttccccctgatgtaatttgtatcatttcaccgtaacctagagcttgcttattcttgtagcaccaatggcgttctattcagaggttggagcaattagctccttaacttaccgaagaagacatccatttagcatatgattaatttagtattaattattataaacttagcaaatggattcgtttgaatttttttaagatatatatatatatttttcaaaaatatcatttagcaatttcaaaaacgtgccggcaataagctagtaacccaaaagctgaaaagaacatggcctaaacgagcatatatatgatgataagaatcgaacacacaaatcgtagacctgaattccaatttccgaacagaccagtgaatatcccattagcggatggtgataaatgatttatcactggacccacataccatagacacatgaagacccacatattatagacagcgagtggtaaataattaattgtcacatcttgaaagtggccaaaagttaaatgtccccacaccagcacgtctcaagcgactctaagcatttgggcagtaacaaagcgagcgtagctacgaacgtcgaatgatctaattcaagtaaaccaccagcactggatggatggagagggcaaagctaaaatcgcaaaaatggagtctaaactgatcaattcatgcagcgaaacgaacgcataacaggctaacgccaacagaagttacagaacaagccatgctacgagaagattgcaatgagtggtttcttcttaccggagattggagtgacgcgcgccgccgatctgcctccttccggggtcacgatctcgcggcgctgaaaaaaaaaccctagccttgaggtgggtggccaattcatgggctgtagcctgtagtaaggtggaatgggcctgtttggtagcggacgatgttggatgggctgtaggcccacgttagtgggacacgtgaactcaagtttccagttcaaagatggtacaagggggtcggggaattaaactccgaccccgcttaactgtcgtttgcacgaaaaattttagaacaatgacagtaaacatcgaatgatattaaacaaaattataaaggttacaaagcatttctagaattttcagtccgcccgctccaaaggaaatatttttggcttcaacagtagtgaaacctggatgaatctgaacataatttgctaaaattcagaatttcgaactttttggccgaaaaagcttcctgttggtggcttggcgctactggtagggccgaaaaaaaacgggaaatttcagtgcaaaatctgtaaccctggtcaaacctacacattatttttaggtcaatatttgtagtaatatcatttttcacctagtgaggatatatccagaaaatatgcattacgacttacgacaatgctgaaggttcattatcatttttatatcattacacaactaatgcatgaaatcgctcattcgtgtgactataaccatcatgttataaatggtgtgcaagataatatattaacgataatatgaaattaaataattagttattcaaaacgtataaaacatctattcgaaacctaattggttgatataaattaaattaatcatatggatatacacttgtatagatatacaattttgagtattcttaaggttaggaatactcatgtttaattaaatctgtagaatttagaatactatggttgcacagtttagtttacaattatctgaatttgaagacatagttgtaatataaatataggcaaatgattgatttgtacttatacaatttattatatgactaagtgcaaaagtagaatcacatctctctacatcaagctccatgtgtccacatgtaattacttgtctccttatatacattatgttttgattaaagtaagcgactatatatctctatttgtaaattgcaatacctttctgccatctcaagcaagtagctctttctattacctgctagaagctagaagggtttatcaatgaacaccatatgtttttttattactacttgagttccatcctataatcaaaatttgttttagctttttgtcatttagtgaatccgataactaatattcattggatggtgtggcaaattctaattacatgttgagtttcacttttcattagttaagatacggtactgtatgtcaagcagtaaaagtccaaaacactgccaactgctttcctgttggctgccagttccaacattttctgaaagcatccaaggaatttctcaaatctcaaatgacatgcataaatcaaatctcaaagcactgccaactgctttccagttggctgccagtctcaatcctccaaggcttgcataaatcaacaaaaactagctggacagataaagctggatatgttaatcaaaactcatgttgaacaaatgtagtaagtactagcaactagctgggatggtatggaatatatggaaacaggttcctttttcaaacccagnnaaaataatttaattggnaananaaaaanagggnttaanacncnntcttannagttctgtaaacgtctgtacatctgactgctaaggctatacacgctacaatccttataatgacatcctaagatggagaacatgaggccaaaatagaacgaagaataatagctcgccaaaaagaccaacatataagaccgagtgctatgagttgatatactgtacaaatgtcaactcgaagctatagaatgtatgtatccctgtgtttgtaaatacgacttcttcacatgtaaaactcaactggtatgcgatcataaaactagcggcgattggtccgaagagacataaaatgtgcagcaaacgaatcatagtctgtcggaagcttggggtgaacatgcgacggagcagtttttgaggtgctttctttcggagtttctgctgggctttctgtgttttcctcctttcctgtgacagaaactgtattcagatcagcttcttgtgacttccctttgcccaagggaggttccacacgcacaggttttggtgaagttcgtggtactggaaccctggagtacacaggtgagtctctcctttgttcagtaaacctagaaaatgacccagcaggtgatttcgcctcagtttcatcagcatgctgcactccaactcggacaccggtttctttctttgtatctgatgtcatctgagtcctgcgtgattgaatctgctctctagaccactttgtctggacctccttgcgttgtgccaattcgtcctcgctatcatctgaatcaaagtaacttttggcagtttttgttgtagttcccctgcgggctccagcacctggcttttcatggtacagatcttgactggaatttacacctccagaactcttattcatcacagaacttggagcattataagattgctcagataacttccctctatcaccttctgacccatagtaattcctcatggttgatctagcttccacacttgctccaacactttgattttggtcatgaagttcactgttgtaatctgcaccgaacgaactcctggccatacctgtagaagtatttcttgtatttccaaacgaggtatcctcttcagagtgcactgatttttcaatggcggtaggaaccttatgcaacgaggtattcccagaatcctttatgtacggaggaggttgccggagtttgtttcttagtccaggagttagccttccaaagttcaagcctggaatcgccttcatcatagtcagcagatgatgttgaagtttgcctgcctaaagaaaacagctgattcttattttctcctgttgtcaatgatgatgcaccttccaatttatgtggcactctttcttcttcaagatctctgatttttgtacgatccaattccccatcaacccatgagtaatcagatctaggtgaactttcactgtagcgctccttattgaatgcattagaaccagatgaattaaggtaattcttcctggacatggatacatgatcttcaatattttcattaacatcatggacaacctttccagaaattatattttctctactctcggaaaaatcggatcctctggaatgagaccttaaagaccttgcatgcatgcctgtggtcatttcctcatcagaactaacaccatccgagtcaaatgtaggtggcacattatcataagaatgaggtgaggaaacatcttttctgtttgcttctgttcctgaaaatagtgttgagctgctatgattaactggagattcatttctatgctgttgaccccaatctgcacttgagaatcccttgtgatcttcaacagtgggttcttcagtgtgctttgaagagaaaggatccaataaattttcttctccgacatcagaatcatattgatcaaaaacaacagctgaagaatcaggtccagctttatcattctgactgtcccaaatggtactgctgccatgggtgaatgtaccatgggaagagctatagttgctgtagtagttgtctgtgttctcttgatcaaaggtagcatgcttgctttccgtgtccttgatgttgtgcccaccaagttgagcctcggacaatctttctccaggtaaattaaactgatgatcctcaggtcttccaaagttgctttctttctcagatgaatcatcagaatattgaggatcgggtgaatgagaacgatgcggatcagttggcatgtcatactcatcactgtgaatatgagggctatatggtggggattgacccaaggaattagttggcatattctgactacctacacggcttgtttctgttctccccccatccttcctagcatcattacttgagatgagtcttggatcataagcccctgaactctgctcattagaactcctctgcccatccttcattaaatgttcagcttgttgcttcctgggtgtagtttcatgggtataagcaggtgactcaaaagctccagtattttgctccgcagaaaggtttccacgactagcaagttgggcagcagccctagcagcaatactagccatctctgcggactctgctgctgcttgtgctgcagatgttgcatccttgaattctatattccaattggaaccactaactgaagattttctctccctagagtgattgaactcttccctcctggacgctgtatctgaaaataacatttaaactaggaatgaacaagaaagcactaaaaaattggtaatgttcagattatatgaccttcacctgtatctggaactgttgcaccatattgggagtaaggtctagaaacatttgaacctccagcagtatcatgagagaaactgttaggaccatgctgggacctaggggacattggagcatcagaaccccttctgttttcttgggggaaagcattagaattggcagtgacatatggagccctattgtctggaacctcagctgatgaatatgaatgtgccgtagacatgtgagaattggaagattccatatatgaatgagaaggtgcagcaggctgtgaagttggcatgccagaattagaagcagatgatcccctagttggaatatttcctcccggatatgttgaggtcacatgctaaatcatcaaatgattaatccagttagaaccataatacttgaacgcttaaataaacttttatgtcagctaatttaccagaagatcatcattttgcttcggcaatttctcctcaaatgcttttggctcccatttgatgttgtgctcctctgcaatagaggtcaaggttttgattttggtctgtgtatcaggtgctccagctgacagcttctcaatgacctgtatccaattattacaaacataagctataatcatggcatatatttattcaggccaacagaagtaaggaaattattttcccatacaaaatacttctaaaagcagcataaattaccagtcggctgacaccactgtcaggtcgcacttcaagagctgctgctgcaaactcttttccatacttacttgtgaaatgcttgcgaacatctgcaagttctgtgacatctgaacacctcattgatgcaaatataacactggctatggcttctttcagatcaatagggcaagtccttcaggtaaaaaccacataaacaaggaaaggaagagaacagatcagttccaggggaacagaaaccataaaaccaataaattaactaagaaaaccaaaacaatgcatagttttcaatcaatattaatctcaatttattttttatctaagctcttttcttcctgtcattatcttaaaaggtcgcgccacagcacaggtcctagataactaagatgcaatgagcatctaacaccctggacattagtatgttataattagacaatcgatttgtatagttttcgtttaagaaagcatagaagcactcatcttagtggctattattttgtatttcttaaaatgagtgtgccaattgccatagagttggtagcacttgacttaattagactattttagaatagtttgattagttaagatgagaatgagtaaatgggaggattcagctcctttgaaaccatgaaataatacttggagcgtaaaactcatgtctaggctaacttgatattttcagataatggaagcttaattgaactcagctaaataaggctaacttgatatggcagaattgagtccataaaacattccactctggaaccagggaagtttcaattggaagacataaggaatttacatttatctccagcaagtaactaagtagtatatgactgtgccacaaaaaaaataaagtgggttcagtttccagattacactcacgaggaaaaaaaaagaggatgccaggattataagcagttttaggaggcccatatcaatcaggcaaaatcatgctttgcttataagaaaaaagtaactcttgtgatataagaaacaatctgaaggttgctaataacatgaaaaaaattgtttagtatcaacttaagaaatcatatcgacaagaaataagctatgttagaggtagtcctccaactaacaaaatatgcttctgttatctatgataatgaagcaatttctgacataagaaacataaatagaccagcaagtaattggctatatgcattatatacaataaaggggaaaatggcttacttctgtgagtcaataatggacatgcgtgccaccataagttcacagtatacttcaattaagtcatatgcttgcatgaacttctcttcccttatgacatgttcaacctgtggaaaaagataagcaaaacgggccaaaaagaaaatagatgagcctttggtcaggaagtaccatcaagacacgttaggactgtgtgtgcgtctttgattcactaacaagtagctggtcactctgtggctcagaacccaacaggatgccctaataatatactcacagcaagataatacttgacacatgcattcgcaacaagcaggcatgtaaaagtaaagaaaaaccaaatactcaaatggatggaactaaaaaacgaatcattcgttgtaatgtagctaccgagaggcaaaaccaaacacttgtcagataagaatccaatactctcatggaattcaagagttcaacggagcaagtcaatacagtgaccaaattgatggcactgctacagaacgaattgtaaatggtttctgtcaagacataaaaatgaattgcatttgagccagcaggcatatacagggccaacaggcccaaggacttctatggcaattccacttataattgcagtagttcatcggcatatccaaagcgagcagatcattcgtaaaacatcactactactagtaactaacaaaattttcccatataaacacctaaggcacactaagaccaagcgcaagcggctaaacaattgatgctagcatccaaagcccatctgattccgcgtcaaggcaccccaattacccgattccgtcatcaattgggggagctaaagagacaaattgagaccgcgatagagacggaggcaagggaaggcgtaccctgatgcgtgcggtctggtcctgatcggcctcgagcagctgcgcgacctctcgacgcatctgccgcacctgcacctccttgcggttcctcagcagcttgatccgcgccagcgccatccgcagcgccgtcttgctgcggcatccacgagacccaaaaaaaaaaaaactgttagcccttgcaagcacgcgcctccgcggcgcacacaaacgcgcgcggagagttagcgagggcgagatgatctcgggcaggcgggcaaactgaccacttgtcgggcttgaagcccttgtgcaggacgccggacagcttcgccttgctcctgttcatctccgcctccgccgccgccgccgctgccgcttccgcttctctgtgtacctagattcgaatcgaatcggctcccgcggggcgcggggggcaggcgaggggtagctgggcgcgggcgtctccggttggtgcaggtagattggaaaggagggaggaggatgggttcacgcggatgcgtgtgctgcgctaccgaccagggaggaagaggccaaggagagagggggggagactttcgctaggcagggaggaagagaggagataggaaaacggatgcggttttttctcggaggattccgtgacgacgaaaccgcagacagaagcccaggcgcaggcggcttcttcaccgcttccgtcacgtcgattcgggagattgaccttgaccggtggcgcgcccggttcgagggcggggcgcgtggggaggattcgcggggatttttgggggtgatacgcgccgtttctgctggggtgtacttgggttggaaaacccgaggaacggaggcatatattgttacaaacttagtaaaaactttctaaactgatcatattaagtagatatataaaataaggtaagccattaatatataattaattaaatattaactattttaaactttaaaaatggattaatatgatttttttaaagtaaatttcatatagaaatttattttttaaaaaacataccgtttaatagtttaaaaagcgtgcacgaaaaaacgaaataaaccaactcactctcacctcccctagaacgcagtacaataaagtaagagctagctataaacacatatcgagaaaataaaagaaaagagaaaaacaacaagctacagattcgtagtcagctgcagcatggactccaaggcaaaacgtgtgtatgataagtgggaccgattattaatattgtagtatatgtttataggtaactattgtatgtattggctatatatatgatttggtgctagttgttaactatactattaaacttgctctaattacatctaaattagtagtagattctaaaccttaatatataaacatgagaaattatcattcctcgtaccatttccacaacatttcactcaaaccaaatctatccataatttaacgtttaacaaatcttcattcatatatctcacggtaaagcgcgaggcattatatccataacatttcacttcaaaaagtctatccatcatttctacgagatatatggttctatccaccatatatagaaaaaatggttatatacacctgagagtacctgccctgctcccgatccaccattgatcagtgcaggacaccgattgagcacccacgaccttgctatcagatccaccatacatgctttggttttttcttttccagaataaattgctggaattgttaattatcccttacggcttgactgacaactggagagaagaggattgagagtttggagtagggaattgatgatgagattaacatgggaatttgatttttaattctaatatcttgtttggtagagatggtgggaattaatagggagtttagtttgagattagattttaaatgaaaatggatggtcatatttgtttaggcaaagtaaaggaggaatttcctcccaattaccaccctatacccaaaagtattgaagagggagttattactttctcaattccccattatcatcctaccaaaatcttccatatcttccaccgaacggaacaattaatagcctcatatctctaagctcctaatcacttgtaaaaacccctcctaaccaaacgtcccgttaatgatcggatctagcaacggcgctgagctgctagcatatactccctccgtcccaaaatatagccacttttgtttatgaatctaaaagtggctatattttgggacggaggtagtatactcttgtttcaaccgtggcgatgggttgcggcgattcggtcgatctcccctgatatttcccatgcgagattcggctgctgacaaatcgatccacctcatggaagaaacatacatggcggcacgacatcgtgtacgtcatcgtgttcggcatgcttcactagacgatgtgctttgttcgctcaccgtgacttcctcgttaacaggcggcggcggttggaatatgtcaacaccagcatctagcctttctacgcgtacgtgatgcatctgctaactccattttttgatggatgatgagcatattataggcgcataaatctttttatcagcatgcattgtgtaaatatcatccttgtctagaatatggtatctgtaagttctggtagttcataacctataatgactaataaaaatatctatcatacaaagtactttttatacattgtttccattgccaagtcaataagactatgaaaacacaacacagataatgatcgaggtcgctcctcgaccgaggaacacatgttgagatagtagcgcggtttctgagtctcactattactaatatctgatactatcattcactcatcaatgacgaaaaatggtaaatactgaaaagttgcagaaaaaacttcatacacaaaattataattgatttcatcctcagaccaccaatcaatcaaactaggaaggtcaattgttttgtgaccttaagaggaattattcaaggcatgctgccaatccacaccccttccatatcatatcttcctatatagttgttacccactaagaatcatttactcctataaaacaagacatgcaagaagttacatcatcaataattttaagccatcggatcgcattagtatagagttatcacccgttggatcaagaagttagctactcatccatctaatttaatcattgattactcatccattcacctccctttagctcataatcgcgcgtgacattgttatacattctgcacatccaaatcctcaaagacaatactaatcttttttttttctaaatacaactccaattattacataagatgtgagctttgttttgttataaacaattggataacatacaataactaggtatcattaatccaaactcatttttgaaacatgcttgagatgaagcagataagtgctacactacctaattgtaacgatatccagattgtgcatgaaaacaactttcacatatcataacaatacacaatgatgtttcaaaaaataaaacatgaattatattgtaataacagaagctatatatgaagccgcattatcatttattttgtatatacaaagagttgcatctaatcatttaaaacattgattttattcgatgataaaactagcaaatcccgcagcaaggcgcggggtgccaactagtaaacttaaagcctaatggcataagaggtagtaattctgatcaatcttatgacttgctgaactcatcctaaattcctggaaggcaaatgacaaaaattacagcaaaattttcatgatttgcattgtacaaccaaatgatatagaattatctaaaggtctggtacacgttgatttaccccttaacacatttccattataaaaaaataccagaatatatgggtgtgattgtacccttcaggttgctgctcctccattaagagcattgatagcattgtttagatgcatcttaagttgcttcatcaatactttattaaatttaagaaaatggattggatttttttaaaaaaactgttaacatcatacattacctaatatacattgcacaacaagatacactacgtcaggacaggtttatagtaacacatttttgtgttacaataaccccaaaaatgtattactagtgcctacagtaacacaattatgtaatgttactatagcctatgttactatagctgggtataccgtaacaca

SEQ ID NO: 60699 - DNA, 5819 bp, Oryza sativa
taagaaaatttaaatataggtactatttacatcattccataacatccataacaaacttgaagatctttaaaaggagtatatattttaggcatctagctacattaaaaatgcaaaaatatagaaaatatatctatgcctatccaatctctatgaattcccatgcttcttgattagatcttgagtaggccactgaatcatgatcatttaaccattgatcttttgaatctgcaaaaaattaaagtaggatgtcatgatagcacagacataatatgatatcaatgattcatcaaagtgtggaaatatatgtgtatgcatgcatgcttacacaaattgaaggccaagcaattgacattccttcagcatgaacatcaccaatgtcttgcaatgcttcattggccttactagctcctcgttttcttgaagaggatgattaacaaccacttttgtgaattgattacctatctcaacaccacccactttctctcttggattactactcataaaagtagcatatgccacatgttctttgttaggtatattttgcagtcatcaaaattactgtggtacctgcctacaatatgattgaataagaatcactagttagttgcataaacaagaatcgaactgtactatttgaccttcatcacagaagaatgcatcctgtttgaaaccatgggatgtgtagtcctgttcagaccatcctttttctctctactcttcatagtcttttgttatagatattgttatcggatgaagggatagtaacattgttatatatattgttatcggatgaagaaatgaccaaaataaaatttatagatattgatgagttatacaactttattgttgatgactttttcagttgaaatcatttagtacttgaaaatattgtctaaagttgtcactatttgaaattcaaattcaaattataaaaacaaagtcatatagcaaaatgatcaaaacaaaatttatagatattgatgagttatacaactttgttgttgatgactttttcatttgaaatcatttagtatttgaaaatgttgtttgaagttgtcataatttgaaattcaaattcaaattattcaaacaaagtcatacagcaaaatgacaaaaacaaaagttgttgatcttgataagttatacaattttattattgacaattttttcatttgaaatcatttactaccctaaaaaatatttgaattgagaggaaggaggcattatagacttctcggcgagggaggagcaaaagggctgggccggcggcccaaagagggaggaggggaaggggaagccggcccatggagggagagagaggctgcgggctgtgggctaatagtgtatactttataccttatactatggtattttgctgtaatttttttagaatatttgttatgcaaattatacgaagttatagaagaatatatttttctgttgagacttaacaattagacttcatataattgtgttttatgatgaattgtagactgttaagacttgagaattgaacttgacaaaagtttgaagctcagtttgaggggtttttgtattccgataaattttcgttaccgtatccgcgccggttcgttttcgcttcattttcggtttcgataatattcgtttccgttttcgtttctggggtttccgattccaattctgattccgaaaaaaatatggaaacgaaaacgataaaggttgttttcatccgtttccgtaccgttttcacccctagtgctatagtgattcgtgccaaaacatgccatgcgattcattgcaggcagtgggtgttcacatctcagtgaggcagaaaaaatacgattggttattggagatagccaaagacacttctctcgaagatccatttgaaatgtttgattgatgacttcatgttgttgtgagggagatgcgcgtattctgattgaatgtgccccttttttgtcatacaacttccttaatatagctgctgtaattgcatttgaacaaagttgttacctcttgtacctgggaacccaaactgctgctcccggtacacccgcttattggattttaacacggacttggaattagtatgcacactaactttgcatgcatctcatgaagtcattcactgcataattccatcccgtcaattttgttcttccgagctctctgtttcatctcgcctattgcttttttatatattgtgggacttctctcgcatgttgctgctccagagtatcttatataatgtgcggaggcgcgtgcgcagctgcgcgtaatagaaacgccccgtgtttctatccgttctgatttgagatcggttgcagtcccaactacaactaactgcacgttagaggtactgtacacaatctcatccattttttttttcattttttttcgatcgaaagtacagattagccttgctatattaattgtgcggtgaatgcctaaagaaaatgagccaaaaggaaatgatttacctaagtttgagtttattcgtgcatgaaatagtctatcaattttgtggaacagtaacatttactagggaatgtctttgcaaaagcagctaagcatattgtttgtttttcagacctacctacctagcgtctagcaggcgaaaccgcataacagaggttcacccgtatggccgtatgcccgtatcagcaccacacggctgtttaaccagacggattttgcatcgaccataatgaaaaggacacacagcagaagagaaaccaaagataaatatactcgtataacaatcgacttggcagcaatgccttagtcaattcggacgcagataatacacatcaaatgggaacaaagtttgttctgagcaagttcatacaaaaatgaatatcgactgccactataaaattcattccttggtgaaacagagataattggcagatatagcaaaacaaatattggtggtagtaatgttttgcatacagaacagaaatgctcacaacttcatccctgataagttcaacttaataatgatagtacagaatacattactcatgcaatattcagaacctaaacagcccaaagtcttgcatgtagataaattaattcactagattattaacagctagagtttcagacctctgtggtcaaaactcaaaaggatcactacgagataaatcagatgctctttggaagctccaactgccgccttcttcgagaagggcatgtgtcgagtacactacttgacaatttttactcgcaggttttacagaatccagagccttcaaaaccagcttattcttctccaaagttgtgcaacttgcattggtggaaataatatcaatcttttgcagcacctgcgccctctccatgacaaacttgatgaaggcaagctcactctgcttcccttggaactcatcgaaaaccatctttttaacatgtgacttgatacattcaatttcaccagctcccttccagaacatggccttgtgctccccagtggcattgttgagttcgtcagctttgtcagactgaaaattaaaccagtgcaaggcaatcatggatcatgtagttaaaaagcaatcagacaccgattacgactcaaatatcaagtggagcgagtgggttcaccttgaggtgcagcgtttcgacgttgggaaagcactggaggaaactgcacaacatctgggcttcgttgagggtaccaaagtacaccttcaatgctaagatccgcacgcttggaaccatggtacttggggttgctcttgttctagcctgcaacaaaatccaccaaaaacagttcatattttggcgaaactgtcagcagtgggaactaacaaaagagggtttgcaccttgatggtggtggtgccgatctgcagcaagtgtcgccctggctccaggtatcctagtgacctcaacccctgggcaaggccgatcttgatcctcgtcgagaattttctcccttccgtggcccaaatatcgctcagtaagagccgatcgaggcatggggcgtccacagctgcaaggtccgccacgcaggagaagccgagctgcacacaacgtaggctgtggctgacaaagcggaggcgcactacgttctggctgagaaccacagtgagtatctcaaggacagggctcctggagataatggattcgagatcgcggtcctccatgagtacacagcaaaggccaagctccagcaggtgcgggaaggcggtgctgcattgggggaggccagcggtgttggggaacctccatacgccgatgtagaggcgtcggaggtatgtgcagctgaagagcgtggccgggaggcgcaggttgatgggccagggacggttgacgaagacgagctcctcgacggctttggcggcgaggagctggagccagcggtcgagctccgggaggtgtgcctccatgatgctgcaggacaggtcgacgcggtggaagggtcccgggtgagcagcgaggacgcgcgagaccgcattggtgacggagatggggtgggtgttcttgttctctctcagccacgtgagtcgtgaccgattcggacggatagctagccggcccatatcaatcagtttcggttcctacctaaggattctgaatggatcatgtccatgatcttttttttttgttttgggattattaactgcagtttaatttggaaagagtaaatctaatgtccctcatcttatcatcgagttataaaattatccttaaactgaaaagctagatatatgacatccctcaacctaccaaattggatcacttaagatgtgtttggttggatggatgagatggccgcacgagttttcgtgcggtttggttggagggcagggtggatgggacggcccagaatagggaatattctctcaatatactggatgagtgcatccggtcgatttggctggatgaaaccattcagttttgttattctgattggctgtggttggtttgatttcctgttaagcaaggttcaaacgatttttttcgcctaaaccgtttatctaatttatgatttgattacaccattatttttgttataattaaatctttaaaataagatctcggatgattatattttgataaaaaaaatatatatgacaaatgggtcccactaacttttggcttttcccatccatgatatatcccttcaaccaaagaaaaaattggatcgccatatccatacaaaccaaacaaaaaattggatcgccatatccaacaaaatatggattgccatatcttgtccatgtatgaccgtgaatagagatggcaacgggtgcatacccatcgggttcctttgcctcatacccacacccgcaatgtctaaatattcccacttaaatacccacacccgtgcgggtaacgggtatccatacccatataattgacttgtagcatttatatagttttgtactttaactagctatattagagttgtaaaccatcgatattttctctagcaacaatgctattaacattagcgttcaaaggtgagtaaaaaattatacaaccgcattatataatcaagaaatcaaataaaaattttatataactagactagaacaatgcttaagatgtgaaaggagttttatgctatgatttagtagtcgttgagactcatattgctaatagttttaggttcaatcaacgggtttttttttcacccacgggttggtgggtacgggtgggtaaagaacggaccatacccatatacccaatgggtaggagtttttgctcattagtggacccatgagtataagagttagaacacgattagctcctaatagagtaaaaacccatcgggtctcgggttatgggtccccagtgccatctctaaccgtgaaccaaacagacccgtcc

SEQ ID NO: 60700 - DNA, 3044 bp, Oryza sativa
cctaaaatagaagctaggtgagtggtcgagagcggggatgtcgtgtggtggccaagctccggtcattgatgctccagtcgtggtcgatgccaactacggtggtggcgagaggttcttgcccgagggcgagagagagagaggagcatagagcagaggaggaggtgtggagcagtggatgcagctaggggtgggcacaaaatcaccgagccgaatcgtcggttttttcggggctcggttttctcttcggcttttactccgttgtagttcgatcgttggtatcttcgtcggttttacgtcttcaaatactgaactgtacgaatattccaaacaaaccgatcccaggccaaacaaaccgatcccaggccagtgcgggggcgtgggcgagcgcccagtggccagtcaaccttcccccttaactccctcgaggactcttaggccccgttcggtctccaaaactttgagagaaatttttttcattagaagaaagaaaattatttaaaaggtattaaagaaacaaaaggggcttaaattacaagatttgtaaccaatcaaggggcttagagagagaattttgttgcacgtaaaatgaaaaacctctttagcacataattaattaagtattaactattataaatttaaaaatagatttattctttttgttaaaataactttcatatataaacttttgtaaaaaaaaatacaccatttaacagtttgaaaagcatgctaatgaaaaaaagaggaagttgaagttgggagttgaagaatagaaaaggacatcaatctactatagcatttcattatctttaatatccgtacagttctttttttcctaacgagtcaagcacatctcgccacgagaataattacaatgcgtgtcagtatcagtatcacagcatgcagcaaaagccctggatttcacttgattaaccggacggacaagctaagtgccggcggaaaacattacgatgtcctcttactggcttctagcactattgatcctcaagtcttctgttgctacggcaagtattcgtacgtacaaccctccttgcgagcaagataattttcggctacaagatgatcgatcctcatttgtatgaggtcgtcatcgacctgcagcgaagaaaacttcgtcatcgacaaagaaaaatgaattaaaagaaaatccaaagatcaatctaattttgttctacacaagcagtttcgttctctaaaacgaccacatgtgcagactaaaaaaaaatgcaaataatggacatcttttcagaagttgcactacatatggccagaggacgtgcctaaaaaaaatgcgccagaaagcaattaaggaaaactgccacaagcattctttagtggaggatatactgtagtatgttagtaccttgaaataaggatcacacaacttcttgcattcctccacgagtttctcatgatccaatgtcttcctatccttcattatacgcacaattgcgcaatcgacattttgcttccggtacctcctgacatcttccatggtctcactggcacggaaatcacccctgtcaacatgatgaagcggtacctgcagcacacattacagtcacctcagagagagagagagagagagagaggcgctaacagaagttctggttacaaaaggatcacctttatctttcccgttttaacactgaagttattgttgaactcaaatatgtcgtctggagcaattgttttgttgctcggctccttttttaggatgctgtactttccacatgataaagaatacagcattacttttgcatcattgtccatgatttccaacttagccacaatgtcattataacttaatcgatcatcttcattgaatagcagcagcaatgcagcctggcaaaaatagatcaagggcataaaaaggtcatgcttagcccatgtgggcgtggctctgtgttcaaacttaagggatttgaactcacctgcattggtgagacaatcatctcaactgatttgccttcaaagtttccaacaatattgcaatttccaagggaatagatccaggtaagcgttctacccctcctatttcctgtcgcttgtccatgaaactcttgatagaacttctcgaaagcttcagcacaattgagctgagaaaaagaacatctcagatcttaccttattagaaatatggataaccaaaataactccataatgaactagaaaatggttaagagaggcaccatatcaggggggagcgataaatgctgtttttgttgagaaggaaaatgaccctgtttcagaaccattgtgtccatgtccaccagagtatttgattctgggttcatgctcatatagtctttgaagaatttttgtagttcttttgaaattgaataatcttctagcatatcttccaggattgagacgtccaagactagttttagctttgtgataaagcttgtctcgacctcaatgttgcaaccaatggatagtcttcctaagagcctgttcctgcaatacattttcagggggaaaatggattcctcaaacttcagttgtcttctaaggagtcaaacaaccatagctcccaagttaaagaagcaaccacaaacctgtacagctcaacaaggtaatccttactgtgcaggtacggtagaagcttaacgacctgaaaattcagtatccacattggcaaattgtttccgtaagcctagggatgtgagctttagaattgcaaaaacaagccagtagtagcatacctttgcaagggtatcttcaacagagtcatcgtctagcttgccacatgtacgttgttcaatgagtctctcaaggaatattatgaaaattccccatcactaaaatcagcaatgtttctgttgcagatcatcctaaagttctcatccagggcctgcacaaagacagaattccctagtaaccaacatcatactatcatgttttagcaagtaattacaatgatctaaggcaatgttcaaagtattgactatcgagtcattccaaccaagcaaaccttgcgaaacaaaatgtgattgtcaaaattattgatcacatgcgcttcg

SEQ ID NO: 60701 - DNA, 8018 bp, Oryza sativa
gaattcaaaatgcaaatccacaaacattacaacaagctcatggtttctcgccacatgattatagcgaagtgtagtgctccctttcccctaatcgcctcctggtctcagaaattcaaaatcaggccaccgtgccaaacggcggaattcaaaatataataataaaagaaaaaaaaacaccggaccttgatgaactccgcggggacgccgcggacgcgctcgacgatcagccctacgtcctccagctcccgcaccagccgcgccacgcagttctcgacctcgccgcacccggccgcagcgccgcggtagagcttgggcacgacgatcccgacctcgaaccccgtcgcctcatccacggccgcgccctgcccctcgcccgctcccccttccctcatcctccacaacgacgacggatcagacgcggggaatggcggtggatgcaagggagcggatccgcatagggggaaagggaaatgcggcgagcgatggaaggaaaatttttttgcggtctttgggaaatgagaatggagtgagacgaggccaaaggacgcgagggtaggaagagcagtttctattgtaagtatagtaattaattagacttactattttgattagcacttaattaacctattgttagctgttgccaccgatgcctgtgggcgtagttaaactggcgatttgggaggaaaacgaggattaaatcgggaggtaatagcgattttgaaagctgtggtggctgagcggccagcaggtgcgcctagccgcctaggagtcctgggctttccacccgtagagtattttgacaggtgggcccacgagccaacggtccacgtgacgcgagagcaccgaacgaggcgtgggtagctgccacgagggacaacaggttcacgtttcgacaaaagagcgcgagctacgaattacccctgcggctgacactgggccacgggtgatggctttcgccgtcgtgccgatttgggtcacgacgtatgtctggttgatcgctggttcggataatgtgttcgacgtgaaatgtttcttccaacgctaatcttctcgtgatgacaagattaaggtttttgttagtgtgtaatttgctgcttgctggtgactaccgcgcagtagttcgatttattagttacgaatcaatcactgtttattccgcagaaaaaggaatcgttttgtctgcttatttgtagcaccactcgaacggcttcctcttctgctgcagctgatgcgctcccgagctgctgccgccgttcccgtagacgaaagaccggtacgccatggcgccgcgctcctggaccacgtcgcagagcgtctccgggcgcagcgccgcgacgtgcaggccgacggcgtcgaggtgccaccacccgctcctcccgctgaacccgaccaccacgccgccctccatcgggtactcgaacggcaccccgtcccccgacgcgtccccgaacggcccgtgcaccgcccccgtgctcgtccggaacgtcagcgaccgaaccaccgtcgatccgccgtgcgccaccgggccgcaccggccgccgacgccggtcaggaactcgtacgggtagtccagcttcacctgcatcgatcagagagagagggagagattcagagagatgcacattttttttggtagatgagctgacttgcaccggagcacgcacgcacgcacgcacctcggcagtgcggcttgttctgccgtcgccgccgccgccgtgcttctcgccgtggacagggtggccgttcctgtcgtactccaccctcatcgactcgaggaaccgcccgtacgtcagggcgatgctccggacgccgcggtgcgcgccgtcgtcccacgggctcccggcggtgcctccccacggcccgaccttgatggccttgctcgaagcaaccatcctcctctgctggtaatgacccggttgctgaaagagcaagaaaaaaaactgtgttcagctgcgttcgtcgtcagaaatgttcagcacgatcgagaattcgagaccacgacagttgatgtgccttaccatgtccattagactgacttgcttgtcacctgaaattcggagaagaacaggaagcacctggataagtggttgtatcctagtaggagtgtactatttttcgttaacaagtaggagagtgcacttatatagaactgaaatactcacttttgtaagaggtaagtggagagtacaaagaattagataccggatagcacaagctagaccatgatgttcttttaattttgtgcttcacctggggcaacaagaaaccttagcacataataatgtactttaatctgtgcttcatctgggtcctgggacagcaagaaacttagcattgtttatttgaaagaacctcagcattgttgctaatcacttttttttttgaatttttgctgctaatcactttgagtgttctcgggtcttagataaagcaggtatggctggagcgggcgaataagatgctgagcgattgtgattgggttctggcatattaggtggggaagaatcaaatgattggcgtatacttcctccgtcccaaaaaaaaaagtcaaaccatgattttccgtgtctaactttaactgcccgtcttatatgaaatttttttataattcgtattttcattgttgttagaggataaaacatgattaatattttatgcgtgacttttttttaaatttttttcataattttttcaaataagatggacggtcaaacgttgtacacgagtttttttttgggatggagggagtatgtacctggaattttctcgttcccaaaaactttttctggtctgaacttaggactgatcagtttgtccggtatcactccccgtatctgctatggattaatttatctgaatttgcaagcataagttcttttgttctgtgttcaataatataagcagcgtcgtagactgactgacgagctgatgaggaatcagaaactcttgtcgtatctgttgctttgtgcttattgctactgaaccaacattctggggaatattagctagtagctacggtacagattttcgcggttaacaaacactttcaggacagggccacaagaacatagaaactcttttaaaactctttgaagtattcgggtggatgttcatatgtttcttccatgtcaactaaataattaaaaaaaaaataaaaaaagatacattaatatgtaatatatcacttaacatgcatgttcaaaattaacttctaaaggttcgaaaaaataacaaatttagctataaatatactacctgtaacaaataatatgtaatatactagttggagtttattttgttatttttgttacaactcgtgcaaggtggattttaacttgcttgtttgtaaagtgatatattaatctatcttataaaaaatatttttttcataacaatttagtttgcagggaaaaaggtacatatggtgaaatttagaatccatctcccaggtggacgtccacaagaacagtccaattggaaacacaacagaaggcgaatgataatgctatgcacaccgcacagctcacctgcttatataattcagatatccagtagtggtagtttacactttacaaccgagcaacccccaaggctcccaatgcgtcgcaatcttcctgtcattaggcatgaatcggctcatttccaatagcaaatttatcagactagctgacactctagcagctatatgttttccactgtttcttcgctgagtaatcatggacacccaatcagcttcttgttcacgctgtcaaagtctcaaatgctatattttcaggaatgcgggacactccaacgcatatccactgttagctggggccttgtgccgtgctctaaagattcttggacacctcttattatggtgtatccggacagcagcttaactttgctcctacgtcaattatcagtagctcagggtcaggtgaactatctgtctatttgtgcttactagctttgactgaacggatcaggacatggcagctgttcttttcttttctctagcctgttgcttcagccttaacgtcttagcttgcactctgcagaatgagatgaaaccaacaactcaactctttgtgacttgtgagttgtgaactgttccgttcacgtcgggttcacctgcgatcttcggttgagcgcaggtcaagctgttcctgaacacgcctgcctgatcttgcggtctgacgagcaattcacgagggaaagaaaacttcgttcgaacaggcggctggacgatgagtgaaacgaaacaggggatcaatcaaacgaaacggcgccaaaccatgcaaggcatgagggcgacggccgccccgccccaccggagcagccatcattgggaaggggggggggggggggagcaccgaacgctttgcgcgcgcgcggcggcaacgatcgatcgcatgtggtgtgcggccccactctcgtcgccttcgaatgagttggctcaatcgaatgatcgaatcaaggttcatatactgttgctcgaaatccgtctttgagaacctaaatctcttcgtttcaatttcttgatgccatcgccgtgtatttgtcactcgcagcagtgcaatgttaaattcgggaatgagtactacggagtttcattccgttagccatcacctgcaaaaagccaagaacacgtaattcttgtaaacactaaaccaagaacaccggtcgttttgctcgtgagctgtctcggggtaggcaggccaggcagacagactgtgaaaccaagacctcttcagttataacagcgcgctctcctgcgcctcatcacacacacacacacacacacacacacacaccccacgcattcaagcagccctggtgttgtacagatcatccgaggcgacgtttctcgattcgatcatggccaccaagatgttccgcgccgccgtcgtcgtcgtcgctgccgcggtgtcttgcctcgccggggttgctctggctgccgatgggcccgcgccgagcccgacgtccggcgccgccgccgtctcgtcctcggtcgtcgccgccgttctctgcccggccgtggcgctcctcttcgccaacctgcgctactgagttggttgaggtcgtcgcagcgcgcgcgtgtccatgaggctggctccatgaacgactctgttcttctctgcttgatcactcgcctagtgtgccttctttacccccctggttcttacctgtacttagcttcttccttccggtgcgctagattaaccgttcttgccttcttgtgatacgcatctatgtgtattgattcagatcatttcataccatcatttggaactatttattaattgctccgttatatgccggcctgtgaaattaatcgtcgtggttttgtttcccgacggatatgattcaataacctgctacgaatatcacggattctagacgaatattgtggattatacggaggatgaactcatgaacaccaggcgattttcgctgtaactatcgtgtgtttctccagttctgtttcatttccaattttgttttcttttggctgttgtcactgggtgcaagaccgtcaatttgtaaacatttggttcactgatcgcctgaactcttcttctcagataatttctgcgtgcgtgcagcttatcagctttacaatttgcaccgcgctgggccgctggcgccgcatcgaacatgcaatcgcccattctacattcctacctaggttttcgtcagaatgccaaggtcgagcccagaattccttacagtgtaatcgtcgatgacaaaatccgccgcggatacctaacctcgaccatcttgagctccgcgaaccgccgtgcgcgtgggctgaacagagacgccgccggcgccgtggcgactcgacgtcgccaagtcggatgcaaggcagatgcagcgactggacgaaactagagttcctcgtgagggtgcgagccgccctcgcgccggcgttcgtccaggtacctcatggcgaggctggcgtgcaacgccgcgccgtacgggagcgcggcgtcgtcgacgcggaagtgcggcgagtgcgcgaggtgcaccagcccctccgcctcgttgcgcaccccgacgaagtagaagtgggacgccggcacggcctcggagaagacggcgaagtcctcgctccccatgcacggctccatcgcgccgaggaccgcggccgaggcgccgagcgtctccgccgcgacggcctggaagtgcgcgtgcagcgccgcgctgttgatggtcgggggcagcagcggcctgccccccgcgtggaagtccaccgccgcggcgcaccggtacaccgccgactgcgccacgatcacctcctcgatccgccgcttcagccgcaagaagccctcgttcgagaacacccggaacgtgccgccgatcgtgatcgactccgggatcacgttgagcgcgtcgccggcgaggaacctcgtcaccgtcaccacctgggcctccagcgggtcggcctcccgcgagacgaggccctgcagggcgaggacgacggtggaagcggccaagatggggtcgacgctggcgtgggggtgtgcggcgtggccgcccttcccggtgatcaccgcctcgaagaagccgcagccggcgagcagcgggccgggccgcgatcccaccacgccggtggggagctccacgctgacgtggaacccgaagatggcctccacgttgtccacggcgccggcttccaccatcctcctggccccggtgcccacctcctcccccggctggaagaggaggaccaccgtaccctgcaaaagaagaccagactttgcttaggctgtattgggggatgcagtcaagcaacaatattgcgagttagtacttagtactccctccgttcgttttctaagatatgacgccatttactttttctcacatatttaactattcatcttatttaaaaattttatacaaatatataatatataaatcacacttaaagtactatgggtgataaaacaactcataacaaaataaattataattacataaatttttttaataagacgaatggtcaaacatgtgagaaaaaatcaacgacgccatctattaaaaaacggagagagtacatgattaattaagtactccctccgtactcgtaaagaaaatcgttttggatagcgacacggtctccaaaacacaattttgacttcttgtttctataaaaatatttattgaaaagtgatatatgtatacttttatgaaaatatttttcaagacaaatctattcatgtaatttctacattttcaaactcaacaacatgagagttattcgtgatttatattcccaaggtttgatttacacattgtcctaaatgaattcatttataagtacggaaggagtattagcttaaaaaattttaaaaatagattaatattattttctaaagtaattaactaggtggcgcggctagcacccatacaaaattatctattttttaatataatttatttaaaaattgttaaatagctctttttttgtcttaagactttgaaagactaaaacttatcatctatgtgtttctaattttttagtttttaaaagttatatgtatttgctaccccttattttttgtcacattttttatttgcttgttcgatctatcactgtttctattcattttcctcagatcctttcaaaattagaccttacaaattttagagtttattgtctcgttgggtttcgtttttataatttttaggtgtcccgtcaaacattgccattatacttatctattacccgtccgttgtcttctctctttattgtcattgtgattttaaaaattgattttttttaactttcgaagacccgccaaaccatcggtagcatttccattgtactcctctacggctgtccgctgcctcccctctttattttcattgagatttcaaaatcgaacatgattatcattaggggtttatttttttctctctagaagtcccatcaaccgtcgtaactgctgcttaacagcctgtctgtcatcccaattttaatcatcattgagattctatttgaggttttgtttataactattagatgg

SEQ ID NO: 60702 - DNA, 4652 bp, Oryza sativa
gaccaatattgaaaccgccacacgtcatgtcatgctacaattattctggagtgtacgtccaaggcccggaccacaaaaaatgaaaaacatttgtggaaaatgacaccgggaaattgctataactggtacaactttaattagacacatgatgataagtagtatgggccccccaacaaagttctcatagctgtatgcccaaacaagcgaaacaaaccaacgatcacgtaggcgccacacccagtcggcttgctgcgatgatcgatgcctcttatagctatttatggacactaaaagaaatgaccgttcgttgcaacgggaataaaacatgagaatttaagaaaaaaaaggagaaatatttacattacgtaattaattaaaatacaaatttcagcatccttactataaataaactacatatatttatatttatttcatccccactacatataaaatcgcagttacatacgatattacgaaaagaaaggatcatgaaaatcaaggtaaatgtgggtaataaattttcccaagtaataaaattaatttttattaaattttccatgattaattacgttttatgaatataactgttaaatgtagattaaattcgacaaactaaaaacgaattgaaagggaaaattacagggaaaataagaagaaggagttgggaatcgatttttgccattaattaaaggaggaaacgcagggaaagacatgggtataggttcagattggaatagataaaaagaaaatcgaacaaaaagctggcgtgcgcaagaaaaatccgattccaaaaaaagcaaaaaaaaaagaaggaaaaaccgattaaaaaagataaaaatgattaatccgatcagaaaataaacggtgagaaaaaaaagggaaaaccgataaaaaaagatggaccaaacaaaaaaccataagttttattttaaagaaaaaaaacgctcatcagcggagggcggtcgcatgcgcaccctcgtttcttccagccccacgcgcctcatttcttccgcctgaccttatcctccctctctctttcctctcgctgtatctgctccgcccgcccgccatatctccttctctccttcaccttttctctccccaagcggcgacgccttccctctccccaaaccagcgacgctgctctccctcctcctccccccacggcgacgctgccacccctacccctcagccagggtgccctcacccgcccggagggtcttttccccggcgggtggcgtcctgcccttggaaaccgacgctttagctgtggcgccctcccaaggcgggcggcgcctcagccgcggtgcctcgtaccaccctcctcctggccggcgatgccctttccccagcgggcggcgttctctcctcggcggcatcaccttcttctccggcacaatggcggcaccttcttcatgggagcccctcggcggcggcaccctcctcatggcgcacggcggcagcacacgcgccatccaccacgacctcgggggcagcggcatcctcggctccaatgagtagtggtgccagtgatttagttttttgtgatttaattttcttgcatgattttgattcattgttgttggatttgtgattttgtgattaagtgaagttgtgattttgtgatttattctctcttttctgtatgatttgacatctagttcaaggggaacatgtttgttatgtacatccgtatgggacggaagtgaggcggacatgtatgttcggccacgggatgcgatctcgcgaacggccggatcggaatcgggacgacggacaaaaaaaaaatcacggaaaccttataaattttttaattaggtatagatagatatagatatataagctggttaataattaaccatagttttcgcagtactataaccttcttggcttcgatgagtggctgcacttggtttaagttctaatctcttcgtcttcatgaacattcaaaatcacatctaatacgagattaacttttatcatatgtgacgaaaggcatatagtactcccactgtcccaaaagtacttggtttaagttctaatctcttcgtcttcgcgaacattcaaaatcacatctaatacgagattagcttttatcatatgtgacggaaggtatacagtattccctatgtcccaaaatataacaacttttggttgtatgagaagtcccatccaaccaaaagttgttatattttgggacagagagagtactttctttgattcaatgactgctgcacttggttaagttctataccatatatgaactgtctcttgccttttacagtactacctttcttatttttcatggttacatgttatgcacgtgtgggcagtggtgataacactaccctaggatctagctaacaccctactagtagtaaccaccatacgtacatgtcatgacgtggtggatgcatcctgcacgtgcgactgtgcgagtgaataggaagagtaaaatattccaaccaacacaagttgatacaacaaagcacagaagaatgaaaggtatcggtctatcggatgaattacttttctactagtagtactactaaattcattcattttattctttgtgtaatgaaataaactaatactagtcaaaactgcttatgacatttgtggacaggcaggcgatgtggcccattggtacgtcgcctggcctctagctagcgttcgtcgcgacagaaacgtacgcgtgatgggtgtgccgcaggctctgttaggcatgtgtgatgactgatgagtgaccgcctgcctaaccacgtaccccttcttgtgtcattgtgtcatatgcaatgggagtatcaagcgtgacatacatagtatcgcacgtgcgaatgaaacgtctgtcttgggtgaagtgtttgtgtggagttgttaatgtaccaatggtgatcaaggatttatttactgtatctagtatggacatagcaacgctaattggtaatctcattttcaggctgatgttgtatgttctattatctccatcttaaaataggagacgtcctagtatagttgagctaaattagccaaattagtgtaccatatgacgctaacttattactacttcatccgtcccaaaatataaaagatttagggtggatgtaacatataatccagatttatagtcctttgatatatcacatccatcctaaattttttatattttacgacggagagagtagttactttgaatgaccagaataagcaatcatttcaaaacaaaaatacacctgtcatttctaccatggaaggaatcatggatgaactaccatacatgataaaatttgaatcgtacactgctacaccgaccccacgtttctgcttcttactaaaacatcaagcattacaggacaatagatatgaagtaaaatgccaagtatacgggacagagggagtattgtaatttgcaaatatttgtttaatataacaaattattatattttaggatgagtaaagtcatatattactagtttgctgtatctattagtctgttcggttggatatgggatgcggctgcagccagcacggataaaactttactcacagaatcagcagcatgcagttgtagcatggctgccgaacaggcgctatataagtatatataagtgacgtgacgatggggttggaaattcatgtctatctttttttttcttttgataactgctggaaattcatctctctcttttttttgtttgctaactgctggaaattcatctcattctcatttctcgagtgcagggcagttggccgctgctggcctggtgattacggagtacatgcatgtgggtagcaagctgggaaaacaaggtacgattacaaatgctggcactgcatcgacagatccaaccgaaccactgcaccgacggtgtgcgcgggtgctacgagtactttactactagaccgatcactctaacagtgtgttttttacaaaaattttctatacgaaagttactttaaaagaccatattaactcatttttcaagttttctttactaatacttaattaatcgtgcattaaacaatcgcgttgttttgcgtgcacgagagggagggttcccaacccatgctaaggaacatagcctaaatgtactgctctgaccgatcggtcgacgaccgtcgtgcaattagggcattcatagtgcgccactattatttgctcagcctcacgcgccagctagatgaggaacaatgttagctacatgtgtcacagtgcaagttgcttcttatgggtcccaccattaccatccttttaccacttttttctctaccctctctctttcctgtcttctttccctaccgcagtgagcaccgagcgcatcgccagccgagcagccaagcggcaacggcgccgaccggaggggcggtgaggcttgacgctcgcccgtgcaccaccctcctcctcctcctccccggaaaaaacgacgagcatcggtacaacggtgcaggagctcagcggcggagggcttgatggcggaggagctcggcggcggtcgatctgggacggcgccgggcggcggggcggtcgagcggcaacccgagctcctccgctcgagctgggacggcgccgggcggcgggagacgacgcgcaggagctcgacgacagatctggccgacttggggaccgccgctcgtgctagaggagaggggag

SEQ ID NO: 60703 - DNA, 922 bp, Oryza sativa
  unsure (1)..(922): unsure at all n locations
atgacggaattttgcgagctcagacacacgcgtcggccgatagtgcaacgaccccacaacgtacggctgtactgcagatcgacacggcaatgtggtggtgggggagcgacggagagttgctggttaaggttgttggcgcgtcacgtcgacccatcggatcgcccgatacgacgtctaagctcaccatttttcctttttcctttttttttttgagaactgtctaagctagcagagctcacctcgactgcccagtgcccgtcattcggtattcccgtgggacaccacgcccgtcgcactccctccgttttgcgcgacgggaccgggtgagagcgtgcggtgtgggatcgagccggccggcgagcgagatcgcgcaatgaggagggcaggaggcgcgacatgtaaagtactgacttgaagacgcggaacggccggttttcacacgagaggcagaccggcttcgacgacgaggaaaacttccagatgacacgaacgtgcgccggcgtgggacgttgacgatgcggaatctgagggagggagcacaggtagtccgtggtcggtaggcagttggtcaaagtaaaccgcgcgtgaaaactgtactagtgcttccaaaagattgatcatggactgcacatactaagcagttttgatttgtagtgactaagcagttctcttttttttttttccttaacacgccttgagcgaaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60704 - DNA, 753 bp, Oryza sativa
gccaccgccgccgccgctgtagttattcgactcgccggaggagatgttgccgccggtggtgccgctgtagctggacagcatggcgccgttcgacacggccccgccgtcgctcccgtcgcaggcggcgcccccgagctgattccgggagaaggcgagcgccgcgtcgaggaggccgtcgtcgtgcgcgccgccggcgccctcggcgacagacgcaaacacgtcccccgagcacagcaaccccaacgggtctccagccacggcgccaaatcccgaggtaccctgcagacacccgccgccgtcgccgccgccgacgccaccgtcgcactggagctgggcgccgaagcacgcgcccaggaacgcgtcgtccagctcgaacggccgcccgcaccccaccgagcgcggcaagtagatgtcgtcgtggtgcatcagctgcccgccgccggcccagccgaaggtctccatcgccgcgccgccgcaagaatcaccaaaccactggcttgtctgtctggctcacggattctcgacgtacgacgacgcgacaaaaccgcgcacactgcacgcagaaaacggaattgaagcgtgagcgctccagggaatcctcagccaaacgaatcacacgaccgatcaatcagacaccgatcaagacgagcaattaatctctctagataattacaagaagagcgcgcgcatgcgtgatcgatggaattacaaatccgtaatcagcatcaagaaacagtggcgctggtgagcggc

SEQ ID NO: 60705 - DNA, 852 bp, Oryza sativa
tccgcccaactagcgcctagcgccttcttgaaccatgaatacaatagttatccataaatatatactccatccgttttaggttataagacgtttcgactttggttaaagttaaactgttttaagttgactaagtttattgataaatactccatccgttttaaaatgtttaacaccgttgactttttagcatatgtttgaccgttcgacttattcaaaaaaaaaattgtgaaatatgtaaaactatatgtatacataaaagtatatttaactatgaatcaaatgatatgaaaagaataaataattacttaattttttgaataagacgaatagtcaaacacgtactaaacagtcaacggtgtcaaacattttgaaacggagggagtataataatatttataatactaaattagtttcatcaaatcaataattaaatatattttcgtaataaatttgttactatttttttacaaacttggtcaaacttaaagcgttttgactttgaggaaagtccaaacgtcttaaaacctgaaacatagggagtattacataattaatatctggtctcacctgtcatatacatatgtaacttggagtctgtgctgcagctggctacaaatatgtagcccattgttcttctctcttcttttttatcttctcaaaatgtgtttatagctagcttacggtcatactcttaataataagctggctggttgcacaacatacgacgtcactggtatatttgtcccgtcgttgacgttgtttttctaatgagttgctttattactatttgatcgtacgtggcgtgtcttctggagtactgtacaccagtaatccagtatgtgtgtgacacgc

SEQ ID NO: 60706 - DNA, 8947 bp, Oryza sativa
aaacttgttatccccgtgttcttgtgttctaatcatgcttatggttttatagtggaaatatgttgatattgctactttccctaactgtaacgcttaaacatcaggtattaacagaaaaaaagaaggaatgagtaatatcacatagaagaagtcatttgttgcagaggccgggtgtaattttatttcttattaatgagaatctccccattatctaaaaaaagaagaagtcgtataccatataccatgttgttgtacaccattagtggtgtgcatctaaattgtacaccatgttgtcgtaaaaatgcactgtacacaaattacagtaaaacacaacaaagataatagactaagctacaagatggatagaatttgcaaactactcatggtttccctatacacccttctgcgtctcattgtcatttcgggcatgtttggattgctaccataccaatttgttgttagtgccaaattttaggcaagttttggcactaccaacattttggtaaaggtttctattgatttggcaagttttggcatcaatccaaacatcacacaagtactatttagactaccaaaaatttggtagggcaagatttggcactaaaccaaaacagcctttcatgttctgtatcatggtctgtgcaggagcaatggtcaaggttacttgtcaggctaatgaccaggcactggtgggtttcggctatacccaagacaatggcaagtacagcgtgagcatcacaggcttaccactcagcagcacatatggggccgactcatgtaaggttgagctccattcagcaccaggaggatctgactgcaacgtgccaatcgagctaaacttgtctgggcttagcgtttactcgaagtccaatgaggaagtggtgctccaagccaaccaagtaatggcattcgcgtcacagaagacatttgggttttgttcgaaacctcacattcaaccaccaatttttccatacaattcaccaccaccgtccccttaccagtatccctcacctcctttcaactacaagtccccgccgttgccaaatcagttttcaccccctccattcaacaagtttccacctccatctcaccagtatccatcacctccgcagagttcctaccattcaccaccaccctatcagtatacacctccaaacagctaccaagctccaccaacatcttacaatcacccgccacccccatatggatacaattctccgatcccaccaaccaacaagtatttaccacccccatactacttcaactccccaccgccacaataccagcattcgccacctgcaaacagctatgtatcgccaccactagctcaccaatatcccccacctccatacaagtcaccaccaatacctccttactacttcaactctccaccagcaaaccattattcaccacctccatacaactttggatcttctcccccaacctaccagtactctccaccattgcttccgaaaactccaaaatatttacctcctaaagttcctcttgagatgtctccaccggcacatgcaacatctccacagcctctggtccactatagccctccgccaccactgcagcatgctggcatatcatcgacaacaccatctgtgaactcctatcaatccccgccaccagtaaatcagctgtcataagcatcagcgatgaggctcctgaagtgtaagttttctttctgatttatatggcataatgcacgattttcaggagtgatgtgaattttcagactttaaggagaaactcaagaaatataactaaatttgctacatgaatgcgaggcaattgtatccacaaagtcagtgacatgttatctatatattactcaatctcctttcaggatcaggcgtctgcagaataaacgggagacttgaagtctacctcgagaagaagcagtgggttaattcgagttccaggcatccatctcagtatctaggattgttacgacagtaactagtattgtttcagcttatatctcattgcctagagctaatttcagcagggtaatcataagtccagtaagcattgccagtgtctctagttttcaactgaattcaatgtatgttgttggttcctagcagcccatataaagcttttcttatgagcacttattacataagaaaatcaatcatatgagaggaatatggttgcttggctgaatactgcactagtcccattttttgttccacattatatgtgcaatatataaatccaaatgcacctcttcaccacaatcaaacaaaagaaaaccctgaaatatattctgtgatcgaaaatgagcgtagaaaacaactcacgaaccaatcactagtcatcactaaatcagagcttcaggatttcagtaggatccagtgcagtgcagacacaccagcacgttcttcagcgggcataacatttttcagacgtcgcatctcttccacggatctcgcggtatctaaacagcatgatcctcccacaaacgagaaggaaaacctctacatcgccgattcctacgattttttcccaaatgcagccgccgaactagtaacttcaagcaacgggctccaaggacataccggagaagacgaagacgacaacgaagaagcaaccggtggccatggacgcggcgttctcccggaggtggcggttgaagcatcgccagaggccgcggcgacggcggcgggacctgccgtcgcgccgccgcagaagatccggatagtttttgggtgggcctgacaagcctttatctggggcttccatttgggcccgatgggccacgcgtggtgggccgcgacgtccctttcggcggttagctttcaacgtcacacgacgcaactgtagtcgtgagccaggcgatttgattaattgcttttgcattctactccctccttttttttaaactaaccaatgctacacattaggaaacggaggtggcactactatagaaaattcctttagctctgactcttttggagttggagaaaataaaatgagatttatgaggagagacgtccctccaaatattttttaagaataaattatgagcgtgttcaagattaaacacgaaaacttaggattgaaatcacatacctctagctattgcactatcaaatacatctctagatagttttagcttcatggagttgagctggttgtaatgctctcacaaaataaactagagatgaagtagattttaggttgcttcataactttatttcaaacccaactcttgaaataaaatttaagagatcgagtctgctaacatgtccttagaactagaactaattaaatttatcaggttattttttataattgatatggaggttcaggattctcacccatcattttccaaaaaagcgagcaactagacaaaaaaagtggccacaaaacgaaggaaaatggcaaaattgggggtggctttttgtatttctctgagccgatgatgtgcttgaggctggcattgcaggagggccagaaaagaaagaaaagcaccattccctgatcaactttgagatgccaacggaatatgagtgacatattcccttctcctgccattggaggcctgaggctaagccacatccaccattccattccatccataccccaactgccatacacacacatacaatctcctcatcatcctttttgttctcttctcagctcaatccatcacttgttatccatacacttcttaatcagcatcaaagcttatctcactcccccatatactgtagtataatccaatagtacaatcaccaatgttaattactgtaattaatgaaatgtggactagtactacacactgtactagtaatatgcagtgacattgctagagagtttgagtatcccagctactgtagtagtactgaaactttgtcatacacatgtatggtcaggtgtaggagtagtgcagctatccgtatttttaaagcaggaagagaactgccactatcatcatcatcatcaatcagtgtaattaagtaatgggaccagcagacactaaatgcagaatttacctcgagatccaactcgccaccaactccaatccaagtgcagcagcagctatgatattccaaaattcatcttcaatcttcatgctacaagactgaagcagtataccactactaccaatgaacattttactgtaagttggggataaaaagattagaaattggcagaagaatctgcagtataaaattgagcagcagcttggaggcaaaggcagcacagcaataaacttgggaactgctctgctactaaccctgtattattctgcaggagagaggcagattgcccaaaaagccctcacactgtcccacactcccactgctcgccaagtccaagaaagggaaacaaaaaaaaaaggggggaggagagacgaagagagagacaagaacaagaaagggcaaaggcaggggaagaaagcagcgaaaggattcaacgcagctcgcgaaggccgcgatccgccgcctcgcctatccttcttgacagccgaccttggggcggatttaccggtacgatgctgttgctgttcgtctcccctttccgtatttgatctgattgtagtcgctaatcggcatgatttttatggttttactcatattggattgtatgctcgtagaacagaggcaaagaaccgatcaagatggggtttctttatttttctctattgggggttgaacaactgttcgaggaacaggagaaaccttttttttttctcagatcagtacaactgttccgttttccctagtaataacatcctttggtgttgcttagagaatttggttggatcactccgatattcatttcatagatatggattcgtgatagtgtgcgattttgtgttaacagtaaaggattcattttgcaaagtgttcttgatccactggggccctccagaacgcattttgttcaggaattagggttactgggttaaggcaaatgattttttttttgaagtaacaagggataattttcaaagttggaggggattttttttccttattctttggtcctgttcttccaaagttggttctttcatttcgggggaatacaattcctaatcgatctgaacaacttcatgaatcatgaccacattgcccacctctttgttctctgttcccctcttgtgttgatgcaacttgcattccagaggaagattgctttttattaattattgaggaggaagatgcgcatgggttatgtactgttgtagaaaatattccctgatttgaattcatcattttgacttctgttctaatatgcgcggctccagttcatggacctaatatagttcgatggacaagatagggcactgaattgggcttactgttagaggagtactggttctgcttttgctgaaggaattatcctttgtctgatgatgtgatatataagctacttgtaagctggaaactaatctcacattttctttagttttgttgataaaaatacaatgtgtgttgtatcatcttttggttggtatggtgtcgagcacatttttagttgtcaattatgtttctctttgcagaacatatttgatcgttctttgctggagtttatcaatggcagcaggggtcacttttaactggattaaaaccccacttgacatccggagatttcatgacttttctagtttaaggtctctctctcattgtacaactgaatcatttgactggaccccttgcatttcgaaaactgactattgtagctaactattgtagttttcgatgccgaaatacttttggatcaatccaaccttcctggctgacaacagaccaggaaccatctttttccaaagttcgagtggctgcagattactcagattctgttccagattcaaagtacacaagagatcggggttaccatcctcttgaagaagttaaagaacgtccaaaaaagaaggacctgtcactgacagatgtggaaactgctagaactgtagtagaggtaccctggtgcatctatacatttgtttagttactgatgcatgtaaatcgttataattttgcataggaatgacttacaagattcctcaatcactcaaccttaggctgagtaaatatctgtaaactgtaaaagttaagcaataaaaaattattcctgttgtaaaacaattaaactggtgatcttaccttgtgtatcgaatccctatcatactctggataacttttctatcttgtctaggccaatagcaagggattacttgtgttccctgcaagagtgcataatgaacctcatgggcatgttgcttggtcagactttcagtatattgtagatgactatggaggtaatgccttaatgtgcagcatatatttttacagtagggcattcatagtcctcattttcatataacaagttctgtacttatgtacagacattttctttcaagtacccgacagtgagaacatcttggaagatgatgctgcaaacaatcctgtggtaagattactctactttagtactttcatgttggcgtatgtcttcacaagcacatatcatgttgaatgatcactagcgccatgccaaaaggatcagagttttggaaatgttgtaaactgttatgcaccagtattctagtgggaatggcatatctgcttagttcttatcggaatggcattttaattgcagacagttttgattggaatggatggccctattattggagaaactagtgtggtgactagtgattttagcgactacatggatgttgaaaattttatagacatgcctgatgagaacgacagcaaggtttgccaaataaatcatcgcctgctttcagctggttttatgacaagttttctatcagcaacaattactgtcattagttgttgatatttcctttgtgatatgtcgcagatcgatacagaaataactgacattcttatagagtgggggatgccagcaacaatgcgtgcaatacatccaatttattttgcgaagtgtttgacaaaggtaaaccgtcaaaagttattgcaagcatcagcaaccattgaaatagtggagcagatgaaaactttaactaggataactttcataaatgtattggcaatgtgaacaatgaatatactgtgagtgattagttaattccaacctacatcatattcttagaaataatgttgtgaagggtgcaaagtctttatcttctggtaacaaaagtaagagcctggacctcaacttgatacttcaaaaagggaaaaagaaggtagaaattcaaggtatggccttacctatttcaagatacactctgtcaactgtaacagaaaaaaaaatagagatctgaacttagtggtcagataaaaggaagacaaaaggcatttttgtctcttgttctgggatatgtattcaatcagttagtactggttgtatatgaaagatatcattaaaaaaatgagtaaaatggtaaacaaaagaacaggatgaacttttgaaccagcaacttgaacttactgttttgctccaaattttcctataacagttcatgaaaaggtagatgctttgggaagcatagttcgtaacctaaattataacgagcaccatattacatatcaaccacctagtccatgataaatatactgtgtattcttttgctatgcaggctgttcatgataaacacagggaaaagatggatagtccatcaaatggtgtctcaattgtaggatatttgagacctgctttcatagaagaagaatcttatctaaggagcttatttcatggtgagtgcaatggtgatggttattcgtctgattggagaggtaattctttgctttatcttggttacttctgttaatactactctttgattctggtttatttgttctaatacacaagaaatcaaatagatgaatgcaaaagagaacctgcaccagcttctggaaccaatggcctaattggtaagttgatcagttgtgatcaattcattcagtgcacacttttgtttaaattttgttgctaatgttaattcaatatttagatgatgataaatcgagatttgatttcacgaatgtgggaagtagcactgattcaacaatctacaaactggaaataatgacggttgagctgttttccatatatgggaagcaggtaaggacttccctcttctgtccaatgtattggatctatactggttcagaatgcatacatgactcgcataacggaaagttgaatccatgtctaaatgataaacaggagataattttctcaactttcttggcttggttggttgttctacgacattactttcattctgttaatatctgcagttgatgattgatccacaagattttcaagatgcagaaccagatattcttgcaaattctgcttcagaaattataaatcgcattaaagaaaacgatgatcagtgcgctatggcactcaggtccctctgtcataggaaaaaaggcctcactgtcgaggtatgttcctgttcatcaatgccttaatccatgttccttgttccttatgttttcagttggcatttggattattacttccatagagtaagctaaattttgcagtatggtatgttttacaggaggctagcttgattagcatcgacagtctcggtatcgatgtaagagctttctctggtttggaagctcggacagttagattttcgtttaatgcgcaggttagctcttactcttagactcaatttttcgcatgtcctgtcacctatttaattttcatggagcctataacaaatcatttggaacctttggtttcaggcactctctgaacgttcagcagagaagaagataaggcgaatgcttttccctcgtcgtaagaacgtgaaaccttctactgaagatgaatgttaacctatcaaaacctggttaggacacaagagagtaaagggattcagcataagatgtgcatccaatctgatgcgaattcgttagagatactgcaaatctgccgactatgaaaatgacctcatttcctgaagagttag

SEQ ID NO: 60707 - DNA, 11551 bp, Oryza sativa
  unsure (1)..(11551): unsure at all n locations
cccattttaagtgtagttcatccgtcttatttaatttttttataattagtatttttattgttattagatgataaaacataaataatattttatatgtgacttatttttttaaaaaaaaagttaaataagacggacgatcaaacattgaggacagacacccacaactgcacttaaaatgggatggagtagaaatctacatcagagagaaagtttgctatgaaaaatgtactactactaccaatctgtctgttggtgaacatactactacaacttttttaaaaattcttttccatcaatgaactgacaagtgataaggctgtgagctagtgaggttagcaggttaatgttcttgttcttgatggcatagtggcagtcaccatcctgaaacgaaactagtggcgatgcttttctgtactaagctatagctcgatcgatgcaagcacgagtgtcagtgtcatctcttttttgttttttctcgctttctgccttggattggtctggtcgtgcccgcttttttcccgcgaaatttgattcgggagagaagctgatggggagagcatttcggcgccatctttgattaccgcgtgtgtgcagaaaaaggcgcaccggtggcagagcagaaatgaaaagaggatgcattcacagatttaagagatattttacggtcgtcgagaatattttaagggtgaataacatatcgcctctggataatatttcgaggacattgaagaattatattgagttaaatgcaccgatcacttcaattacgggtaaaggtaaaagaattctactgagacgatgcatcagatgcatcaaatagttcaacctaaaagcttagtccgataaaaactctattaactcgagacttttggctcaatggaatatgtataccaatcaactgttggcagcttttttttcagttcgagcccggctcgcaacaacaaggcttttggtcatatcatatctcggcgcctcccttgacatgttataatgcatccgcattggcagcgagtggaagagttgggttcgattccctttatacgcgatgtggcgaaaaagactgattcaacgaaatatgccatgcctgcattaagatttaaaacgtgtcgtctagcactagacatcaacaccgtggggccattccggataatgagtttcgcgcagcggtttcgaagactgaagctcttcttgcaagtatcaaaaagtcagaatgccaaataagagtttcttgtgccaaaggtaaggatcatcccatacagagtaatgggcttcaccgctgcgcgccttttcccttttagcctttgacaaacctgcaggtagctcattagtgaccaaataatggaaaatatccgctgaggtacttgcatgcagaccggagaggaggaggaaaacttagaatgtcgtcttttgcgacataaccagggccctcttgcccaaattgaaacgttaaatccacgatgcgatgtccatctttttcatttcataatttcctggaaaaaaagaattaactaatgaatcaaacttatctttatggaagattcgggaatatctacacgagtactcattttgcaaacatagcagaaaatctaaatgcgcctttggtgtcttggctggtaactttctcgtattcttagtccgtcagaaggggatcgagaaaattaaatataaactaatggtttgcaaaatcaatgtcttactggatttcgtctatccttagcttactgccctaagatttatatgcttggattattcgtaatctacctcgtggttacgtttttttatcttagaaggagttgcaatctacaaggcctataacgccgtatcagatctttccattgccctatggtcacttgcttaaaaacggaaaagagactgaacttcacttaggctttctcgcaagcttattagagcattgaattgagctatactaagagtaagatggcttttattctactaaatccaaagaatgctggctagggtgacgctcgtgcttctttcgagtaaggcaaacttagtaagggggtcgtgttattaagtatatttcttagctacaagcctggcctttcacttttcttagttcccctttttccaaccttttccattccatatctcaccactcttctttcccggataggtgcagaagcacacacatggggagtggattcaattagtattgcactcgcaaaaggaataggaataagcctcgtgatctaggcatctttcatcccgaggtagttccctaccaaaccccccattggtctttaaaaggaaggaacggcattttttacgaatgggagatcctataaaatgaagagcggctcaggtgcttttttctcttgccttctggatggttctgaagtagtgaacagcttccgaccattatgaccttttattgaattttggattttctataggagctcactactgctgcatttcaaatgtgcccgcctattgccttaatttacagacctctgcgattcacatatagccccactaatgtaagacagctcaagcgagtttagcctgagatataaaatcacactagccaataaaaaaagtagccaaacaaagccaggtagttttcatccaggtgaacaagtagaaagagcttacttggtagtggggaactcttgctgcattatctgagtgtatatgccttttaaaaactagcatcgtaggaactttaagaaaaaggatattgttttagcagctcttatttctattttactgctcaactagaaggtaatgcctttttttttgtgattcgagcagttcttgtcacgagatgatgggccagagaaaagtttgataggaaaggaaggcgacagttaaataaaaaaaagaaagggaagatgatactgatataagagtactgctctttgccctaagattacgatcagtcactttttatgtttcaatcagctcctcacttcttattaaggttttcgtgaccgacaacagagaggaaaagaggaagcaaacatagctagctcacgaaagaaagcttgcaactacgcgttatatattttattttcaactgcgctaataagggcacatccgctttctctgtatgtagattaaaaaaatacataccatattttttcccttgctttgctatttgaatgcttacctcagtgcaagagcagggaagaggtttgattgctaataaaatgagtggaagaaggccgtcatggaagagtttggggtccaaagccacaccttctttctcccataggaatagaggtcaggagctgccggcagggcgctgcttttaatctgactgatggctcaagataagttggagacgtacttgagatagataatttatgtatttcgctactccacagagggactttcctgaattagtgatacgaaaaagtaaacgaataaatgctggaaaagcaagaaaacgtatgcgcaggcgcaagggaatgaatatcaaatattatcgggacccaatcgaatatgaaagaaaaaaagggttgatcgccctccgatctttcctttgaacgagcagttagcgaagcgatgaaagtgcttcgcgcgagactgcgggtgggtgtgggaactgtggcggcgttgtgcggatgggttcttttccgcctggtggaggtttcgctaaataaagaccctctaaatccctgggcgagtaccgcttcactcgtcttatcaactaatagcgctaggttaactatttaatatctctagcgtattcgctcgtgctgatgtttaatcatgcgatgccaatgatgtaagcgcgggcccgcaggtgcagacaggttcgtcgggggttatgcaagcttcagaggtggggggtacgattgtggaagatcgcgtggaggcaggggttggagatgtgatgcacggatgcggggaattgggtggaaggacagtcgttaatgtggagtcaggtttgacgggcgtgaggcaagaagtggagggaagtgggatctagattagaagagataaatacgatattcctgatctgatacttttcttttcttgagaagtagggacccaagccaagaattacgtattacaagtggactagtattcataggggccttttctttcgagaaggctttaataagaaaagaatttggtttggtagaccaaaaaaaaaccttctatcgactagagtttgatgtcgatttatccacacttccatgacttttagaggaaagctaactgcttgctggctggaagctgtatgagcgactgagaataccatagctatacttaaaagtaaaacactaggaaaagcccatatgcgacgaagattttttgttgctgttggaacaagaaaaagtccaaaccccattgacataataactggaagtgggagaagagggattacccatgcatattgatatgtatgttccataagaaaagaaattgcaatttttacttgaaaattttacttcaatttttctataaaattgaaaaaagtttccgattcaccaaactaattcttatctatttctgaaggaataaaaaaaatactagaattcttaatttttcaaaaattttctcattgaaacaatcaaaaaataagaataggttttgttggttaaagtcaaaaagttaatgaaataacttcgttacctagttattacctaaagaaggacttttattaaaatacaaaaaaaagattgaatcattttactttaatatttttttgtattaaaatgaagcagctcccttgtttcgtaactcaaattgattggaattcaaccctgctatgatccctcctgccgagaagggtggaaggacaggggagcacgcctgtggttgagctagtgcttcataccttactggacaaggaaggaaaggcaaggaggatcagtacgggagagaaagtgatttaagaatgtgaatttgatttgataagtaatcaaggcaattagcttaggttcatcccgaatccattccatgtttcttaaacaagtccttcaaaccatcgtgctaacaagccattctcctccgaaagtcctagagctttttctggtccatatgcagccttgaagaatcgagatgccatgtagaacaaagaggcgctggtctgggcctatttacaagcgaacccgctctatgacggctaagttacatgcacacccccattttgaaggcttagttacacgtataatagtctgcttgctctcatgtttagctgtgtacccattttggggctttactctttcatgatggaacgaggagcttgagttgatttgcggcagcagcggcaagcttgtgtcgactgcagacaacttgaatccgttagcaacggtagtgcgaagcagcttgaactgacttgttctagccattggccggctgcgactatgagtcttccttttctagccgaagaaaactatcataatgcttccggtcgaggaaaggttgaaaccattttagagctaggcgtggacgtatcgaactgaaataagatctaagattgacatcttgatacaatgatttaccataataataaatagagtcaatggtgacaaagccgtgggaagagccgcttcttttttgcggcgggggcttccattcaccagcggcagccccaccccctgtagagttactcgggccagcctccccttgtagctggggtagactggtagtagtttcacctataaaattttgcatttgtggaatgtaggttggaactacctgttccgggattgtagaaaggaagggctccacagttgaaactacctgttctggcatttccgaaaggaaaggcaggacagctaaaaataattcgctgtcagccgcagtatagatacttcgagttttggtaactctggaagtagcgctacagattgaagtttttctgcccccgattataagttctcgtcactgcatttccttagttggatccgctctttctctctcgtgcagttgttgcttccggctatttattcagtcgtcaatcagcattgatccgggtagttagtcagtctctctcttttttcccgtccttctctatctatgaaattcctaattaagggctcaccatttcaatgtctatatctgtggttccagaagtggaattgcccggaatcaaaccagtgaagggagtcccgagcgcacccttccatcccaagcgtccttccttttttttcccggttcaccacccactcattaaagtggctacgtccggggggcttacttatcgaccacatacccactattctttcccgacgcctcctttctcttgcttgatggaatagttcaatgcccgagctcctgctttgcttgcgttcttcaccggcactcgccagatgtatcactcatcccgaaaataaggcaaggagtctgcagtttgttataatcattacnnnnnnnnnnnnnnnnnnnnnnnnnnnnnnnnnnnnnnnnnnnnnnnnnnnnnnnnnnnnggagttgtggcatccaagacttgtttctagcaagcgagttacataagaaaccgaatctctaagttcctatgactttcgacttgttgaaccaggttcggtacgacctataagcgtaacttttgacttccttgccgtttgtgaattgagtcaatcgagttacgtttgcaaaatgaatggaattctggagtggaccgaatatccatggcagaaccccttatttgtgttgttggttggtctttctcaacgtggtctatagcacgaaaaaccattctttacaagatagggccgttcacatgaaagataagaaaaaatccattcttcatggtcgggcgcatttctccaaatcctccaggatcacaagtggaacgctaagcaagggtggggaggctgcgagctccgcgtcgaacagaaagaagcaagcagggggtgttgccgtagcgcgctggggagcaagcgtaggcaaccaaactaaataaggctaaaaaaaagtagaatccaaaaatgttgggattgtattaatgggcgatgggttgatgatacaagagggcagttttgtaaaagcaacaggaagaattgctcagatacccgtgagcgaggcttacttgggtccttatcctgcaatttggagagtagttgatatggtctttcttggctttggctttcaaagtgcagttcgaaaagagtgagttgctgtcaatggcgggaatgaaatatataaggatagggtggaaaagagtgaaatgagactactatacgcgttttccgaggagcaacatgatactttctttgccgttggttcccaactctccttccttttaatttccttcctcccttaaagctgaatctcaccattcgagaagctatggaatcgtcgacccccttaccaagtagactatgaagtcactttcgtttttttggttgtgtatgctatgtgtttgtgccccgtcatctacgaagtaaattcgacaagaaagctatccgatgtatattcgttggatatgataatgagcgaaaagggtggaagtgttgtgacccgaatacgaacccttgctatacatcctgagtgtggtcttcgcaattcttgggttggatgaattatcggaggaggatcgcggcaataatgagccaaactagtatttgcggtgaatcccccggttaagtagtcatgcattacaataggaacccctaattccctcgcaaatacagctctcttaatcatttcttcgcatgtacctgcagtcgcattcaagtaatgccccttaatttcaccggtttcggcctgtgctttataaatagcttcggcacaaaacacaaaacggtccctccaacgcataaatggttgtgagtttacgttttcatcatctttggtaaaatcaagtccaccacgtagacactcataacatgctctccaagcagaaatatcacaagtaccgccgcgaccagggccgtcgcaaggaaaactatatccaaaatcttttttatccgtggcgaaccatgctgcttgcgtagtgggagatgcccgcccgtcgggcccggcctgcttcctgcccgaaagaaggctagcaggactagtgcgaagaactgcttcaaatacagtatcgggaagcactgcttggggaacttcaatatccacaggcttattcgctaaatggcaattggcacatacaattcgtggtctgcagctcctgcctttctttacccttccgcttttcgggaaacagattacgctttcacgtagaaaatggaaggtcttcgctatatataaaagagctctttacccttggcaatagagcagcgcctacgtacagtaccttttatcctttttttattcctttactattatgtatatgtatgtgggtttacataactttttatgagcacagggttttttataatgtaaaatttggatatgaccttttcaaaggtttactacgaccaagaaagatgtcccatcagttaattcagatagtaagcaagaactaggtggattcaaacaacattgttcagttctttgaataaataataagacctttttttgtgcagaagcaattgtcgtacgacctgtaagcgtaacttttgacttccttgccgtttgtgaattgagtcaatcgagttacgtttgcaaaatgaatggaattctggagtggaccgaatatccatggcagaaccccacactggtcaaaaataaaagtcaatctctctaaaaaataagcacgcagtatttacagaaaaagttttcatttattgggaaagaatcaatgacatacaatgcattacagacgtatgatcattacccttagggaagcaagagtctcatagggaaggagatcctgcacagaccaatcaggaagagagtcttgttgtcaatgaaagcaatgagactatgtcacatatctgcctatctcgtgttgtgagctaaaaagtacccaccagggggtggaccaagaaagaggcaggcgattgggtccttcccatcctctgtgatgtcagtctctttgtcattctttcacccttgctgagtagcgaagtgagcatactcaagatccaattcatcaatcatttgagttggtacgaacataggaatccagactccgcttgattcgatcttcagttcgaaacccgtgcttaaatcctactcaaggcccactacgggtagcgagcaattaacaaatagagacaaggatgaggagaaatgacgcatatcagctgaaacaaagaagagtttggtccgctcttcattcaggcccggcccgcccatctgctgctaggtccgagaatggcgccaggcgagggtgccgctatgccccgcagctctgctgtggccggcccccagactatgcaaaagaatcgaggccgggggatgtcgtccatcagggcccccgccttacaaatgggtcgtcccccttaatgaatcgaatggtccttcgaccctcgtttgattccgacggccggcatagatgaaatcccatgagacccgcccactattactacaaaaaagccctgcccctggcaccttcgctacttcatattcatcattttctaaaaaaagggtaaggggtctcttttctgcaacggaaaaaaaatcagcggagctgatttgactcagcacaacctaacgatatatccaataccaatgatctatgcctaccgatacgatactcaaaaaataaattactatataaagagctaatgtcaataaaaaggctaatgacagagaagagtcaatctcctttactcctcccgacacctcaagatgagaaaatcccttcatctaggcgggcgctcatgcctactcagggagctacttctaccatggctgacacattatctccacaaaaaccaacgacccatcccgaagagaagttgactgacggggatgtctcgagaagaaattccagaattggtagctggaatttcacacctattttctcacttctggaccaagtcctcaatttacacataatcatgttttcttggtatctataattatagagcatctaaaaattgtgatagattgcagtcttgataatgctaacatagtattggtaatctaacaagcctttcgtttcttgtgccactcagccctgaggagggcgcctgctcgacccagtcaggtactactccgccgccggccccgagtaactctgcgggggtcggtgcagccctttcttctattccggagtgtataaacaaggatcctcaaaaagtgaaatcatttcgttaatggcatttcagaaatgagtcataggcgcctgtacaatgacagaatagagagtcctttttttccagaatgaatcattctattcaaatgtcaataggaaacctgggttccgttagcctcaattgaaacatagagttcaatcccagtgagctgtggtttcctactgtccattcggcaagaagaagaaagtacatagcgatttccgccctttttaaagtctatttcctcccctacacaggatcaccaaaacgttgtttttgtgcctatgttcacacttcgttcctgctcaactgtgctttttagttaaaacaagctaattcgtttgttctagtccggtaaaacctactatttgtgagatttcttactcctcaatccacttattcgttcccttctttcatatacctccccaccaatagatagagacaaatggagggatcttggagtcatttgtagactggacgtgttgttcagttgagtagactgtgcatatgggagtggatcctagatgataggaagcgctcaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggcgggatatcttactcaactgctagcaggatagccaagcattcctttttatctgggatccgctttcactacgctgggtatggtccatcccacaaccaagtatcatagcatcctggtccggatcgatgccgtgaagcatcttattcctgtggttctacagccgtaggagaagattggtttggatttctcacatctttttgataacttgttttgcgagtctccgaccaggaaaaaaggtattactttactgaactgaccccgggcgtgttaatatcagttgaaacacgctttggtccctcatccgtgaatcaatccctagcgggtcttgtctcgtaatcaccagatcctttttatcaagcgtgcaggaccagtgaagaaaaaagatttgcaaaaacacacatgaaacatattgaactcctaagaaacacctgaccttaggtgcttttttctcttgccttctggatggttctgaagtagtgaacagcttccgaccattatgaccttttattgaattttggattttctataggagctctctactgctgcatttcaaatgtgcccgcctattgccttaatttacagacctctgcgattcacatatagccccactaatgtaagacagctcaagcgagtctagcctgagatataaaatcacactagccaataaaaaaagtagccaaacaaagccaggtagttttcatccaggtgaacaagtagaaagagc

SEQ ID NO: 60708 - DNA, 6323 bp, Oryza sativa
gtggatcccggtttttcttaatgtaatctccattacagatggacaaatcgttgaaatgccataaagcgcgaaccaacatccatgatacgaaaaccaaaatcagaatgaggaagaaaaagatatcgtgatgtaagtcaatgattccttgcatcataggtgttgcagcgtcttgagatcctaattgccatggttccgcagcattacaaagagcgattgtgaggaatcgacattctaatgaacgaagaatcattggaatttcccatcttttttagctctgctcctagaaaggagactgatcttgacgtcggcgttggtttttccaacgaaaaacgagaacatactttcacgaacttctaatccaaaatgctagttgccttgtaacgcatacactggagcgtttgtcccatcgacgaaggccaatgagactactatacgcgttttccgaggagcaacatgatactttctttgccaggaccgactttcccacttggatgtactcatgatgggtgacgtttccacgtcttaacgttgagttgaaacctgaaaacaatattcaactccatgccttcaagagcataaatgggtaacagccagaaatacatgaagaatcacttctttcgagaatgtgcctaagcacgtgtttcattaagaagatacatgaagaatcacataccagcaaaaatgtcttcacttaaatttataccacaggaagccttgctaatgcctcctcttgtaatgttaaaaatcctgtcgaacacatcaggatgtccatagtgaaatcgtaccctgcacagagaatgaagtatgtcagatacacagcatttagactacaagtctgatgccttctgccctctcagacagtactgccacactttatcccgtcaacatgcttaaacttgaaaagcttcaatgcagaaaaaagtttcaagcaatgtagattattgatctaatctgtaacaccttatttacttgtaatctcagacacatgttcatgtgcattttcaagggcagaaagaatatccttaaagggtcatctcgcaatctttttctaggccaattctggatcatcttctggaatcgtataactgtcaaaagtgagtgactgttcatcggaactgttatagtccgaatactcataaggttgggtcgacgcctgccgtccttacattctatttaggattaggaataggtgtaatcagacctgcttttgacatatctatcctatccttatttgggtaccatatgcactcgaaagcgttagcacgcgcatccgttttcttgctccttggcttcaaacaatcgattgaatctggattcctttgcttatccttcctggctatagtctctcttgtgccttcggcagttcagttaaagatttctgtatcagtagtttgtttccccatttgctaaacaattatttggttatgccattttgggcgtagtaccggtattagagatcaggaaagtagttgggagagctcatgagactctttttgtgaaattcataagtctcaattccccaaaaactcgagttccttttggatttccttcttgattaatgacaaccgtcatcatatcgtattatcataccgttgtcacgtttgagttctttacatgtacgtacaattactgctcaactatatactaataaagaataaatatatagttggtattacgcttgtctgaaaactttgcaatcattggtattatgagaaccaaaattatgccacttgcaatatctcctcttgcctagttcctcagctgatggaattacatgaccagcagcgaagttgaatttgtttttcccgaagcaacaaatcgaaaatcttatcaaccttggtgatatcaaaatcaaaattttcctctttcccagaacttctcacccattgacatggcacaaccttcttgctcctgacccactcggctgctgctactccggattcatcctcttcatcggaaccatacatgtaagtgtatatgtggttgatctttttgaaatttttcttcgcctctgcaaacctttgttcgtgtagggttaccttctgtgcaagatgagataagctttcaaactattattactatgagatattattactatgaaggataaccaaagatcaaaacgctgattcaaaattctattgcatcatccgcccacgaggaattgccgcttcaggctcgcgattcgactttgatcgttatggattggtaccaaaccaagatcaagtcctaggcaagcgggaaacctgaaaaccaaaatcatgcgatcattccttcaagagcataaatgggtaacaactagaaatacatgaagaatcacttctttcgagaatgtgcctgagcacgtgtttcattaagaagatacatgaagaatcacataccagcaaaaatgtcttcacttaaatttataccacaggaagccttgctaatgcctcctcttgtaatgttaaaaatcctgtcgaacacatcaggatgtccatagtgaaatcgtaccctgcacagagaatgaagtatgtcagatacacagcatttagactacaagtctgatgccttctgccctctcagacagtactgccagacttgtgcgcgctacaattgctttagagggagctgctgtcggtattggaaacgtcctcagttcttcgattcattccgtggcgcgaaatccttcattggctaaacaattatttggttatgccatttttggcgtagtaccggtattagagatcaggaaagtagttgggagagctcatgagactctttttgtgaaattcataagtctcaattccccaaaaactcgagttccttttggatttccttcttgattaatgacaaccgtcatcatatcgtattatcataccgttgtcacgtttgagttctttacatgagtttttgagctccattatgtggacttcatcaattttttaattatggacttggtggtagtggtcaatactaactgcaccgtctaaatgctccctgaccaagttagcgtactcgccagggttgagttgagggggcagcccgtgcgctaattgggctctgaggttggctatacgcgaaaaaagctcactttctactgagctgtcctaaactgttccagaatgttatttgtttcataggaagattccaaaagcacattgtgatgccgaaagaatcttcggaaccggtggggttctgattgaaggctagacaaataacatgactgaaatatgtaaatcaaaccagtgaaatagctttataatattatatagatatagaataccaaaagcctgataatgggttaaaaaaatccaaaataagctttttgctttctttttattttgtgtgcgctttcctcctgccttcccgaccacggataggctatggggctttgcacttcttccgcgatataggacgattcgctcgctatctgaggcgttaatttacctactaaaatatcgcctgtttctacccaggaccccaacttcacaactccatttctttccaaattgcggagtaaatgttcttctagatgtggtatttctttagtgattttttcagcggagccttggcttgtcgtatccgtctgaatttcatattttcggatgtgaaaagaagtataaatatcctcatataccaaacgttcgctaatctcattcccaccccgtcgtcgagagcagccagcccgacgtttttatgcgagtgccccatgaagagattttcaatctcgaatctccgtctggttcccaggtggggtattcatccattgatcgaccaactgataaaataagcaattcttccactttctctctgttgcctatcggattgtcgcctgttgatggtaggtttgttctagaggtagacgaggcattactttggctaggtggagtgtttgcgagtactgaagtcaatcttttccaaaaaaggtttagtaaatgcacatcctcgccgctcggctcctccctcattgcccatagtccctaaagtctgtatgtctcttgtctctttgagaccggggatttcccaactgttccttcccttacaccctaatcttaatacccctgttacccgcctgtaggcggatcctaccaaccaaaataaagtgaccgaaagacacaattgcatcggtccaatgagacatggaagcaccagtagatattgaaagaaaaactattgttcggtattattgttgtagttctttgttcctttcgtcgatgaaagtacaaccacccattttccacactttttcatattgacttaagtcagcgaattacccgcggcgaggaggagagattagaactcctggattgaaaaactttttcttctccttgctaattgccgttcctgcccttcgcttcaggccatagtgcttctgaattatttctatacccctttgatgatgcagcctctgactttcgtgggtaaactcaagtctacctcgtaagccacttaaagatctttgagcagctcgagagagaaatccgtcttcattggtacaaaataaccttcgacatttggtactggtcaataacttacggcgagacgagcatccctataccacgtgtatccacactcgtttgtccttttctacttagttgtacagatcacttcagaaaatcgtataaaaatcaagcaagaaaacgtatgcgctttagcaacaaagcgctcatcccttcttctttcgcttggaatcccctcgcttcttctttcgcttctacgctcgtgctttcagcaagttcgtaccagtcgtcaggagctccaacctccgcgcctagccgcaaggaacctaaatgctggttctatcccggccaagcaagcaaggtgaaccccggtgggaaagaaagaccagggggaagaagctgtcaacacttctacaatccagtctcttaacactagctttacttgggaaagtagtgaaagtcctgctgctggataaagatactggaaaaagtctcaagttccactaggcgagatgaaaaagttcagaactgggatgccaaaaagagccgatttacaagcaaaatgaaaaaactaccactttcccactatgtcggaactagttttttcggctaaccctatctatctccttaccctgtaagaaaagcaaggcgccctccagtctcgttcgctgggtggtcagagtacagcttcgccttctcctcaggcggcaacttgaaaaactccattccaatccccaacaaagcgggattcaaaatgattgacaggtaccaaagcaaacatcccttttccccttgcccccatgaggaatcctttgtctacctggatcttcaaagagcctcatagccaaaaattctcaagcagagaagccatttctttctctctttgatacaaattcccatctcatgaaatttctattcaattttattttaaaaaatagggctaaacttctatctgagcctttacgagcaggatccggagtgggttgcgttcattcagcagatcaccggcatacctagcgtaaaagaagagttgctgcccatctgcatgttccattactttttcaagagctaggtctaatggaaaaattcattaataaacttgttttcatctggcagataagcttttgagaagagaccactttgataacgagctttcgggttgccgtattgataccgcccttcgggggaacaggatgacctcgaaaaagaatacaattaaagatgttgattctagaaggaccttagagtattgtcactgttccactggaataaaaatatttgtcagtggtcagtttagttcgaacaacaaagtgagtggctggacttctagttttgaactctggctagagtaaccaaccatcgaaccatctccaggtcacagtcacccaccaggaaggcatagaggcaagacagaaagtcaagacagcaggaatcgaacctagtcatagtaaaatgatcattcaaagtagacttttgtcatagggcaaaggagcttagaagggtgatgtagggaagtagtaagggatgaaatcacttagatgttgtatgacggaacggccgggatgaatcaaaggcatggaaagggaagagatagccctacccttcagtgaaccactcaaggtcaacctacgcctgatatcggcggttattatacgatgcagttcgtggattggcaaaacctggggcgccccggcaggaattctgtaagcttgacttgcgtgcagcgtttgggaatcaaagataaaaaataactctatgggacttacggaactggaaagaaggtagcacctaggcgtaagaaagaaagtaaatagagacagcacctactacgctatctattgaagcttactatataatatataaaagaaaaaaaaaggccatata

SEQ ID NO: 60709 - DNA, 780 bp, Oryza sativa
tacttggctggcataagaaagaaggcgccccggcaggaattctataagcttgacttgcgtgcagcgtttgggaatcaaagataaaaaataactctatgggacttacggaactagaaagaaggtagcacctaggcgtaagaaagaaagtaaatagagacagcacctactacgctatctattgaagcttactatataatatataaaagaaaaaaaaggccatataggcctattgggtgccgatccactcgatcctatgctatgcatttgtgaccaaggcgaggtaagatcatgaatacaagatggcgatgagtcatgccaagtttggggagtgttgctcataccctcattgcatgttttaaaatagggcatactgcctgtgatttactattgatttccaagtcgacacgagattctatttctttccctctacactatgtacttacttttccggctatgcgagagagactttatccttggtctataggcacaaatccagtagaaaataccaatccaacttcctcctaaaatcacttctaacaggcgagcgtgacttgtgcgtgctacaattgctttagcgggagctgctgtcggtattggaaacgtcctcagttcttcgattcattccgtggcgcgaaatccttcattggctaaacaattatttggttatgccattttgggcgtagtaccggtattagagatcaggaaagtagttgggagagctcatgagactctttttgtgaaattcataagtctcaattccccaaaaactcgagttccttt

SEQ ID NO: 60710 - DNA, 5145 bp, Oryza sativa
cttcccccgaagaatcgccaccaaagacattcttccatggttttttttacatggggggggctcggttttgtaaaagattatgggtttgtgtcgaattattttattcttcttacccagtccttcggtggaatgatgaacatacaaagctcatgaataggattgacttccctaggcgagattagggttagaggagatagcaaacatggagattaatgcttcttcaggttctaattgcttttctgttgcactattgcttaactcctcctgtggatcttcctttcacaagttgacaatcacaatcgcagtacctaaacgtcttgcagtgatatggagttaccaaccacctcgacctagccaaagggccaaatcaagatgggtttttgtagaaaacggctaaaccggctagcggagctgatttagagagacccgacgaaaacagattcgggttcggaccctgacggtcagaccggccgcatacctgcggtaagaccggagttcaggccacggtcagaccgcccacatacctgtggtctgacctgtcctgtgaaggaaacccgacactttctaaactttggtaattttcctctatttcatccatatgtgccaaatttggatgtaaacatcaacttaaatgtttaaccagaaagattaaactggtgaaaaaagacaaaacagtttacttatcttctaacaaattcgagatctgaatacgataaagtcgtcgtagcttctggcaccaataatacgcctgattctcatgctcacaagagcacaaagtagccaggccagccttgttgccttcgttgcatggagaagaaagatacacatcaccagagtgtgggatcatacaggagaagaaaggatagaacgaaataccaccttcgtcttttaatatatgacgatattgatgtttacacatactgttcaccattcatccaaattgaaatactaaacaaatatcatttgtaacttgtttttgttattaaagattttttaaatcatgacgtattttttttatttttgcaataagcttttaaataagacaaatcatcaaacgacacgtccaaaaaaatttaaaagcaaagagcatttttcagctcgaagaactaagaaacatagggagtactctcttcgttacgaaataagtttagttttatccatcacacataccaatataaaattaaaaaaaaagactacaatacccgaactttattaaatcctaatgcaattattcctatctttatctactcccaaatcccaatgcaattttttacaaactctgatacaattgctaaagataaatttgtcttgagattaacaattgagacataaataaagtcgtttgggatagtgacacggtctccaaaacacaattttgacttcctgtttttataaaaaatatttattgaattttatgaaagtatttttcaagacaaatctatgtatatagtttttatattttcaaactcaacagcttaagagttattcatgatttatattcctaagatttgacttaaacattattctaaatgacttactttatgagtacggagggagtacgagctattagctccgtccaagaatgtactccctccgtttctaaatatttgacgctgttgactttttaaaacatgcttgaccattcgtattattaaaaaaattaagtaattattaattcttttcctatcatttgattcattgttaaatatactttcacgtatacatatagttttacatattttacagaaaaaattgtaaataagacgaacaattaaatatgtttatgtgctaaaaagtcaacggtgtcaaacatttacaaacggaaagagtactagcaagcacacatgtgcgttatcgtcttctcccggcgcgaccgcatgcggaggagagggacgcgacggccggtggcccgggcgttatcatcaaaaccatcaaatcagccgtgttgtcgatgcggcagccagccgatcggctcgccggacggccgcctgcgtttgtcccatcgtcctcgcgagtcctcccctcctaacctgcagtgctatatatgccacgacgagcaggaggcgaccagacggagagagagatcgatcgaacgaggcgtcgccgtcgatcgccgtcgtgccggatcgtttggttagcttgcaagacatgcttatatactccttccgttacatattatattataaatcgttttaactttgttttaattttttttcgttttcaaagtttgattaaatttataaaaaaaataacgatccttttaacataaaataaatatcctattaaaatatatccaatgttatatttaataaaactaatataatattatatataaatgatgctaaattaaattaaatcaaaacgagttataatagaaaatagaaaacagatgaagtatatatatactctatactgcgcgggcgtatggatcgccggagtcgccgttggaaaactacatgcgtgaatgcgtgattaaaagtcggcatgatccaccaccgcctgcagaaagaacaaagcacgacagatggtgacttgtggtaaagagattctgtgaaggggaaggtttaattttatgctgtcaattaagtaagtctctcatcggatgggctaaacagtcaaagaataaaccaaaatttaaattttcaaacttaattttgagattgattttgagatattttcaacgtagtttctttttcagcattgacttttaagtcaccaagaacatatatataaaagttttatctaaaaattcatttttattctctaataagccgttttggcttattagggaaaaagccaaacgatgagagcctaacctttcaagactaaaagaaaaatattattttagcagtatatagtttatttttctcttccatgatgttaaacccaagtgtataacagataatatgatcgatctgatggcgtctagaaggctcatggacaattattatatgctgctttttaccatacagtatattgggatcacggtgacctaattttaaggacttttttgaaactcaagaattttataagattttcatagagatccgttcgaagcaagtaaatgtttttttcctatagaagcaccgctatgatcttataagaagcagctagtatgtaagtcagttgaaggaatatgagaatctgaaaaaaaaagttttttcacttatatttctagtttgttatttcctccatcccaaaatatattcgtagtgctagtatgtggcacttcttataccaaaatctcttatatcataaaatgtggaaaatagttagattctataactactgattcctagaatcttttgaggacctgaagatttggaataaattacaggcgtaagaatctgcaataactgattgtttagcattatgaaaaacaactgattggtcagcttctgtaatctgcaaaaaatggctttttatcttctctcttctagttcatgaatctcacaaccacatattctcaatgtttaggtataactttatttcttcgagagagctaaacattttgagagaggcaatacttcttgagaatgctacatgctgggtccccttgtcccctgcctatccaaggacgagtgagctgagcaacaaggaggagggtgcccaccggcgaggacattcgacgtgggccgggggagaggacctgtttagcgagaggacgtgaccaccagcgacgagcactagcatgggggcgtggacgacagtaggctgtgtggttggcgacggtagcggtggctacttcttccctgggtcgccatggccgcgcgcgaaggtggccaccaccgttgtcgtcagcggatccagcagagggaggataggaagcgccatcgtcaccgccgctgcgccaagtgaggacggccagatccttctccactgatctcgattccccacggcagcaacgatgacaaaggctgatggaacgtgtagctggtactgatggataccttgtcagtattgtttgatacctatagggatcgaccggtgtcagtggatacctataggtatcatctgataccttgtcagtattgtttgatacttggtaggtatcagatccaggattccgtgtttcgcaagccccatgtacgcaagaagctttccaaatgcaattcgtgcattcgttagggcatgagcaacgtatcttgtcggactcggtagtaacgtgggcccaagatacatgtgatagtagtatatgaacttacccataatatttattcgtgtgagtgagaagtaaggtagggtccacttaaaagttgattcctatgaatggtgagaaacaataatttcatggttccttatactaatattttacttgcatgtgtcagatttactgtacaaataatgatatttatttcttatgttgctacttggtagcaagagtgcattcaatgcttaatacctagtttttcatcacattgtggatgtccttagagcaagtttaatagtatagccaactattagctccaatttatctatagccaatctaataactcattcatacaatagttacatactacactatcaataactggtcccacctgtcatacacacagtgtcttggagttcgtattacagctaactacaaatgtgtagcccgctgctcttctctccttatttatcttcttaaaatatgtttggagctgcctcctgctatttaatctgctcttaggcatgctgaaaattgaaatgcaatgaccggggcccacgcgtcagtaacggattcccacgccctcgcgcctcctcaaataccaccacccactccactccgctttccttcaacattcgcgacgagaagttcaaaaaaaaaaaaacattcgcgacgagcatccgatactcgccgccgccgcagcgcgcgccatgccgctctccgcaacggatgcggcggccgccgccgtcaagccgctgccgcgtgcgctctcgcttgcgggggcggccgtggcggcggccaccacgtcgctgatcctcatctccgtcgtcgtctcccgcgcccaccactccgcctcctcctcctcctcctcgccgccgccctccagcagcgcctccaccgcggcgccgctgcccgcgccacccaccccgtcgcccgtcccggagcacctccaccaccacccgccgccgccgccccccggcccgccgtgcccgccc

SEQ ID NO: 60711 - DNA, 1992 bp, Oryza sativa
ggacgcgcctgatgtggttcacaaggtgaaggatgctgcagacaggctacactggcacagcgaaatcgttgacactgagaatgggggcctggatcctgagaagcttctcatcgtggacaattctcttccattcccagatcaccctgcatgatgttgataatttccacatcttctctgatcatcatcttcagaatcagaaaagattgttcttggatgcttgtatacatgcacagatgaagagtataagaggactctacacgcaatagttacatatccagatgaccacatagccgaataatccaatgtatttgagctgtttactccactagacactgtcagattccaataaaccagtataggtaacttaatctcctgagctctgtgttgttcccagcatggtgttggatgtgcagagatgcaaccatgctcgattctgtagagatgtagtatctaattgctctgcatttgtatattgtatactagctgtgtattatcggtgagatttctgtgaaattccttcagagtttgccttgctttgcttgctaagcaatggcatgattcatgtatgatgatggaatctgtagcctctacagttttgctcaggtacttccaaatttttcaggctaaaggatgttcaaaagatgcctatgcttgtttgggatattgtacaagtaaagtgaagctgcagctgatcgaatatggacatgatattttcgcctctttattgaacattgaactgaaaagtttgagcttactacgatggcctctgctactactgccgaagtagtagcaacttggaatgactgaatagattaattaatagcaattagtactagcatgcaacatttttgcatgagaatctggaaaatgtattaatcttgtggaacacataatcccctttgctaatatgatgctggaaacatgtatatttatttggctatctatattcacaacacacaaggtaggttaccagtacagccaactgctactccagggccttgatccaagttaagcagctgaaatgtgtatacagtcagcagtcagcaccaggtgcttcccataattcatggctataatttatatacaatgaactggggtatttccttccaatatagtagtataacataaacttattattacatataaacgatacatatataatcaaaaggcaccactggttcaacgaaccacttacacttatatctctacgggtttctaaccagaaagcacactagttgctgttgttatttttcatagttgcacactagttggctataataataataataaatatagttgctgtttttttacatagttgcagactagttggctataatagtaatatagccaacacgcccctataataataatataccgagctaacactgcctgcttcttttgccacaaaacttgttcgagacttcctccacagtgagatccgcaaatttgtttgtacctagtgtgcatttgcagcaaccatattttttcacctgttcagcattgaacttttcgacatactggacagtagacttgaatacctcaaagcgataagccttctctgcctcgtctttgtaattacggttgaacttgttcatccactcttggaatctcaccttcagggcctgctcctcgtcttcagacaccttcttggagccctccatcctctcatcactgtcgcttgtcttcagatacttgaaagcttctgtaattatgaggtatagtagacatttcttgttaattatgaggaaacaaaaagagatttcacttcaggcaaagctgtccgtacctggttcccctgcagtgtttgtggttgccatagacacttccattgtgttaccaggccttaataatttgagttcacgttcccctgaaggcaccctgcaaaaggtaacgaaaacggaacatagttaaaacatgtagggttatgagtgatgaaatgctagatttttttcttttgctctaacttttctgttcgtaaagttgattgcacag

SEQ ID NO: 60712 - DNA, 6846 bp, Oryza sativa
  unsure (1)..(6846): unsure at all n locations
atttctgtgaaattcctgtcgggttcgccttgctttgctcgctaagcaatggcaatgattcatcattcatgtgtgatgatggaaaccgggaaatgggttgcatgtacttgtcttctcttaatctcttcatctaccaatcgttggacgatgtgattgggtgatgttcttgcttgtcctttcgtcctctcaaaattccaatttttccccctttgcttcgtgcaaaggacatcataactggttttgttagacgcacacagtgctatacatctccattctccagttctctgctttgcttattctattacactccctccgtccctaaatgtttgacgccgnngactntnnnaaanatgnnngaccgnncatnttattcaaaaacttttacaaaatatataaaattatatgtatacataaaagtatatttaacaatgaatcaaatgatagaaaaagaattaataattacttgattttttttaaataagacgaacggtcaaacatattttaaaaagtcaacagcgtcaaacatttagggacggagggagtactaaaaacttaccaacacatctcctagtgcgtttagagatggtaaggtctatgggttttttcacaaaccccatgtagccttcatatatttttaggtaaaaaatgtgtaaagattcaacccaacgttgttctagctgagctgttaggttgtgttttgaataacctgacgattcgttatcctgatcgacatgttattgatttaaaaggatctcacatactacaaaatatgcccgcccgcacataagtccattaaattacacgctcacacgtaacgaaatacatacaacctgtttggtttgggggaatttttgggagggattgagagtttagagatatgaggcaatttactgttttatttagttgggaaatgagaattttagtgggatagggattggaatggggaatttgggaaggaatttcctctttttcattttctgtgtaggaggtggtaattgggagggaatttctcatttactttacctaaacaaatcttaatcatccgtttttgttaataacctaatctctaactaaacccctatcaatttccaccacctctaccaaaaaaaattttaggattaaaattcaaattcctatcttaatctaaccatcaattttctaactcccaatccccttccatcaagttgccaaacgagccaatagtctattatagccacaacccaaccttttcttcttctttttccccctattttgatgaactaggtgaaaccccgcgcattgctgcgggaatttagtatgataacaataaaaataataacgtgtaaaataggtagataacatcagattaagtaaattaatatggtttataataatttaaatttaaatagtatgtagaatggtgattcaaatgtaaaaagtaaggtggtatgactttatggaagaagaaaagtagggagatagtttgaaccgtagattaatcatctaaaggctaaaaacaattgatgtgatataacttaattagaggaaaaaaggagaaagataatttggaccattaatcatttaagcactaactaagtgaggatgaactatataagtatataggatatcataaaacataataaaaatatacattgaaatattatgtgaattatgttggatgataatttaacatgtttgtatttgaaaagctcttaaattataaaaatacaaagatatagcatgtttgcatgatgtttaaatgtgatgattgttagtggatgatgatgtggcatatttgcatgttaagcttaaagagttagtggaggataactttatactaagataggataggtgacaaacaccatcaaacctcattcagttaatccttatcagggagagattggaggggatttattctacttctattgtggtgtagaattattcccccacaatcccctcgaaaccgaagaatgcctcgacgatattagtaatagcagggtttctagttgacagttgactcgttagtagctgacagcgggcccaccccgtgtgggacccaccgggcaggcacatctgatccaatcctaccagcttcttcggctcttcccataaactgcagagtactacgccgcgtcaaaacgcttagaaataggcagcagaaaaaaaaaaagaaaagaggaaaccgaactccgctataaaaccgcgcctccgccgcgacgaagccgaccaagtgaagcagcgccgccgccgccgacgacgacgacgacgacgacgaaaccgccggaggcagagaggagcagagnnnnnnnnnnnnnnnnnnnnnnnccccccctccctccctcccatgaaatccaacaccgttttcgagcttgatcgtctccgatttcgtttctgggcggcggcggagtactagtggagacgacgcggtttgtgtgggggatgggattcgtcggctcggcgctgcgctggggtgagtggatgtgggtgtaggctagtggggtgcgcgtgcgtgctagtttgattggtgttaggtgacgatttttttttttttttggatgcggcggtttgttaggcgcgtgggtttgtgttgtgcgaccatggtttggatctcggagctacgcatgcgtactgtttttgtgtttaggtttattggcaattatggctgcctcgtgagtactggctgtgttcgtgatgagataagttgattgaccagtttttcatgttgaatgaatgaaattgttttgagactttgtctttgagggtttatttgtttattgactatgtggtttatgttaccgacaccgtaaattctgtgtacagaaatctcatgtatgtgatgtatggaggtcaccatttttagccgagagagcaatttcatttttagacgatctggaattctctccttctgaatagcatcagcatcatagacgcccattgtggcagtacatatcctgaattcctgacgctgtatgtctctgctgacaatgtcttaataaggagcgaacggagaggattgcccactgaaatttattaagaatggggaacaatttaggctggaacattttacaaccggtctaaggacattgtctctgctgacaatctgatatatttcttggtaaaatttatgtgctgtacagactacaaggggtaaagtagtgagaagagatggtaaggtggcgccgctggatctgctgcaattgtcaagtgaacgagtctgatcagcttgaaaatggacatgccaaggtcctgactagtaatgcagatggtatgcttctttgaccttgcttgtgttctctatttatatttcttagtcctgcagtgtcacttcattgattgaaaacttaaaactccgtttctgattgttcacctttctacatttttttctccttttccaggagtgacaaagggtttgaaagattctgctactgaaaaagctcagccacaaaattcggctctcactatcaatattcctgttctatccttggacgaactagtagaaaagacagatgattttggctcaagtgctttgataggcgaaggttcttatggtagagtgtactacgctgttcttgacagtggaacaaaaattgcagtgaagaaacttgattctaatgaaaatgagcccacttcagaattcttgacccaggttgacttgcttttagagatatgaattattattatttggttatagcattaatgcatttctacagatggaggatcctaaacaacactgcttattttctgatgctaggtcgctttggtttcaagattgaaacatgaaaactttgtagatatgttgggatactgcacggagggtaaccttcgcctagtagcatatgaatttgccactatgggttcactgcatgatgttctacatggtatggttcggcatatccatcatgttctccagtttgactaactttactactgtttttgggtagctgggaacgggtgctgtatagctgcagcagaagcagatcaattgttgatatatcttttttaactttgtgtaacaggaagaaaaggggtgcaaggtgcacaacctggtccagcacttgattggatgcaacgagtaagaatagctgttgatgctgccaaaggacttgaatatctacatgagaaggttcagccctccattgttcatagggatattagatcaagtaacatactcttatttgaagacttcaaggcaaaagttgcagacttcaatctctcaaatcaggctccagatatggctgctcgtctgcattctactcgtgtactgggaacctttggttatcatgctccagagtaaaaattcttaccatattctgtgatgaactttattttactgttcaattgtagtttctttatagcattacttcttcaattaactttggaaaggaccagtatacaatgtgattattatagtttgttgaaaaggatccaataagttctatttattcataggcacatttaggactcctgcagtgaaagaaactggtcttactctacgatatttcttactttgtggcactttctacatataggtttttatgcctgggttgctgtagagcccattattgcctctatatgacattttctgatgaataatcaagatatatatgtaacactgtttttatgcttgaaatgatatcattatctgacccaatatgtgaactttgcaggtatgcaatgaccggtcagctgacacagaaaagtgatgtgtatagcttcggagttgttctcttggaacttctgacaggaagaaaaccagtagatcatacaatgcctagagggcagcagagcttggttacatgggtaatgttcaccatatagtttactcatttatcttgtcgttaagttcagatcacatctgaatatctgatttagcagcttatagtgtctacagttaacaccttgattagtacaatgtagcaatacgcagcccaatcctttagtggctactttttacctagttctctgagcatgtctcagttctgttttgcaggctacaccaagattaactgaagataaggtgaagcagtgtatagatccacggttgaatggtgaatacccaccaaaaggagttgccaaggtctcgatctctatacatgcacacaatatttatacacatgagtcatgatagtcatcctttccttctcttttcccccacatttctcactactgcactttctcgatgcagcttgcagcggttgcagcattgtgcgtacaatacgaagctgagtttcgcccaaacatgagcattgtggtgaaggctttatctccactgctcacaagtaagccgactccacccgcgcctccaccagctctggacggttgatgtacagaatcatcagagaagaaataacaactaagaccatataagcttctaagggtcagggactattgtttttcctgcttggtcattttgcatggcataccacagaatggagctacttgcttattgcttctcggaattcaggctaactgcatggagaatgtgttttgccttttgaaggaacacgatccgagcacaataacatacttaatttttgcagacggtgtctaacaatcgggattgcattgcatatactgtcattctgggccaaccataggatttgcaagtatttaggtgcctgtttacagaagattagacgatggcttgtgttctagtagtcgtttattcagtgaactagagatgatgtactgctgaatactgatgatgttctttgattcaaatagtatcgctgttacttgtgttgctttaccgttcgttcaagtcttgggagataaatcaaattagtcaccacatgttgctactgctaagttgagggatactttcagagaaaactcattagcgcatgtttaattattaattattataaaattaaaaatagatttatttgattttttaaacaattctacatagaaactgtgtaaaaatatatcatttaacaatttgaaaaacttgctaacggaaaatgaggaactcaaagcttagagttgagaaaaaaaactggccctagctgctagcccatggaatatggttaagaaacgtgcacgattctgtacgattgtgtgcatcttgtaagcagtcacgttaaaaagaatattttgtatatatgagacttgacttaaaagacacattccaagttaaatgcagagcttaaggtttgttaagccaaaaacgaccttaacaaagtacttactgagttactgtagagctgattaaacattagcacgaagcagaccaccccagatgcacatatattcttgctacaagatcattaatacctaacttatgaaaaaaaaaactctattctatgccactagtatataccaagttctagctcaacgatttatcgacttcattaatcatttctataacatatctaaagtttacacatacaatttagatttaaattcaaatcacccggcaaaaagatttaaattcaaatctaaatatttttaagttaaatgttttaatattaaaaatttgtacgtataaacttttctggtccgcgctcgaacgcttgccctttacacccaggcaggatgctcgaaaaacacatttaatccatccataaaggacgagcctttctcagcaaatcagtcggctcttgtcatgcaacaactgtacagtaagtacagcacggaacagcatctgtttaaattactatgcaagacttgcaagggaacatattgctgctgctatctacaaaaccaacacaaacgaatggaatggatgaatgctgcttcgattcaagctttgtaagtgtgatctcatcacacgcaacaacgctgaaggtatccttcatccccccgctactctatatcagtaaactcacacgattcggttgcgccactgaattagatatgcagagg

SEQ ID NO: 60713 - DNA, 11646 bp, Oryza sativa
tgatgagtacttcttcaatattgtatctgcagtcagcattaatgtgttttaaatgaactgcagtacaattaccaaaactggcatattaaaacaaaaactcataaaagcagaattagcttatccatgtaggtgagatcttaagacataatcacagctttgcatactaactttaccaaaaaaaactggtcaactgcatccagaacatgtacaaaaacagacttcaaggatattaaaaagtaccattttaagagtcaaagggaaaacgtacctgcatatttgaagaaaaatgacgataatatgccctgagcggcattgttgcaaataagaaacattgtggcctttgaatgcccttccagaatattaaagctactaggacctggacgaaattacataataagtgatctttatagcaccgagtaatgcatgacacaaaagaaaagtgcatagctatagtggcatcgtagaagtcaaatggttgatacatatgtacaagaggacatttcagagaaaacacagttaaggtacaagatttcgttgcgcatattgtcatcctaaaagcatagttgattgaataattgtgacaaaatggaaagcaagaagaaagagattccattaattaaactattgaagcactttattatgatctattaaattgtagccataccgaggtgtaaagaactaaagatatatatcacaaaatgactgaattaaccaaataagtaccctatcaaaatccaagcaggcatagggctagtaattaaaagtaaagttattgacagcagatcacaacacataatttggaaactataatatgcaaaaaaaatgcatttcttatcatgagatataaattctcaacaattaccttggatgatggcagtgatcacaagccctaggaaattaaatattgcaccatatccatacagaaataagtctgtaaacatgatatgacagtcatgacctcttgaaaaacaatagctttaggagatacaggctgatagtttagtacattatcattgagtagcacatggtgactgcaggataagtatgcatatggtcatacctgaagatatatactggtatcaaactggcttttcagaagccttttcattgtaaactgaagccaatgcaggaactgttacctgattgcagaaaatgttagcatggaacattagattgtgttggctatttctgttatataggaaaaaaattgagcaatcaaatgaaattaagcttgtttccaatgtgaagtattcaaaagcaataatgtaatcccatgtgctgagaactactgtagctattttactctgtcagtttaccacaagttcttaatcctaccatgctacatatttttaactatatgtgaatcaataaaatgcaaaacactggttcaaagcacaacatataagagttcaagcattgtatcaataacccaaatgtctgctcgtctataactatatgcagataaagagcaggccagatatagcatcattgtatcgtaatctacggactaccagaaagccttgcttgagctgggcatgaaaatgaactctgaaaactaaaagttaacctaccttcccaaattacacagaagatacattagtctagtctaaacctacatgttaaatagagtagcacaccatgcactaatcagatataagaggatgaaaagaggtacaagaaaaacgaatgaacaaatgaaccaatagacagaacttacgaaaaataatgtgtataggtaggcaccagcagcaacaggaagaccaagtgtactagaaccttcaggcagtgatttgagctgattaaccgatataccaatcaacaaaagagcaagggcttcccactgtcaacacgccatagtatgatgtcaattacataaagtttgtggtgttgcaaaaatatttattaagagttagatattaatagatagatgtaaagaaaaacaggaagccaatcggcttaaataaaaaaccacatttggaccacctctacttttaaatcctgaaaaaaaagctcaaaactgattaacatgacaaatgataattaaaaaccaaacctacctgaattgtggagaaacgcctcctcattatcacctttaggagcacagcaatcaccagaacctacagaacaaatgtgtgatgaccaatacaatcaaaacgtaattcacatgttgccaaactccaaagaaatgatgaaaatcaactagaaaaatcacaaggttgggagttgggactattaggagcttaatagcttttctgaaaacaacatggacaagtgtgtgcgtgtgcacgtacatacatgtgtgggaggtgggtgaatgcaccaacgttgatgctatgtagctactacgacagtaagataatctttgaaaaaaaaaaagagggtataacataccttgagattacccaacattttcactgttgcaggattaaaatatagctgcacaagacaggatcaatggttagaagagctgcatcagattgaaggtaggcaaaagaaagatctcacagattggttcaaagaaagtcaagttcccacacggtctgtaattaagaggtctttatgatcctatacctgcattacaaacttcatgtaattgttgatagcatagaaaagagcaggaactgcaagaagaacattgttgcgagcagcctgccaagtgaagaagaataattatgatggcagaaaaaaatcactaacttcttgcaacaaatgggagcatatggccagtaagaagtaacacatgattaaaagatagctttctatgtaagttttaatgctttctgccaaatgacaagttgccccataatgtattcgcgtgcggtttatactgttaggcaatgaggattgactacctctcttcaaaataaatagtgagtacttcaactgtggggtttgcaagagaaatcaatatttgagatttagaccaggcaaggaatcacctgatccaatcagtaagcatggcatacttgatggttatattacctgcatgaatgttgaaactgtgagaaatggcttctctcccacctttaggcgcctggcctgcaaagggcagaaaccgatttgactaggatatccaagaattaatagaaacagaattctttagtaatcaaggttgcaatgaagttctaagacatgaaaaacaatcaatattccacttgcttagcagtacatgaagaaaatgcatcttgcagtcaccaataaacaagtataggaaacaaccgtataaacaaatacgcttaatggaacaatagaaggttttacatacctggatgcatagcatgatgatggcaaatataatttttgtaatctctgtcaagaagtttacactaactgggctaaatttgaacttcccatccactttacacatgtacaccaatataggctgcagaaaaagaggtagagatgcgtcaggcaacataagagttcataaagtggcaacagagtaatgacttagcaaacatttctatggatgtgctcagatggctaaataactcagcaacaagttgtgtttcaacagaatgttccaaagtttaagatctctagagatatctaataagcaatgaaaatgatggaatgataatgacagtagtaactagacattcattcttttcctagcagctagtatgtgtatctagacattaacattagctcaggaaagaatacaagtcatcaaaaccccaaataactactgcttgttcacgtacacagatcaatgaaaccgatcatggtgtgatgtgataatacataacactagacatttacatgacgctcattttaccagacatcagcacagtttaataacattaacacattcatagaaaaagtagtcacagactcatggctaattagtaagtttttgtttagcatgaactgtagctaaacaaatgcaacagaggcacaaactttggtaccattacagtttcactgagcagcaagctactaatcctaaatctaaatcctctcaattcattatctcacgcaatccaccaaaaccaattcagtccgcgcgcaacacctggcggcgattcgggaccaggcacgctgatcagaccaccaaaacccagtgcaggaagggggggggggtgaagcattatccacctgtaggccggcgaggacgcagtcgccggagacgaggaggacgttgagcgcgcgctgcctcgacgacacggagctccggtggatgtcgtacgccttcgacaccgccgccgccgccatcggcacctgcaccttcgcgtggcacactctgcattccacctccccgctcatctcccccaccgccgcctcccccaaaaccctacgattccgatctctcccgctacaaatcacccaaaaacatcagcaaaattcaccaaaaaaatcgagaaaaaaaacaaaacaaaataaaataaaatcagaacccgccctggccgggacgaactagggtggggggaaagggaggcgaggcgagagaacctatcctctggaggccaccatgggagggagctcgttgctgggccgaggtgggaggaggcgatcgcgattcgaagattctagaaggcgcgagtcggcgaggtggggggagacacggggagcggaggcccggagagggagaggagtgggaaaaaaaattatgtaaatataaaataaataattattcggaggaatatcccacgagaacgaaaggggaagggacttttatgtgaggttcgtgtgtttctaaaatggacccttgaattttactgattttcaaaatggtcctcgtagcatttttttttctccttttttttgggtgaggtttttgctgatttgggatggaatcaaaacccaggatatgtgtgatatccaagtgtcagtagagactttcggtttagagggaatgtttaatggctagtgctaatagatgagtattagctgttgtaaggtcttgttttgtcgagtgctggtggatgatggatgaaattcagtttatgtcaattgttggatgttataaatgaatgaattagatgttagagagttaagagtttgttttgtaaagttttgaagaaatggttatgaagaaagttgtcaaagagataataaacttttaggccttgtttgaataatgggttagggaaatgttttttcacccaccaaaaagcatctttaaatcctaaccatttattcttactcttccatttaatcctaacatttcattcatttccctatctcaatctcaccccttatttcccattgtccaaatatacccgtaggagcttaggaagtagccatgataataaaaaaaaatatcttaagctgaaaaggatgaaatttaaaaagcactaagtggtgaagaggattttgatgctacaccatattcgccatgattacaccattaggcatatcatctttctataaggtggataattagtatatcctcatggaatgttggaaatatataatttacgtttttctaatgtgggcaccaagcaattaccaaacagacaatattgtacgaatgtgttatactatagtgcattaccatatatgcattacagcataaaattcattagctgggtcgaaatacaaatctgtaaattgattttttttaaaaaaaatattaatgcgatcctttttcggaaggagagtttgttcgacccatccagcataaaaaaatcaaataagcaggaatgcaaaggtctaaactgacaattgccacggccctttctgcttgttcaccggtcaccaccatggacgagacttgctgagagaatcgccgatagagacgacaaagtggagacctcccagacatggagacctaacattccgaaactgccacctatcctcctcaatcaattcacagaaaacggggggtactaccggtatttcgccactgcacaggtgcagtcataccgaacaggtaggcaggattaaactcaacccgtttcatgcagttgtgagtttttatatctaacgtttgatcatctgtcttatttaaaaaatttatgaaaagtttaaaaataataaattactcataaaatattatttatgttttatcatttaataaatataaaaatattaaatataaaaaaataaataaaatagatagttaaatgttagacagaaattcacaactgaataggataggggagtatagagtatacacgacgcttggggatgcgtaatccagagtcaaggctccacatggaagcttcggaaatcatcgggacccatgcgcgcgccacgtgtccctgctaccagcactggcgactcctcaccgacaaaaaaacgagagcctcttccccctctgtacagttgtgaatacagtggttttctgtaaaactgcacaggaaatgctattgaatcttacaactacagcaaaaaggagatcttacattggaactttgttgttcttttttataaaaataaaacttagtagtagattaatgttggttggttgcttggtctgtttgggcagatattttaattcctaaatttaatcttaagagttgagtacgaagccaacttagcctgagttcggtagaacaggttgggaactaatctcctccgcacggaaaacggagcggtctattaacgcgtgactaattaagtatttgttattttttcaaaaatggattaatttgatttttttaagcaactttcgtatagaatttttttgtaaaaaaacacaccgtttagcagtttgaaaaacgtgcgcgcggaaaacgagggagacgggttgagaaaaggtggacccaaacacagccatagagcaaccagaatctaccgtcacctttttagttcaatttgtgataacacttcagcatattacagttctttttttttagctgaaactgtttggagaggtggaagttggaattctgcaaaacaagcccttaggtcctgtttggctcatgggatagggaaatcattttccacccactaaaagacatctttaaatcttaaccattcattctccatcttccatttaatcctaaccctcatttcccaatctcaatcccaccccacatttcccattatagtttgtggcttacccaatttttgctagagttttgagggtagttctgaaattaccaaaattttaataagattgtgttcgtactgatatgtgtttggtttgttgtcttgccaaatttttataatgttaaaaatgacaataaagtgaacacaccgtgaatctgacaataaactggatataagctctgaattgctaatagtaggatctgaattggataatttgtggatccaacaagttcatgcaacagtgttatcccagcagcataatccaatcaaatcttttaccagtctcaaactgaaagcattgagaatggggatacaggcatacaagttcagtagcatcacatggtagtactacacaatatcagcagctacagtttattgttagactgcatggataaatcatttttcggagcatactatctgcaaactttgcagtatagcagaatcttctacttcaaagcaaatgaaaattaaacagaatatcagaacaaagccatactgaaactgatccacccatggatcagccaaacccccgccccacccggtacagtacagcaattggtgctcctaaagatcatgacaagagcaaaaactagcaggtctcgcagttgcaaaccctgcaccatgcagagacctccatgaggaatgacaagcttctgatgccttcagaaaagctcggaccacggatcaccttgagttttcttgctgttccgtggggtgaccagtctcccctttgaagttttgcgaaataactgatcgatcgtgttgcctcgataacacgaggcataagcacctcatcagtgtatttgctcacctgacctcaaaaccatataagtgaaattcttcaacttcaaccaccttcatttcctcccgtcagtaggatagacattatgagatgaaccagcagacagccaaccaccagtccaccactaactgcagagtttcacagtgcatgccactgcctgagcccaatacttcagtctagccttcacttcctttgggtcatcacctataagaattcagaacctattgatcagcaaagaacagtatggctttcatagagtagatactattatagtttgccacacacatctcaatatcaaacatctcgattaaacggacagtacatctaatagctacagagaacatgcttaggtactgtttattttagaaataaaattttacattcttgataggaagaatagaatttcttcaaatttgtttttgagagaagaaacatgtgttggaaaggagagaagcataatttcctgtggggctactcttgctttgcttgcttgtgaagactgttttgcagaagacagttcgcacttactaagaaaagagacatcatgaacaaagcaaatctgtcttttatcttgagtgctctacctgagaatgtaagcattttttccttcatttcctatgctaaaacttccattatccctttcctgtatgtgtatcaattcagagaaccgtaactttctaaaaaaaattttagagaaccattgaatttacaacaaccaaaaggttggcacaatttgcagtcttgagtgtctaacatcctcatttctttatgaaacaaagcaaaagcaagcgaatctgattctctccgcctaaacaacttgtgctgtatgtggtacaagatgcaagcgtcatcaagacaacagaaatcctaactccactctcccccaccagagagagagagagagagagagagagagagagagagagagagagagagagaatgattgaatcaatatcctaagaataagggttgaatacaggatacaacaattggtattaactgtgcacgagaaagttggcaaattttcagcggatttccttaaagagctacaacaagctggtatccaaaacatatatccagctggaattgctgttataagtttgttataattattacaactgtgcatcagttgaatagagcaaaccatcaattcatatgcacagggcaatcaaaatcgaaattaggcatccagtaatctccaacaaaatccagggtgttcaatatagcctgtaaactgggcatcgattgtctgcaagcatgttgcttgaagcctactccattccgttatgaatatctcatatcttttattcattgcgagcatcagatttcaggatgtttattcattgttagtgccatcctatagcaaagccacttgttaaaaaaaacagtggtgtaatctacacaggattcaacgagcaatctaatggagaaacccacctgatataatattgcaaacatactctcatcctacctgggtagaacataggataatcaattctttcacgatcaactaagtctatactacttcgctacacatatctcaatatcaaacatctcacacttcaaatggaccaaaaaatccaagagatgcacttgatagtgcattggcaacgggtgtgtggtttcaacccaagttcccgtgttcaattctcgacacgctgacaatttgttcttaaaaaatgtttggagggacgtctctcccttcaaatctcgtttttcttttttggacccaaaaatccaaaccctgcatctgacatcccaaaaattcacctctaaacctctcaaatcatacagctccaacaaaacaacagaaaaaatcgatcacacaccttcacaaccaagaagtaatcaagtatatattcacacaatcccaaacctagaacattatcagaatcaaaatctgcacggggggaggggaaagctttaccggggccagagattctccagttggggagcggcggcgtggcgggcgactccggctcctgcccgggcgccctctgctcgtcgaggaacctccgcgtcatggagtagcagagctccagcgccgggagcgtcccgcacagctcggggatctcgtggtaggcgaacccgaacccgaggtcgaggcagcccttgagctcctccaggtcctcctccgtcaggctcctcgtcctccccaccgcccctccccctccgccgccgctcccggacgccgccgccgcctcgagcatcacgaagctgctccgccgccgctgctgctgccgcccgccggacttggcggcagccgtggcggggagctgcggctgcgaggagaagtaggcggcggtggtggtggagatggccgccattttttgctccgatgctctgcctgatcagggggggctatttataaagaggtaaaaaaaatatttcctggttaaaaaaattgctttaattaggtgacattttttttttggattagttttaggtgagtgctaatttagcaaggatttcttttttggagtgtgtttgttgtgttttatttaagctggctctattttagtcatgcatccctaattgcagttatctgtctctacagtaaagagcagaagttgttttatttttctcatgttggtataaataattgtatcattttactttaactgcttagttataaaggaaaaaaaaacttcggtataagcatattacctggtacctggatgctcccaccgtgcacaaatataacggatttttggattgttcaacacaatttaagcttaagttgaaattgctttgatgtcactaattaagattttacttgattgtaaaattatgatgtctagcgaagtagcgatgcaactaccagtgagcaataatagtggaatttataatcctaattttcgtagataatttttaaatcataaaatgcccaatatttgtatttgtgaagtagagatcacttgatagtgtagtggtgaggatgtgtggttttaacctgagatcttatgtttgatactcaacatgctcataatttcttcttttaaaaatttagaaaattttctccctctatattattgtttttaatttgtgatctgtatatatatatatatatatatatatatatatatatatatatatatatatatatatatatatatatatatatatatatatatatatatatatcacagttgatatgtgcattttgggatattaagaaaagataataatcctagtactaaatctatatgcattcagtgcacgtagatatatgtatacacaccacttgcccatgcgtacgtgccagaaattatgtcggagcactcgaccggaggaaggtgacgtggactgaaaattacgcgcaccttgactgcgcttgtcgtgggggacgggcccacctggcagggagccgggcatcattaactactagtggccgcatgctgagaggcataattactccgtctgttctctggtgacgtggcactgttttccccctgccattaattacatctagtagtccactgtgatgacactatcgacgcatgcatgcactttctcatcgatcttacgtggtactcttagctacagtagataatatacttacacatgtaaaaatcacatattttacatgtacattatacagcattgaacttgtaaatgtttttgttcagatcacttggaattggtatatatactagtacttaatatatagagaaaattccctatctagcataaaaaaatgttgctcttccctctatagcacccaaacttaaaaagttacctatctagccacttataaaatttcccttccctatatagcacttccgttagtttttacacttgacggtgttaactagcaagagaaaagacggttctgcccttattta

SEQ ID NO: 60714 - DNA, 1082 bp, Oryza sativa
aataaataagggcaaaaccatcttttcttctgctagttaacatcgtcaagtgtaaaaacaaacggaagtgctacatagggaaggaaaattttagaagtgtctagatagggaactttttaagtttgggtgctatagagggaagagcaacttttttttatgctagatagggaattttctctaatatgtacttactctctgctttacaatatactagtagatgttttgggttttaagtattaatattttttaccctaaaaaaataaatattaatattttggcaaatttatttttgacaaactgatatacagtagaaaataattaactaattgatactcttgctggttaaccctactttcgagtttcgattccaatatttaatttctcaaaaagaaaatctaatatttaatcacacttaaagctataagcttaattactccgtaatatacgaggactcgatcgatcgcgtgtggctgactctgctacgtgtacttaggtggggcccacgggagaggaaaagtgggcccgcccgcgctacgtggatggataagctcgccggggaagtttgtggcggaggagcggcgaacgccggcgacccctcgcacacggcgggtgtcggcgtcggcggcgacgacgacgacacagcaatgcatgcatccacgtggcgcgtgtgggccccactcgaacggcagaatcttcctctgacgtgccgccctgcgtgggttcgaccaatccgtagccaactctcttagatccacgtcaacctcgctgctattggacaatttagttgatcagctgccaagcaggataaatacatgaatcaatcgcatggataaactcataaacataaatctgttttttttaattagttcacaacaaagactcattgcgtcacatcactgcacacgtaacaccacattcatactcccgtgaataccctaacacacactctaagtgatgaaaatcaacggtacaactttgaccttactaaaattaaaaatacgttgaaaaccaacctgtatgtacgtaatatttgtgaatatcaggatttaaattctcttgggtagagtcacgtgcctacgaca

SEQ ID NO: 60715 - DNA, 2414 bp, Oryza sativa
  unsure (1)..(2414): unsure at all n locations
gtggcttcttgagaaggttttcgcctatcttaaccaacagttgaagatgatccttcgtcgagaggtcattggatattgcccctattgggatgttgtgatcctgtaatggtgaacaaggtataaatgttttttatacaatattttttagaacatgtcaacaaataaataactaacttggatggcacccatgacaatagattgtaaagcatgggtcgcgtacctgaatgcgcaatagttggtgtgaacatccgattgcttgaaagaggtctgcaacgagagtatcggccatatctgagctggcatgaaagaacatgttgagcaacggcattgtatccttatcaactagccatcgaaaaatgccccatttggcaacatttcttgcatcaaacatgatatcgtgctcaggcagacccgtgcccaaagatatcaccagatacttgcggtaatccaagggctcggctttcgggaactcctcgctcttccgcttgatctgctttgttatctcacccatagtcaccaaagtctgccaaattagagacatcaagataagttagcatcttaaatattaccatgtccagtttggcaacaaaggttgatgtgaagtctatacaaaacacataatgaaaaaaggcatattgcgttactgggtaaacattattgttgaaagacaaaagtatagagtttttacacaggaatttaaacccaacaaaagttgacaatttcagaaaaatgatgaagaaaaaacatactggattgtttgctgccatgccaccatcaataatgttgaagctttgcgatgcacccgtgtgatccacggtttcaaaatagtgtgcagggagaaaggttggtgctgcagatgtaccaatacatacatcagcaagacaagcattcttcaagggcttacgtctcgcctgcattgtagcatatacattagttcacaccactccaaaaaattgtcatgtgaaatccacacgctaactcagtttagagaagggaccttgaatgtgctgaatattattggcttcacacacttcacatcaaaagtgggaatcacaacatttgtcaatgtttctttcatcctcgtctcgccaagaagatcattgattagtctgtgaaggtattttccatcatactttggcccaatggccatctttatgatgcccaggatgttgaagaaccaaccaaaaaatccagtcctggttgcaaaatccagttgacaaaataccatttatattttcatagctagttaaaaaatcaattaacaagagaacagttcaactcagaaattggttgaccataaacacttagatatggtcatagcttctctactgacctcagacagaaacatacaactacataattgcaaagattgttattagtattaactgaagcctgtaatacatactttacctgtgcggaaagatgtggggggaatgcttgaggtaaaatgggacaatatccttggcatagcatggttgattggcattgcccagtgatggagctgctagcatgcctgcaataagaccacctgtgcttgtgccagcaatggcatcaaagtagtttgcaatccgagcatccttcccatcaagctcctagaagagcaaagcaattcaacaagtaagttactgccagacatgcgcagagaaagaatgttacccaaagagaagaatgactcttaatcatgtagtcgaaaggccagatgaaaatttcaaggtgagaagatgttacttagaaaggctatgaattccattaacataatttacccaagcctactgatcactaagctatacacaattatacatgggaagaaattaagaaatataggattgacctgaagtttagattccaggaatgagaggatgacagcaggaatgatacccttcaccccacctccatcaatactcagaattgtgatcatgtttcccttgcttggtggtgggcatgcacaattcttctccatggcagaggcaaacaagtcagctgttgatcacttgcaaatttctctctctggtggtctttctcaacaaaggagagctatttataggtgatgagggaaaagataactcaggatgaaaaaaaagtaaaatgttaactttgaaccacaagcaatgtttgcacgtattttacactcaagcattcagcatctgccaaactgctggcaagcttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60716 - DNA, 766 bp, Oryza sativa
cgccgcgcacgccgtcgcccaccgcaccgtggccagcacgccgccggccatggcgcgcggcggcgcgacacgtcgacgcggaggcttgaccggaggacgaggtgggcccacactgtcagtgagcagcgcgggggtcagcagccttggttagactcgcagttgagactgatcgatttgctctctctctacgtaaaggccggaaaattctcgagttcacgcggttattctagaatggggtcactggtatgtgggccatgcacagtacaggtagtggcgttttcccggtgggcccacctgtcagtgatagtggagttaaggagggtgggaggggttcggcggtagtggttggcacgttgggttcgcgtggttctagaacgaggcctttttacccggtttttatattctttttttctgtgagcgaaacctagtttttaattaattaattataattgcgatgggccgactcatgaagaacctgcgggccgcgcgcgcatggccttgctgggcccgttgaagtggtttgctggggaaaaagtacttggattacctcaactatcgcccaagtatgattcatatcctccaaacacagaaccgggtatatcgactcctccaactatcaaaactagtgcaaacaatatccctcggtagttttggaggtggttttggttgacgtggcgtctacatggtggttttgaccgagtctttgtcctacgtggcacttacgtggcattagaataaaaacaaaaaaaagttatgtgggacccat

SEQ ID NO: 60717 - DNA, 2243 bp, Oryza sativa
tttttttaaaaaaaatatatatctctttttttttatagtatattcaggccatgcatgcgtgtggctgtatcctcatcacattctagttgtcacacactatctcaagctcttgaataaatgaatagtgctactacttggatctgctcatctgacagaggattgaatgcatgtctccaagagggcaatagatgcaaagatgttgatgtagtatctttttaattaaactatgccagataattcaacaggggagaaattcttgcagtacctgaaagttgaaactcttatctctgtctctgaactgagccattgacaatttcatggatcaatcaaccctgcatgcttgtgagtacaaaactttatcccttcaatcatgtaaaccagattcagaagtcacctctgtcccaaacaagtcaaagtgcactgcactgcaaaggattctgtgctaactggactttgacagggttgcaatgctttcagagttcatagcaacggaaatgcaatatgagggacagcttttcttcgctgcagaaactagtttctttattcagcaagtaggagtacatggtacatgattgttcagacaattacatgtaatgtgtgaacactagagttacaacaacattgcagcaaaatttgatgctacagactaatataattactcactaccaaaggtttcataaataatagtggcatgctgtactctactttgacctcagagcaagcctatgtaaagctagatactcctagtacaacaaatgctaaggtccaagtgatgtttttcacattggcaacacccttcagctctgaactgttctacttacagttacagtaatacagtcaacactgtatatgcagccaacctcctgcaagaagcagatgatcctaacatcctgaacttatctacaagaattaaggagagttgcaaaattaacttcacacagtatcatctctggtggacgaatcatgaattagcatgcccttttccgagtttctataaccctttgcatggcatagtggcacctataaagcaatagcatcaattattttagtccagaaaaatacaccactgaaaaatactagcaccataaccaaataattatgcataagatccttgtaacgaaacaagcattgatctataattttctactgacaattatgattatattgattgaccgaaacagagtaatctgaaaccagtgtaatttcaatccagctgatatacaatggtttactctgaaggtattcttagtatgaatggcacagaaatacaacccttaaagctaacgagtttcaacataatatggtttgagcagagttctcaagatatacctccatggaagatgatcaaggaacatacgaggtgtaacaacaaggtccataaaatcttgtcgattggctataaatgctttgtaactcttgttcttgcgactcttgtgtcgagtcacaggtgtcttctgaaatggagaggtatgattctttactggaacaagatgaataacgagaccaggcagatacacctccggtgattgtccttcaggcaaacttattgtacgcagatcattaggatcaatcgagagttttgtgccatcatttgaatgaggtagcctgtattccctgctacattcattcagatcatcttcagaagacttcccatttccgcatgcattactaggttctccaaaatgaggaacatccagaacactgcaggaagcagccatgcagttccctctatcaccaagaatattcattctagatctgctccccaactcatagttgattgctgctgtggagctcactcgatattttggagtatttaccaagcaagatatcgctttaccaaggaggaatacaccacctctaattgtgtgcattagattatttccgtggatttgatcatttcttagctttgcctcattgactatctgaagagcaccagtagactgacgatgatctgcaacatttcgattgtatcccttcgtcctcacgatcccagcaactagttttccaactttggcggaattcggcaaagcatcctttgagagagctctcacagcagcagcacgtaatctaattattgaattcatggataaccgggcagaaaattcatcattgtggacaatactgtgattgatgggcacttagttagaaaatcacatgactggtatatatgaacaaataaataaatgaacaataggttcataggtatgacaagttcagtatcacctggtaacaaactgtgaaca

SEQ ID NO: 60718 - DNA, 2771 bp, Oryza sativa
atcccccattttataactcgtggtgctaataaaaaattgataatccagcataatcaaataacttgaaatgaattcccctgtgcgttgatagtaataagccaacttactctgataccaagaagtgcagctacagaacctcctaaagaatgcccaacgatttcaatattgtatccatggcactcacatccagcgccgagcaaagaagataagaatccagctggcactgcatctggtttatctgcagacggtctcaagatgacagttaatcccaggtgctaacttgaaatttttcaagaataagttgctatagtattagcgaaacaagtcactcgttcagtccaaaaaactgaagggttcttgtttgtacatagagaagaatctattctatacttaccaacttgtcatgcttaagatattactgacgggtattttggtatttttatatctataaaatatgattgttaggaatgtgtgactgtcatctgatcaaaatatccatgtatttaagttccacatcaaatataaaatataaagttacattatttccatgctaaccttgatggatgggcagcccttcaagcttagcgtacagttctcgagctgattcaaccattccagcatgtccatggtgtggaaaggatgagatgacagcatccttaacttgtaggggtaactgatcagaactgcaatgcaacagatcattttatcaagaaaaaaaatgagtcctaattcacatttaattcagattgaccataaggaccataacgaagaagagtatttcccaaatttaatcatggcggaccatgagactattggcagtggggagttccagatagttcgtttcatgcacaagcagctggctaaggataagccttatttattcataaaataaccagcagcttactctagataagttttagtgtaagtaagggaaatgtagaaaaagtaaagttacttgatcagcccatccaagtcatccaccgtaagagagcattccctacacaagccatcagttataacatcttcaggagtctcagttccgcggatggcaatgactaacgttttcaaatcgtgcaggacaacaacaaaataggcagcctcacgtcttgcctacatacagaatacaaaaccttaggttcgtcacacgccataacaaaattgtaaatagaaggtgaggtagactgctgattaacctggctaacacggccttttataagaacttccgggggtacactgacatattttaggaaagcagctgcatgccctcgccaccaattatcgccttcaagaactggtcgcctgtcaaactaaagttccataagcgtgactatataccatgcagcaaagacacaacagacaaagacagacatcacataaaaactaaacataatctggagcaccaattggctctgatgcaaaatttagaaagagctgaaattcggaattaaaaaataaggaatattagaagaggagactagagtccatatagaaatccaattaggaaataacttaaattcggaattaaaaacaaggaatattagaagtagagtatagagtccatatagaaatacaattaggaaataatagaaattcggaattaaaaataaggaatattagaagtagagtatagtccatatagaaatacaattaagaaaaaaatagaaattcagaattaaaaaataatgaatattagaagtagagtatagagtctatataggaatttaaaactaactataatttggaataaacataataaaattaaaagtagagtttagaatccgtataaaaatacaatttacaaataactaaaattcgagattaagaaaaaacatgggaagaaaagtttaaagtcaatataggaatacaatttagaaatagctgaaattcgaaattaaaaaaaaaaggaatattagaagaggagactagagtccatatagaaatacacttaggaaataactgaaattcggaattaaaaataaggaatattagaagtagagtatagagtccatatagaaatacaattaggaaataactgaaattcggaattaaaaataaggaatattagaagtagagtatagagtccatatagaaatacaattaggaaataatataaatttggaacataaattagtagttttgaaaggggatttaattattcgttctttttccctttcattttaattttgaccccaagggaagctgcaatgtcatgttttaagtgactgtgcttgtagaagagaccaaatttatcaaattaaattatgcaaataatttgaagggttctgttgcaatatttatatgagctgtctctgtgccatgctaccaaataacactagtcaagttctaaaatatgtcttcttattttcgtataaagattgaacggacatcaaagtaagcaagcacaaattatccaagtgctaaagataaaagcaacactgacaaaacatgtgcagcataatctcttttttttttgtgcaactagaagagcatagccccccccccccccaaaaaaaaaaaaaaatccattagcagaaatgagcattacaaagttttcacaacataatctaattatgttttgcaaaagcatgtaacaaagcaccacatatttacctagcacgggtccatggtgtcataacaccctgccgattgagccaaacacatggaaacataaaaggattccttccaaaatcaagaagtggtccctgcaaggagaacatgtaaaaaatgtactggcaagactgaaaatgacagaccaagtaaatgagtcaggg

SEQ ID NO: 60719 - DNA, 1521 bp, Oryza sativa
ttgcaagttttatccatgatgtccatctttcagttcgttgtttgttaattctcgaggacttctgtacacattttttgtggttatagtggggcttggtgtgtgcccttgcaaaagatgataaacattttctttcacttattttactaactactgtgcatgtaaatacaaatgtgttatctgagttgtctataaattttaagaaatatcattttaagctctgaccagggtagatcggggtggtggatgctacagttttatttgctgaagttagcccaattccagggcgtccaattgcaagaaatatgctatgtcagcccaccttgtcaggaactgttaatatttcctagccactctcctcaacaacagaaactgaaaatctgtaaacggtaacaatgtggaaggtttgttgagatgtaaattcatcaggcacctaattttccgtttaatggggtgttcactgtactgcaattaaaccgaagttattctggaaaacatccactgtgtaacatccctggtaagttgccttctgtactcagttgtgaaaccttactgctcagtgcctctgtggtgttgcagagccaggccctgatacataacctttcttgtttgcatatgcgcaaacaaccttgaaggtttggtatcagtctacttcatcattcatcgttgttttgttttctaaccagatgtatttcattgtacttatgcatagctgcagaatcatacaatccagctgggaaagtcacctggaatcaaataccaggtgaaaagaagtttaaccgtccccaattttatcttgtcaggtgagcaggggtgaatggtctatctctttctctctctgtgctgcctcacttttatcttgtcaattatcatacaaggtttcaactgctcaaacttcttactaaccacaacatagcagctaacaaacctcagtgcaagaggtgacctttggtcaaaagctttgcaggctgccattgtcccctatctgtactgctccacaagacaattgagcaggtctaaccaacaaattttgtttgctagtatgctatttaatttgtttcattcttttcatgtggcacatgaatgaaatccagctgaaccattacatgatggctattggaggcaggaagctcatttgatgaagaaaagctggaactaattggcagttggtggctgccaagcttaaccactacatgatgaagaaacagtatagttccagcccaacttcatgatatgcataatcttgggcctatcttgcaccttaaaggattcagcccatatacacactaatattgagacatcaagaacagtccagactgcatatacaggaggaagaatggttctgaaacaatattgagctttgcttaatcttcctgcttaatttgatcagaggaagacaattagttctcatcacatgaagcatggtcattgcatcaactctagctaccattgccccaatttacaagcaggatacctccatttctacccttctatatatatatggctggttaataataatcagga

SEQ ID NO: 60720 - DNA, 3585 bp, Oryza sativa
gatgctgccgaggccgtgctgctgctgcatcgcctgcgagaagaagtcatgcgcggcggcggcggcgccgaggttgaggtggtggagatcctgcaggctgtgcgccgccgcgatcacggcgtggtcctgctcctgcttgcaccacccacgcagcggctgcgcgtacgggtggtaaagcccggcggcgtgcggcggcggcgccgccgccgcctggaacgcgatggtcggccaggcggcggcggccgagtggtggtggtggccgtaatgcgcggcgtaggcgccgtcgccgccgaggtgcgaggcgatgcggccgacgtcgtaggcggcggcggcctcggcgtccttgaggcgcttggcggcggtgccgacggggagggcagcgctgtcgaggatgctcttgacgtcgtagcggctcatgtcgaagttggtgacggcgttgagcccccggaacttgatcgccgcgatgtcgtacgcctccgccgcctcctcctgcgtgcctgcatgcgtgacaccaccatcatcacacacaccattagcgcatgcaagcaagattatcattttggctagctagctagcttaattggtgattagtttgtgttgcaaagaatgtgattaacactagttaaattatttactgcaaataatgcattattgtttcttaattagtgaggatcttgaccaggtgcagtggtgaatggagacaggagtagcaccagacatggaaggtttgaaaaggtagctagccacatgaggagagcatgcaagcatgcacagagtatatatattagtggtgtaatgcaacttgacatgacttgcagatcacatttttagtttaattaattagttacaggcttaagtaagctctgtgttctttgaagagtcacccctctttcttactactactattttgccctgaatgaataaattgtacttgccaagaaaatatgatattttgtatactcaatgagaaaggacatacttattaatatggatttatatggttttgcagtataaatatgaatatttgtacttactgaaggtgcccaagtagaggtccttgttccctgcaactcttcctatccttgcttgccatctcccatgctggtgatgcctatatttacaagtacacaagatcaaattaatggatctatatcacagtcttcattttttaccctaaaaaaattaaaaaaattaattgtacaatgatgcatatatatatgtacctagttactccacggtaaatggatgcacctctggagaaaccactgctcttcctgcacatataaggaacagtatttgttagtatcagtaagcatcagataattaattaacttcaatgcgatagataaattactataaatctaaaaggaaattaattagtatagtatggatatcttgattgtagagaccaaccttctcaaagaggctacgaactcctgccttgtcatgtgcttcatctcctccagctccttttcatagttatttacctgaaaaatacagaaaccattgcctttaagtacagttttagtaatcatcattacactagatcagtatcaaataaaagagtgagaaaataacaatgtgacacaatctgtatattaattataaacacaccggaaaatttgtcgtcgtcgtcgggccccagtatttgagagcagccaaatcataagctctagcagctttttcctctttgtcataaccacctatcagcattacaatttataagatcattaaacttcaagaaagcaaagatcagcaaataattcaatctaccgaatatatacatgcatcgcaaacagaacatctaggttcaaggaatctcactcacctagatagactgtagattcaaaagccaagttcgatcaaacagaggaagatcattcgatcccgaaatgatcattagaaaaagaaacaagatcagtatcaatcgccattggagcataaaaaaacaattaatcgatttaaatggcactagttagcctaccttgacgacccttgcgagtttggccctctcttctgcagctgttgtcccaaagatgagcctcatacctccctgtccatctatgcctataaccaaaccaaaagatattacaactttgttaatcacaacaatcatgtcccacataataatgacataatgataaatcctacaaatctaatgatcaatctatcacctatatagctatcctagaaaatgggatccaaatcacaaacatcaaataggaatgaattcatgcaacacagttaaatcatcaaagaatatatatgattacactgatgatgatttgtgctaagctagctagtagatgaacttttttgagcaaaatatagatagatgattaattaattgcaccctaaataccttgtcacgccgcggtagatcgatgttctctggccgaacgtgtcgacggacttcctcgccgccgccgctgacgccgtcgtgggcgacgacgggcgaggaggtggccaccatgacggagtcggcgaactggagcgaggatgagcttggaggagggtacaggtagccgacgctgctgccggagctcgcgtagcaagcggcggcgctgctcgggatcacgccgcccttgccgccgtgatgatgctgctgctccgagaaggagatgccgccgaggaagtcctccagcttcggctcggcgacgagcgccgagagctccgatcccctcatgctccaatctgcacatcaaatcaatcaatcaaacatgcatgtctcttcaaatcccaaccaacactagctatatctagctcatgaatgcatgcatcgattggtgagcttaattaccttgggggatgttgaagcagacgtcgccggtggaggagtcgccggcggtggtggtggtggcggcggcggagatgagagtggagttggtctgagacggcgggagctgatcctgcggggagagggagaaggccagccagttgttcatggtggccatggttgatgattcacactgaacaagacaagattcaatgcgaattaagctatggttatatgtatgatttgctacttggttaagctctgttagatcaagtcgccattgttgtggtgagctcaaggttaggggaagcttaagctaagctaactgagaagaagaagaagaggtcaagagaggtttggagcactaagcaacagtatcactggtagatatttatataagatagatatgcatgatgctaattgctaagttagtagtactactactaatggaagtactcccttatgtaggagaaggcagcaaggaggtctagcttttgtgcacttttgtttttttttaaaaaaaatatgaatttgtaacctgtgtgtgcatgcaatacaaaaacattgggcatggtttaactgaacagaaaccactttctgcttctgctttctggggggtgagtccaccatattttgtctcattttcctgtgaatatttaagcctgtctatatgcatgaaacctacatgatctcaatactactagtagtatactactacaatacagtgtatgcagtagctttgtatataaagcaatggccttgggctcgataatagtataaaatatcatcttcttttttcactgcccttt

SEQ ID NO: 60721 - DNA, 4602 bp, Oryza sativa
accaatcactaagtgctgatgaaaaaaaaactaaaacgatattatacttatttaatttgttgtgcatactacagctagatgcactgatcggttcaattatgcttttggttggagtgtgtgtgtgtgtgtgtatatatatatatcaacttgacaagaatatataaacccagtggcagtcttgaaattagcttagcttgaccatatacgtgttatggcaaatataatagagtatgcatttttatttcgcttctgagatatacgtacgtgtacaactactggactccgtctgaaccaatttgtccatggtcttgggtcttgactgataaaagaaaaaactatatacatatataaatacacaattgaattactttttgaaaggatatatttaagttagaaatcttgtactccctccgtttcaggttataagacgttttgactttggtcaaagttacactgctttaagtttgatcaagtttgtcgaaaaaagtaataacatttttaacccaaaacaaatttattatgaaaatatatttaattattgatttgataaaactaatttagtattataaatattattatatctgtttataaacttagtcaaatttgaaatagtttgactttgaccaaaattaaaatgtcttataacttaaaacggagggagtaacagatactaggtatattcgtttgtctgtagggtttaaaaatatctgctccatcattgtataaatatagatacatacaagtatagctaggcacacactgtatacatttgacaaacaaacaagctaatactagattgatcacctctgcatgcatttgacagtgaactatggattaagcaatgtatagagcagtagagagttgtagataacacatgcaaaaatgatagagaaatcgagagggcatgcaggggttaatattttgtcaggcttctcacgtgcacacggcgatcatgcatatgcatcatcgaccggccaatataatcttctcttggaacgataaaaaagagcatgtgcaatggcaagcttagtccattgtcatgtgctcgcatgcttttcttctactcaatacccacaatggtaaagtaaggtgctatctataaaacatgtacatctcagcaatagactcgattaatagtaaaccaacttaatagtatgtctacattggtatctatagctctctcatgcattgcctcgtttttctctatagactatctctaagttagtagatagctttgctctctctcttcatttaatacattccaagtagaaaatatgctgacatagatctcttgtagagagcctatagataactattgtgggtgcccttagcatgggcacgtacccacacgtgtgcgtgcatacgcccaagagtcttcgattgatgcacttgcattaattcatgagcaataatctctctgctgttcttttccatttgccgtttagcacattgacatgattctaaacatgttttttttaacgaacaacaccatacggtacatatataaggtgagaagtttttattgatatagtatgaaaataattttacaaaactcaagccttgggaggctataagggcagtcccaacccttcacctagatggtgtctatggaattaactacattgtcatgtaggacttttaacttatgtggcactatattaattaagagagagagtgaagagaggaaaaaaattaagtctcatgcaagacacagcttcaacacgagaacctatgtactagacactatcaagttttgcattgggaaagactagtgtattcataatagatgaagaataaatatgattggtagagaagaaatatgatgcgtttattaatggcccactttaagaaatcatgtgttgcggagtgtagtttatattgtgatgtcttattgacatggcaccatagacactgcttatggatactatgggttgagactgccctaatcaggaaaatgaaagaagacaaaggaaaaactcaacgctgacaacatcaccgcacaaaacactgaggaaggaaactaacactgagccggccgctgtgtgagactgatagccggctcgccgctatgccaacgacagagctacaccgctcaacgatgataaagccaaaccacggaaagggcgctagggcttccatatgacatccctactttggattgcaaagggagaggcgagagaaaagaaagagatcatctttggtcaatcatctgcgttttccctttatgaatatgatttctcaaaaaaaatatacttaattagttagatcacacattatatatttggtaagtttattgttaaaaatatttaatttatcctaatatgtaaataatttatagtaatacctgatatactcgctgacaaatactgtatattttgcatgtctatacatcctatagatctataaagttcatccccactaattatagttaatgctaattatctcttctctcgtaaagccgcatcatctcaattgtttttagcttttgaatgattcatcaagggtgtaaattgcatctccccctcccccaaaaggcacactatataatacaatcatttataacctatggataattaataaaggtaaaaaaatatataaacacatgaaaaaaaattatatagtaggtaagaaagaaaattttagaactcatatctactatattatcatacaattctcctgtagcatttgtacataacatgtatgtatattttgcatgtttatacattctataaatttataacccactaaatctaaaacttaatatgcaaccatggccctgttggttccatgggctaattattagcactcaccttttagccatgaattagccctcaaggatccaaacaggtgggctaatttgaggctaaagtgaattagccctcctcaaaacattagcccctccatggggtgctaatggtgctaattttatgtagggaccatcaaaaagcagctctctctccccctctctctctctctctccctctttctactctctctctaccttttagtcttgaattagcctatggatccaaacataccaccctagactaatgtttagcctaccaattcatgactaaacattagctatcaaaattagccctaggctaatcttccaaacagggcccatatcacatcatcacccgctagcaataattgtatatcaaagctcatgtaaacatgcaacataatctacaatgtattgagttccagtacaaattaacatgcaagcatatcctatcatcactactcacctcatttttaccatattttaacatatttgtccatcatttttataatacttaaaatatacctatcaatatattccgcacgggcatttgtttgtttcatgattattactgataaactctgatgttttattgtttttttaatcttttgctttatgcaatgcaaattttggtccaatatttcatttacaatctcctacataatttactaaatttatttttcttcaaatatgacttggtaaaccagtttaatttattgttagtaaataatgtccttgatacttctagcttgattgttaaaggaaacatattgacgattgtttattgattcctgtagcaaagcataaaaaaacacttgtatataggagtacactatataagtagtactccagtacaaccaaaacaaattagcttgattgacgatgtgtggcagcaatatttgttgtcggcaaactgacaagccaccaagagatgcctccaactccgagctaggacaaggatcgaagacgtggcttcctccgaggatgcatgcatgctgttactgtttaatcatatatccagttttcaaaataaatatagttttaattagtctaatacatatactcttttttcgttttctaaatagataacactgataatttttaaaatgatatttaaccattcgcattattaaaaaaataatataaatatgttaatgtataagtcatacttaaagtatttttatatcacaagaaataaaatgatatatggatcatatggcaagagagaaaagtactatagacatctaaacacaaatctaaaatatcacatagaactaaatggtgaggtggaggaaagaagaatgaaaagagataaaacgacacctctcatatatataaaggacaactcgtacacaaacttttatttattagatatgagagtgtacgtaaggcttattgggcgagagtgaaatagctgtatattcacacaatttcctttcatcgaacggtgagcttaaaaatgaaaaaaaaataatgacaagttggcctaggtagtttgagatgcaaaccaaaggtagtctaaagaaatactcctactaattacatataaaaatatatatagcggtgcatgcgtacatcgcgcagatcgttcaaaccctagcagcagtgcagtaagagcagaatgcatgcagtcagtcagcctaggagaaatcaacggagcacccacccgtgcctcctcgtaaacactgtaaagataaccctatagctagcgtaaatagtagttaattaaagccataggtactagctagtaccacatatactaattaattaccgtgctttgcacttaatacagttgattaaacatggattgcatgcgt

SEQ ID NO: 60722 - DNA, 3707 bp, Oryza sativa
ttttttttatgagggactaaagtttaattagtccctttcactccctttcactcaaacactcgctgagctgtttgaaggctactcctatacgcgcgtaaacggctcagtgatcaatcttctccttttcgcccataaaaaataaacctaatacgaaatataatattatcttaattaattagtacttctaatatgaaatataatattatctaattagtactataaatttagacagtgccacataccgtattagattatttctaatgaaaccaagggagtagctcgttcagagcagatacaataacagtttagccagctgtaaatatattttaataaaataaaagatgagagagaagagcagcgggctatagatctgtagctagctacaacgcgaactacaagatgcaatgtgtatatgacatgtgagatcatatattaataatatagtaagcaattattgtatgaattggttattaaattagtaccgttaaacttgctctcagtcgtctctgtcagtgataaccgcagctatcacctatcctacctagctaggactgcacattttttgtatatcatcagatctgcatactctctcgacatttttcatcgtcatcttaattcttcctcaactgttttcttttacaactttcttctggcagatcgaccatgcaggtggtctcatcctattcctattttctgtacatgatcagttctcatgcatgcaccaatgcatagaattagtctagctagctatagcagttaatttatgcgaattcagctttgaattactgctgcaagtcgctcaaactagctgtagtttctctacgtcgtttgcgttgtttcagttcgcttcaatgaccatgatcagatcagtgatgctgctgcatgcatatgatcagagatcagttaattagcatcaattacctctcacgtgaccttggcctcttgctagcgtaggccgatctaggggaaaaaagaaatcctagcccaatgcatacatataacatatgtgaaaagaaacttttgaaaaagaaaaaaactcatttttaatatattaaaatgcacatttgattattcattgatatttttcaacttcttttatatttaggatattataaaaattataagttggatcacccatacaaaaattacgtcactgcttgctagctaaattaactccaaatccaaaatgagatatgaatgatcgagactatagctatatatatgcatagtttttccatcgttgcttgaggaacgcacacaaacgacaaagctaacgaggatgcggttcttgttcagtttcagtttggtggtcaacgccaccagtaagctggtcctacagtttctgtttttattccttcatttttattttattatttttgataggtaggtgggctcatccaaatcctaggccttgtatagagcaaggagcatatgctataagttagctataagcacatgcaggccactactacaataacaatttttttcgtttagtcaatacgaagggtctgcgaatgcgaaaatcgcacttaagccgcccgcacgggaaaataaaaaatcgaaacaaaaaaaaaagaaaatcgaaaccaaaaccctaaccctaatccagttgccgccgccgcccgcccccgtcgccgacggtctcccagacgccggatctgccacccgctcccatcaccgacggtctcccagacatcggatccgctgcccgctcctgtcaccgacgccggatccgccgcccccatgccttcccaccgccgacgacgggaggggagccgaagggagagggaggggaggggccgcgtgccgccggatccgccgcccccatgcctccccaccgccgacgacgccaccatcctctccagccgtcgtccccatggttgccggccgaagacccccctcccctccgccagatctgcaaggggagggaggggccgcgcgccgccgctgtcgctgtcgctattgccgccggatctgcaaggggaggggtggcgagccggtggcctcccactcgcaccatgcgctcaaagaggaggggaggagaggaggaaaggaaaaggtagagagagatgagaggaggagtgaataataaaaggaaaaagtagagagagtaggtgaaattttgaagtgtgtggaagggaatacatttttgcgtgcggttaattaagacatccgcctgcaaaaatagtctcatttttgcgtgccgttcacttaatatgtccatttgtgaaaatcaattttttcgtgcagtcctcttaaatggaccgcactagaaaatgagctgattttttcgtgcggatcgagttaccgcccgcccgcaatctaaaagtgtccctgtccaggaaaatcgtttttgtagtagtgtgtgaagaaagcaggagaagaaagagagaaaaaaagcggactacaaatttgaaagcagctgtgacacaggctttaagatattgtgcatgtatgaaatgtatgccaagtagtattaatggtgcaatatattttatataaaatattgtatgaatagactattaaagtggatatagatgatgtattaatttttagaggtagtagtggactatactattaagagcatgtacaataacagactataagctagctataaacatattttaaggagataacagattagagataagagcagcgggctacagatttgtagctagctgcagcatggactccaagacacatgtgtgtatgacaggtgggaccagacattaattacgtagtacatgtttatatgtaattattgtatgaattggctattaaattgactataaatgatctggagccaatagttattgctaaacttgctcctaggaaagctttatgcggcttctttcaaaagctctgactcttccaaacagtctaggttctcattggttgcccatatttcttaataggccaaaacagcttgtgagggaataaaaaataatttataggtaaaatttttatatatgtgttcttcgcgatttaaaaggtaattctaacgctaaaaatatcttaaaatcaatttcaaaattaagtttgaaaatttaaattttaactttagatttggtttattagggtaacgaatggggctggtagattctaacttctataaagctatagaatttagaaaataaaaggttaataaatcagtttctctactaattaggtgatgattctcgaaatgttaaggtcccctaaacaggacgcgtccttcctgcatatactagttgtactcctacaaactgtgtgtgtatatgtcacgtactcacgtgcctccgcgagtacagtacagcccagcaaaacacgatcggttagcatcttcctccaaatgggccgcacgtttcggcccatcaatacgggcctcataccaacaaacggaaaaagtatactttgactccctcaactatcacccgagtatgattgatgccctccaaccacaaaacgttgtatatcgactcctccaactaacaaaattggtgtaaacaatgtccctcggtggtttttgagatggttttgggtgacgtggcgcctacgtggcggtcttgactgagtctttgtcctacgtagcattagagtaaaaacaaaaataaaaaaaatatgtgggacccatatggcattcacaaaaaatgtattgtgagacccacatgtcatcctccatctccttcccttcttcctccctctctctctcccttatctctctgttg

SEQ ID NO: 60723 - DNA, 1498 bp, Oryza sativa
aaactttgctgccaaacgggctcagaagagcaaattggtgtttgttgtgcgatgatgctgaattgttcaatcaatgcggcaatctttaacattgcttcaagctgctgtgtgctgcgatgttaggccaagctgcctctgtaggttgcagccttgcagcatctggttagctcagtctttgaaggccgagtttagttctaaactttttcttcaaacttccaacttttccatcacatcaaaactttcctacacacacaaactttcaacttttccgtcacatcgttccaattttaaccaaatttctaattttggcgtgaactaaacacacccgaaatgtagtgtgacaacttgacaagtcaccatgagagtaggataccctgaattaattgacttgaatttgtttttcctaaatatcatgttaccaaaatctgaaatcgtttttaacttcaccgatattcagcaaaatggcatctattcttataggtgagagttttattagtgttattttttttactgttgctttgcagtgctgatcctgcatttttagatgcttactggtattaatgtctgaaccttgaggttactccctgttctgtttgttggcagctgcggtacaagagatggctttggtggacaaggtttggggtggtcattactgtgctgcagtttgttttagcactttgtttgttgtgtattatagtgaaggatttctctgctgggagatcttcaaaacagtgcttgtcaggtacttgcattgtgctatatacagattcagactgttttttttttcaaaaaaaaaatgggctgttaagatgttgttaggatcaaaatacatttattctcttaaacccttggaattctatgcaaagcagcatttttctgcactaaatttacttatttaaaatcaaatatatgtgggatttcgccaccctacatggattttagtatgtaacatactttatcctgtcttcatgcttaaattatctatagtatcatatggtaacacgaactgatatatagtacagcataacaaggaaggccttcatctccattcgtttgttagatgtatggattcctttgttgcaattagatcactgattcatgttacttggcttttatcaggacatgaccaagacaacagtaactggaagcacactctgttaataagttttatcgtcatcatgtgggtggcaactatagttcaatgttctactggttctgatgtattaaggtggaggtcattctatgcttcccatgatattgcgtggagggcacactatagagaggtgtttgatcatggtatccgagaagttttatgctgtctagggcgggttaagtattcgtatgtttctctctggaactatttggtatatcctacctctattgctatttgaaaagtttgagcaactttgttattcacattgctaggagtgtattagaagaagatgatatatgtgttgtggcaaaattattgggtgatcttatggcttatcgcgcatct

SEQ ID NO: 60724 - DNA, 1806 bp, Oryza sativa
ccaaaaaccaaacccatcaaatctgaatatcttggaaagcgattagtttatacaacatgtagcacaaaagtacagtagtgtactgtgagctgttgaggatcttgctgacatccttttgcgtgcgttgggtgcttgattctgtccaaaggaacaaaatcttagcatgcccaacgatggagctaaacaattcggctcgatctcctgcctcttttatatataaaatatatatatggacttcagtaataattgacagagttggattaaggtacgtactaattaggcttttcttttctgcgaggagtactaataagcttttcttttatgatatcgtgacaatcaagtatagattcagcaattgtcacattttcgaatactagctggaataaacgtttcaaccattacatctaaaatagtacgactatacatgtgtactatagtactatggtcgaccgcaaaagcaaatagtaattgttgattcgataagattttatcatgatgaatcgatgtatatcatattcgtacaactgatcaaagggttgactaacgagtctaaaaaaatacgactatacatgtgtagtatggtactatagtcgaccgtaaagataaataataatcgttggtttgataagattttctcatgacgaattaatcaacttagaccatcctcgtacaaccgatcaagaagtcactaccgagtgactagaccgtactagagaatagaggtgccataaagcaaactatttttataattaattggatgacatgtataatagatcattcacgcggatctttccttttttaaaaaacacaaaaccaccaaatgcagatcgacatactaacaattatatactccatctccacttctgaaaccagaatttgggggagttgccatggactgacaaggcaaagcatgaactgttcattcctatgtatgttaggttgtttgaccacacatgaccccactcagtacaagtgtcatagtagtagcatataccaataataaggccaaggggaccccctcaatgtttatggccatattgtgagatatgtgcaacctaggagtagtcctccatgcccttgtgccccaaaggctatgtgtactactgcgtcgctcgtctcgtcatcttctctgaactttctgaacttgttcagaaaagttcagaaaggaagaaaaatgatggggtgcacgtcctcgccgatccttcagagcaagcagcagatagataggctatctagacagacgatgatgcatgcatccatgtgtacgtgcagcacaaatatatatatatatattttcttttgttcattagtgttccaattaatatctctgaacaaaatcaatacgagcagtgctacacacatacttaaaaaattcttgcataacccttacgaacaaagatctctaacagtttgatttaatcagtcgatgattatgaaaagttaagataatcacagtatgccacatcaattttcgtaagagtttgtaaacaaaatttgtacatgcatcgttttccagttaatacataaagtgtttatatgtatatcaaagtttacaaaaccaacgaaaaccaacgttttccaagccggcttaagaacataaaccgctcggtttttcaatcaagttaaaaaaaatcatactgaactttcaatttttaaaagtaccagaatttattaggagtcctttttttttgtgaaaccgacaaaactaccaattctgggttttggttcgagaatagtttggtactaaaatttaaatttttaacaaaatttgaccggaaatcgttaggaggcaatgtattttgcgaa

SEQ ID NO: 60725 - DNA, 9974 bp, Oryza sativa
gccaatcaccaccccctcagtaattaattgcgtcgttctgaagctaaaaggccacatcgagctagcagcatcagcagcagcatatgagcacaggagaccgaccgaaaaccgtgaaatttcgaggtttcgacattggccgggagcagatttccgagtgatataaaatttgaaatagtaaatttttagaacatgaatttaaaatagtaaatccgatcgaaatttcacgaaaactgtcataccaccaggggttgagatccagcgctcaatcggaaaggtgaaccctgattatttcacaccgcggaccaaatcgattagattcagaaaacaagaaattataaacgtgttagagaaaccacacactttttactgctgcacaatcaagcgcatctcagatcgatcagattcagagctgaggtgatctgatcaaaaggacgacgtcgcacggcgacggggcccaacctagctacgcttagcgtcgacgtgcatgtcgcaacgccgacgatgacgacgacgacggcgacgacattattacggatctctctacctttttcttgctgcatatgcatatcatcagctctcatcaatctctccctccaatccgtccacacctacaccctgacaacgacccggccggagaggcaaagtcgaacgccgacctgacccacatgcatgcaggaaaccaacacgcacagattaatatcatactcacacagtcacactctctccagtggtgaaaaacgatgcccatttttaccgaccaaaccatctgaaaatgcatggttactgattgaaataaaagtatatagaaaaagtacggaaatgaaaaccgaaatggtttcgatgttctaccgaccgttctctcgatttaccatattttcctaggaattacctttttatagtattgtagtaaccactatttttaaatattgtagtacatgtggcccatttaccacgacaatcactaatatttatattttcgtaggtatatatctgcaaatagctatttattacgatatccgtttctttcttgcttgacatttagaatgctgtcgtaaatcatgatcatgtgtctttatttaaaagacacgtgatcatctatttaagaacagaggcggatagaaagacagtaataaaactaccgctgattggtagctcgatcgattcctgtgccgacctagctgacaggtccacacaaaattctccaaataagtgaattgcgacacataatttatgcacattaaaagttttgaggactatctccaaaattggggaggtcctctttctcttggcttttggagggacaattgaattgaattgaagctaacaatggctgtggacacttgcacatcaccaacctaaccctaataaaagctcaaaagtgagccaaggaagaggccacgtaatcacaatggggttgagactgtgagagggagcagctagcgtcattaagcttggggataatattgttgttgttgattgggagcatgggtcatgtacaaggagatggtggtatggcctttgtttgtgcacgtagctagctaagggaggaaccggcatttcgtcccattttgttgttgttgttcatgtcatgtcttgactttgcttgttccattgattgctgctgattaagctttgctgttgctgctggcttttctcccatcaatgcctacactgcctcggtgtagtcatcatatttttttcccttatgacaagcaagtactttacatccgctcccttaaacagataacgtgaatcatataatacgtgcagttaaattttaaaattttaatatactgatgtatatgtaaaatattaggatttactatttggggactaggttaatagatttatcatgacaaacgattttagaaagttatttttaaaaatatttttccaagtacatagtaagaaaaagtaatgattgaatatgctctttctagtaagatgtgtccaaaatgtaggtttagctagtgatttttattttattatttttgtagatatttttcaatgaaactctctactcgtatgatattcaagcatgcggtctaaataatttgatagatattgatatatgctcaaagtttgaaattttggtttgagatgtgaaaaaatggacatgtattagagcatgtgggctctatggtggaggattttttttttcaggacttggtgggctctatgcctctatacagatctatgggccttggggcctcaagtaaaggcccatgagtgaaaagcgggaagggacgaagggtcatgcacgggaaaggcccaaaatcggaaagagagttccagaaaatctccatttttaaataactgagactggacacttcattttcaaaatttgatcattctttgtttttgcaaaaaaatacaaatactaaaatatgaattattattaaagtgtattaataataaatgtaaatttactatccaaattctacgcactgtagtctaattatttattagttattgatggtcaaagttaaaatagttttgatttccaaatattgttactattattcatatttaaaatttaaaaacttgtattttctacaaaaaaaatataaatattcaaaagattttgtattatcaatgtatcattcatcctaaacataagcactaaaactacattcattgaagtttagtgctccattggaacttagaattcttaaaacacggtaacaggaaaaatgcatgattaaagtgttctaccacctttcataaggattgaaaaaaaaagggggcagaaattctgcaggaacgaccgtttgtatgaagagtggaaaaaacagtacaagaattagaataaacatggtcaaaaggggtgctcttttttttcccccaagaggttgaacctcacgttgaaattcctatgttataagtcaatatgaaggaatatcataagatttttggataactatttctttgatctagagaaagaagatttttctataggattaaatgcctaaaaaaagccattgttccaaagtaactcgtgaatatctttttatgtaaatggaataaatatccctatatttgcaacaccatttgaatgtgaggataacttcttgtccacacagctactactacctccgtcccaaaataagtgcagccatgggaatccgtgtccaacgtttgaccattcgtcttatttgaaaaatttataaaaaaattaaaatatatttagtcacacataaaatactattcatgttttatcatctaataacaataaaaatattaatcgtaaaaaaatttcaaataaaacaaacggtcaaacgtgagacataaacagtataaaactgcacttattttaagacggaggtagtaatagacaaagttgtttaattgcgggcatcagaatttaaacccttattcacatatcgatattattttacaccgtacccgcagttccaccatcgtactaatggtgcctgccttttgtgactaaagcaaatgcaaaggaggtagacaagtagtagctatagcactgcacttcactagtttgttgggaattttgccggatcaaggaggaaacgaaacgggagcatggtaaagataaaaatctcccatacattaatttgctgaaagatattatacatgtgtagtactctctcaagagtgatcaaggttacttacgttagagcatctccaaccacctctccaaatcgaactctccaaatacccatataaccaattctccatctgatttggttagtcaaactagtagttcactctaacagtctcttcatctaccatctctacattgaatgtatgacacaggaacccacatgtcagcttcttcttagttttttatccctttccttcccattttcctattttctagcatatgcttccttccccaatggcagaaaacaaacgtcggcggcaatcggtggagtgatatggcgaatggagtcgacgggagtgacgaccgtcgctggcgggcgggggacatagacgtatccgatcgttttctgtcgggctgcactgcgtgggggcccggcaaccgcgacgagcggaggcgaaggacggcaaccgcacgggggccggcggccacggcgagcggaggcggaggacagcagccgcacgggggctggcggggtgcgccgcacagaggccggcggcgagcggcgctgcgcgggggccggcggtggcggcgagtggaggatggcggtcgcggcgagcgaagggcggcggctgacgtgctcgagttcctccccatgtgtcgtcgtgctctttctgtgcttggttgccgtgtggggatggaggagatgggctccgtggggcccaccattggccaaccaaatagagtggccaaatttggctagtggagggagggttttggccagccggatgacttagccatccggttggagggactgttggagcacgttttttttgctagaatggctaaaatttggcttggaaagtgggatggagaggctgttggagatgctcttacttcacattacgaatgacacaacacacaaaggtgatcgatcgaggagtacatgacgtctaccacaatgacgcgaagaatgtggagagagatggtacatgaccttttttttaaaaaaaacatggtacatgacctccatcttgtttatatataacgccattaaatttttttagaaacgttcaactactcgttttgttcaattttttttaacaaatgtaaaaaaaatttaagtcaaactttaaagaacatttgataataaatccaatcataataaaaaaaattacaaacatttgactacttattttattcaaattgtttttaacaaatgtaaaaagaatttaagtcaaactttaaggaatatttgataataaatccaattataataaaatatttttataataaaatgaatagttatatatatatttaaaaaattaacaacgtcatatattagaaaatgaatggagtatatatatttgtgaggaaaaagaagagggtgtgacagccgtgttaggtagatcgatgcctacaattcttgtacgaaagagggcaaatggcttgtgttttctgcgtgctatgacgaggggacgacacctcgcaggtgtacgttcgatcgtgcagctacctatctcttcccaatactccggctgagtttagttccaaattttttgtttaaacttttaacttttttatcacattaaaatttttctacacatataaacttttaatttttctatcacatcgttctaatttcaactaaacttttaattttagcgtgaaccgaacacaccctccgtctcagtcacaaaatatcttgtcgttgtatgatgcgtacgtgcagtcgtcactagttgaagtgtcgtttgctttggtttaatttgtttgtcattttaccaaatctcatgttaaactagagaatgtatcgaaccatattgctacccttaccaattactccctccgtttcataatgtaagactttttagcattatccatattcatatggatgttacatatatgtttgtctagattaattaacatccatataaatgtagataatgctagaaaatcttacattgtgaaacggagaaagtatatcctaaccatcttctttctgaaaaaaaaaacaaaacaaatactgaaattccttgtcagtactagtttcttttttaagaaaatactaccaggccttaccttgtagtgtgtgattttataaccaaagaaaacataatagttttatacaaatatatacttaaaaaaggaaaaacagaaggagtactacaagcgttgtaaccaatcagcacctatcttaagggatcattcatcctatacatatgcaaaagaacctcattttgaatagcagaccaccaactatcaaagaaaggaccaatattctgaaatatctttccattttgctgtttccaaatgtgctagcaagctgtgaagaaaacttctaagaaacctttctatctgaaccaaagtcttgctaagatcacaatttgaaagaaatcaagaagagaggtattccaaaagataccaagtttctaccagcacttttcactgaaacgactgagggataagaggtgtaaaatagtttctctgtgctgagaagggcagagaaaaaaacatgttaggtcagcatctggtggagcacatttcttcctatcaagcatgtctcttgtgtttagcagatcatcaaagaggagccaaataaaaactttgattttcatcgtacacttggtcttccaacttccataaccactaaggccatgtttgtttcagtttaagattattgtaatctagattattgagccagattgctgtaagcttgattataataagccgacatagaataagttgtaacatatttagagtggattaccatattatagtaatttggcttataatttgtaataatctaccataataagttatctgtttgtttcagtttacttttaataatccatattataataattttaagctgaagcaaataggccctaagtatggccgagaagcttgtaaaactgcaaagttcagtttataaaaacacttggaggtgtaattactttgattctaaatgaaactcgaaaagtccaccttctaatctgacaaaggttaaattaaggagcttagatcctcatgaattcaatgaaggcctcctcaggcctctcgtgagtactagtattcctggtgttatctctatatttacgttagtatttcaattaatttttcatttatccatcgagttgttatttgtaatttgtagttattgaatctgcaaactctataatagttgactaagacttcttgaaagcaaatgctggaatggagtttcattgttaaaaaaaaaattacatttgaaaattgctatagaaccaacatttcggcgaaagctctactaaatcaatgaaatcatattgatataataacttataaacactaaatatcagtccactaacaagaatagatatttatcttaaaaatcaaaactatatgagtcaggttctatcttcactttctctctcccaaacttttggacacgtggcttcaccacaagatgccaagtctacgcatatatcacgcctaatccacaagcttgagcagcgtaagtatatataactattaagagggatgcaacctcgacgttgcatgcaccatcccatggcgttcactccaaccacgctcgagctgccatccaccatgccaccggccgccgccgccgccgccgccacccgccaccgccacgcgaggccggccggccacttgcgctgcgccgccgacgcggtgtccacggcgccggcggagcggacggcggcgagggtgatcgccacgagctcgcgcacggcgtcggcgtcggcggcgtcgggctctgtcgctcgcgtgtggaggaaggtccagggctccggcgactgggacggcatgctctcgccgctgcacccggtgctccgcggcgaggtggcgcggtacggcgagctcgtcggcgcgtgctacgcggcgttggaggaggacccctcgtcgccgaggtacatgaactgcaagtacggcaagctccggatgctggaggacgccggcgtcgccggggcagggtacgaggtgacgcagtacatctactcgtcgccggacgccgccgtgccgggcatggaggcgtcgacagcggccgcgccagctgggtcgggtacgtcgcggtgtccaccgacgagacgacgcggcggctcgggcggcgcgacgtgctcgtctcgttccgcggcacggtcacccccgccgagtggatggccaacctcaggagctccctcgtgccggcgagcctcgccgcgcgcggcggcggcggcggcgacgtgaaggtcgagtcggggttcctcaacgtctacacctccgccgacgagacgcggcgcttcggctgcgccgacagctgccgcgaccagctcctccgcgaggtgtcccgcctgttcgccgcctcccgctccggcggcgaggacgtgagcgtgacgctcgccgggcacagcatgggcggcgcgctcgcgctgctcctggcgtacgacctcgcggagctcggcgtcgccggcggcgccccggtcaccgtcttctcctacggcgggccgagggtggggaacgcggcgttcaaggcgcgctgcgacgagctcggcgtgaaggtcctccgcgtggcgaacgcgcgcgacccggtgacgaagctcccgggcgtcttcctcaacgaggcgacgacgaggtcggggccgctcgccgccatgcgcggcgcgtgctacgtgcacgtcggcgaggagctcgccctcgacttcgtcaacctcggcgacctcgccagcgtccacgacctcggatcctacgtcgcgtcgctcagggaaggggtggtcaccgacgccgaggcggccaccggcggcgttctcgccatggcgatggagctcgtcgggaggcaatggcagtcgaaggacgcagccagggggatgatgcagtcaactggcttgatatgagagaactctccctgttgcaaaaactcttttcctcaatccttttgggcgttcaaaaaaaaagatatctatgttgcagggaaattgttttaacagctcgagtggatgtcgacccgttgattgtatgtcatctaaattattatgaaaaaaattaaaaaaatataaacaagatggatcaatatataatacatcaattcacaaacatgcatgttaaaattcaactcctacaaattgtaacaaaaataacaaacaaaactcaaattactatatgtacatttacaattaaatttgttatttttgttataacttgtagaagttgaatttgaacttgcatgtttgtggagtgatatattaaatattgatctatcttcttaatttttttgaaaatttttcataatcatctagttaacatgtaataaacggatggacgtccactctagctattagaatccatctccctctgttgcatccattttttgcagagatttttcccattggccactgagtgttaattaattcttagaatatgtgtccaacataatagttttattgactattttagtctgtaaattaacaagcagaggttttttggttttttttttgttttgggagaaaagagggatcaatcccttctcttccattgtactctcattcttttgctgttaagaaaacagtctctctcatttgcctcaaattaatttgtattgtgctctctctgcctctctggtctatagataagttgcaactccctccagtcaaatatttgaagtttatgacaaaatccacttatacttttaaaattcatatcaccaatattttttttataaatgcttagtttataaacaaaatgaatgacatcagtaggtttgccttaaaaaagtactactccctctgtccagaaatataaggtattatgtctaaaataatataaattaaggaagagaagtagtacatatgtgtagtttgaaaaagcatctttggcataataaacaaagtagtagtactggtaagtagtacattaagtacattctttgtattttttttagtttttgacatggatagtgtggagtagtagtagtaatattagaagctctgctcgcccaaggaggtagtttgctttactcaactcccctttttgataacaaggcaaaaacctccgacccgacattcatgagttttgaatgaagaatgaagagtgccctgcctctctttttttttccctaaatcttagaattggaagttggtaaagacccaccccttgtttaagttagaatgagtccccgagacattggcttccgccaacagtgaactattaaggatcgcatcccatgcatattccacattatagccagcaactgattcagcttccgcttctgggagatcagacggagctcgattagtttctactagacaaggaataaagaacataaccaatacggggagcgagggaataccggaccatatctgcttttgtgcctgacaatctcacggagggagtacttctcacagaaatcaattgatgggtggctgacaat

SEQ ID NO: 60726 - DNA, 26705 bp, Oryza sativa
  unsure (1)..(26705): unsure at all n locations
gcacaaaatctcagtgcaagtttctgaacatctggaaatttgatttagagaacaccatgcaaatgtgggaaagggtacaagccaacatgtgcaaaaaatgatttagctaatgtaaattatgtcatgcggtgaatgattatctcccatttgctacaccgatctgatgattacaaggctgaatgtttttcctaggtaccatttcttcatatcacgatgcaaatggtagagttaattaagcgaggggtttttaagaataaaacacaacaaggtgtcaattggttcgaggacatatgcgctattcagtgcaaatgtgaggattggttttcttcttttcttgcaaaatagccaccacgcgccattttctccaaagagcaaaaggaattccatatataaaaggagaaaattgcaacctagaaggtattagtgactgggatcccttgctgtcatacgcttcataagctattaattatatactttcgttgtgattaaatgattaaaatcccaacctaaacacctggaagtgctaaaggcaaactatgaatttatcttgataaaagagctcatatctgtatttctctttgttctttcatataaaatgtccattgttcttttttttcaattagtaaatcatttcgtgaaaatgtcgatgtatatttgatcgttgaatattatttgccttctttcaactgagatggagtttgccttgccttgcctgcagccaaaagagcaatgagaacaaggctaatcaactgtccatgtacttaaatattaaaagctatttctttactaccttattgagaattggtttgaatttaataaattttcaggccaaagtgtctgaaagttcagtttgcacaccgtatcagaggacttatttgttgtttgatgggttattagattaggcaccgtatggtgtatactcctacttaatttggtttttgtttggtattgaattatggatgctgtcatcctcatccatggttaacacaagatgagttggcaatctgatgggaaaagtagaaagaattcctaaatgattgcatgatggtgactggtaagtgcatcccaagagaaacaggtcatgttaaaaagaaatagtgttttgcatgttaacttgctgcacacttatgtaaaagagaccacctaagtttgcctgtccaatttcaaagtaggtagactcttggagttgacagcgaatggatcttttttaaactgtataatttcttctactgcaattctggatagtagtcactccattttaaaatgtagttatttctactagttcttttggaggggaacccctcccctccgcacgtaaaacggagcgatatattaatatataattaattacgtattaactaaaaaaacttgaaaaattgattaatataattttttaaagcaactttcctatagaacttttgcaaaacacgcaccgtttaatagtttgaaaagcgtacacgccgaaaacacgaaaaacgagggagatgagttggtaactctgggaaagaactcagccaggaacgagggtgaaaggatcataatgtccttcattaatgcatggaggacttgtggagagtagggtggctggttggggtaaaaaaaacaactagaaatagctacatttgggatatatttgaatcctgaaaataactatattttggaacggaggaagcagttgatgtacattagcatttaaaatctgctcttagaatatctctaatgctgagatatacttgcaggttcactgttcttatgcttatttggttatataatccttgttatttgattattggttatatgataagcttctctatacaagaatacttgcaactgtgggacttagttgatggactgatcttacaacaggatatccctgaccaacacactttaaagttttcgaagtcaggaacttacacaagcaagtccgcttaccacacctatttcattgggtcgataaaatttaccacatggaagagaatatggaggacttggacgcccaagtgtaagttctttttgtggttaacggtgaataaccaatattggacatcggattgccttgagaagtttggaatatcacactcaaaagtttgccctctctatgaacaacagtaggagataatacaacacatccttgtgttttgtgtctttccccgtcaagtatggtacctaattatagaaaagataggcatggagacctcagggcctcaaccttcctcaaggcaattctctagctggtggtctcaaatggtcagaggtgtatctaaggaagataaaaaagactgaactgttatcttagtggtctggcaaatttagaaatacaagaatgacagtgtattcaacaatgccacaccaagtactgttgtcgtattggttgttgtggcaagggagagtttattagggcagtcccaactctctatctaggatggtgtctatggtattaactatattgccatgtagaacttttagtttatgtggcactatattaattaagagagagagtgaagagaggaagaaactaggtctcatgcaagacacagcatcaacacgagaacctatgcactagacactatcaaattttgcattgggagagaataatgtcttcataatagatgaagaataaatatgattggtagagaagagagattatgtatttattaatggctcactttaagaaaccgtgggttgtagagtgtagtttctattgtgatgtcttattgacatggcaccatagtcgacactgcttatgaacactatgggttgagactgcccttatggtgtaccgctagagcaagagctcttaatgaactcttggcccggttgctccccacttatgagcttagctcctcacatcgcttcagcaacttttttttatgtgttttcctttttttagagtgttgtcaagcgctctgctatacatacattatcttctctttaatgaaataaaacgcatggctcttgtattttcgagaaaaaaagttgttacgatggacacaaccataacaagaaaatgagctgtcaaacaatgatggttactttccaagatgctctactacaaaatatcattcccacattatgttataaacacaaccataacaagaaaatgggctgtcaagtaatgagggttagtttccaagacgctctactacaaaatattatgcccacactatgttttcaatgtgttgggtagactaaatagagaaggtttgttgcttcattaatccttgcaacggtggaattaaatttgaaaatatagtgttcattagtttttttctcagaaatatttcgaaggtaactttttttcaaaaatatacatctgatctcgcacaaacgtaacgtaaaattgatgtggacgtgacaacgcgggcgaccacggctcgagactgctcggtctcgtacggcggggctacgagattgagcggtcttgcgttatcagcgagcgagaccgaacaggctggatcgattaattatgattagcgattaattaattaattgttaatcaagataattaatcactaattattattaattaattattaatcaggtaattagtcaatagttaagtggcagcactcgctaattagctgagaccgaagttcgctctcgctttgtacttgtgcgagaccggtcggtctcattattttcggtccgcgagaccactcgacccgtgtcgtcacgctcacgtcatcttcatgtaacggttatgcgagatcgacggtatatttaggtaaaaaatgttacatccataatatttttaagaaaaaacaaatgatcagtatatttttaaatttaattctacaatggtgtatgagtaatcagtatgaattactgcttttgaaagtacaatctcattcacatattacacagcctatatatacagttttttttaatacgcaaaatgcgtatcactgtaatacaaagatcagggaagttgagacaaccaggtaccacaaatatatacatggtttatttatatttgggcatacaaacgcgcgaccaagtggctagtactatctgatagcattaatacagtttctgttttaaagaaatataatgcagcttgattgcacataatctatacatgtccacgacgaaatgtttgtactttcagaatcatcagtgaattgtgtagctgtcagaagaaacagagggaaaacgatgtgtaactgaagaaagaagtgctagcgccgtttctgcaccgaacaaaatcctagctggagtatctagcaaagttgctgacaacatcttcttcttcttcttcttcttcttcttcttcttttttctctgaacaatgctgaaagcatcttcagttgaggttggctataccaatacttcactgccaaatagtagtagcaatggttaatgcagaattccagggtgttaaattaggttcaggcttctgcctcatcgaactcctgctttacgagctacagcgacgcctgcatttcttccagcgtgtagctggggaaagattccacatcagagagatgacgaatgccatcatccgatagatccatcgatagatcgatccatggctgcattggttgcgtcgcattgcattccatctcgtagtaatcagtgagtgctcgtcgcactcacacaatcagctcgcgttcgatcgatcgaagctagcagctacctttcgccgagctcagaacggcacgtagcaattcagatacttctcttcgggtttaattagattcggcgtagccaagggggagaattttggtaggttttgactgccaaatataatacacattcagctccagcgactgtccggagttcagaaatgttcagagatgtagaaatgttcagagatcgtacttatcaagtctcgatcgagatgtgaccgtgtgtctactgacaatgtatagtaatacacatcgctaattaagcctgataacgtgaggacagcatcaggcagccagatgaaaaggcatgtggttgggttaccaaattaccatgaagaaggctgatggcgaactgcgtcgagtcagacgaaggagacgggcacaaaatcaagcagttttcagggctctgacgagttcaattctcaaggtatatttcagactggaaagcaacaccttttcttttttgatagatagattttcttttttgacctcataaaaaagtttatagataagagtagattctgctgtgtgcttccatgatgcagaacccggaggtgtaatcctcttccaccatcagacaaagagagaaaaaggaaaaacaaaaaagataagatggatgtgtatgtgcatgggctatctgggctggattgtgcagaagggctttggtggcccataggttgtgtggcctgtgggcttaataatttgacacactgtcaatgcaaccaatcacacagatcctgtacgcaaagtatcccctctggttttaagagtatgacacggttaacttttatacatcctccctccgtttctaaatatttgacgccattgatttttttttaaatatgtttgaccgttcgtcttattcaaaaaatttaagtaattattaattctttttctagcatttgattcattgttaaatatacctatatgtatacatacagttttacatatttcacaaaagtttttaataagacgaacggacaaacatgtgctaaaaagtcaacggtgtcaaatatttagaaacggagtgagtacgttttactatttatgttattaaaaatacgtaattattttttcatatgtttcatattataaatcgttttggctttttttttcttagtcaaactttatagaaaaatatagatatatttctaacacaaacaaacatatttaatgttacatttaataaaataattttggtgttgtagatattgctactttatctataaacttgatcaaatctaaataagtctgacgaaaaaaattaaaagagacttatgatatgaaacggtatttattataatttgttttattattaaaagtattttaagcatgacttatttttttatatacactattaatttcaataaacaagtagttatacgtatgtccaaacaatccacaacgtcgtacgttagaaaccggagtactacctagctggatagattttttttttcttcttctgattagacttttgaattgctgaccaattaatttttcgaagaaaaatagagagctcgcgacgaccaaatcgctggcgatgggttgagctccgtggcgagtgcaccaccacaagccagcatcgctagaaaacgacgatctctatcttttcagcgcccagcaacaagctactgctaattaagcacttgctaccctcgtggcttaagtactgctcagtcagtattaatattttaatatatgacgccgttgattttttaatcaaacgtttaaccgtttattttatttaattttttttataaatataaaaatatttatgtcagatctaaagaacatttgataataaattaagtcaaaataaaataaatgataattacataaatttcttttaataagacgagcggtcaaatgttgataaaaagtcaacagtatcacattaaaatacggaggaagtaattaacttaatacttgtattaataatctaatctaatacagttgagattagtagttgcagctgccacttgctagctaattacctctctctatctcccatgagaggaggatgcagatgcagatcatgctagctaattgcagcctgatcaggagagagagcctgcaacttggcgcccaaaaaatctcgtcatctcgttggattcagcgagagttgtacttgcccagtgtactttttgcagcagatctggcgatcaggcagctagcttagctagctaatagctaaagcttgatgttactttagggttcgtgtgtgatgggctttggtttcagcagcatccacatgcatgcatgcccaattgggaataattaattatatatatcaattgttgatgagtaatcaaacgcacacagcttaatataatataatctgttgctagtactgcaagcatcaccggatatcgaaaagcttttcgttagggttaggcattggttcggctgggtttaggggcaagaagaagaaggagaaattttaagtttttgtttacaccgtttgaccactcgtcttattaaaaaaatagaattattatttatttttttagacttactttattatccaaagtacattaagcacaactttttattttttatatttgcataaattttttgaataatacgagtggtcaaacaatgcaagcaaaaacttaaaatctcttatattatggaacggagggagtataaaattatcgaaagtcaaggccggttaacgcaaaaaccggttccaggttcaggcattcttgacatgcatgtactgtactatcaacacgcaacagctaatctgcatgccagtcacttaatccgtccgccaaactatcttgagaagacaagtaagagtagtaattaattaaggtttgacagtacgatctattgaaaataaatctctgtttttggcagtaggacgacgacccccctcggttctctgaagaaatcaagaaaaatattcagaagcagcacatgaagtcatcagtgatgtgagctgatgcaggcatagctgcagctaattaagctagcaatgcctattcgagagttgagaatcacacgtactccaaagtaggcccggtttattttccacgcaaaaatttttcatcatatcagatcgaatgtttggacacatgtatggagtattaaatatagataaaaaaaactaattacacagattgcgtgtaaattacgagatgaatcttttaagcctagctaattgcgtcatcatttgacaatgtggtgctacagtaaacatttgctaataacggattagttaggtttaataaattcatctcgcaatttacaggcagaatctgtataatttgttttgttattagattacgtttaatacttcaaaaaagtgtgtccatatacccgatgtgacacgctaaaacttttcaccctcgaaaattaaacagggccttaatctgacagtgatccatcagccacagcgagagaatcttagccatcgcatcgcacccgggggcgaaataggctgtctggctaggtgtccagatatccggccggtttatcgatgatcgatcgatgcagtttgctccccaatcagcttgcaattatgcatatgatcatgaatgcttacgtccggccaatgccaaccatagccaacagtgtactgctgtttgtgcagatcgatgccgtagctagccgccatggccgtcgtcgtgttgcagccatagctagccaagcagctggcagcagcgatccggtactagattgggcggggcgtgtttagtctagtctagtaattatgtagtgtgtgtgtgcctgtaaaatagtagccgctcacatggggaggacggagaagacgacggcaacctctcgtgcgtgcgcacgacgacggccatggcgtgcgtgtgtccttgggttgggtggcattgcagattggcagccaccacgaaccaaccaaccaaccaacccaacgcaaccatctgaattctgcaggctttttcgctttaatttggatcagaagattcagaactccagatgctgaattcagaggagacatactactgtattatttcctccgttccaaggttgctaaatgcgtagatagagtagatgtttacctaaagatttgcgtgacagcctcgttcagatgggatgagggtgaagaataaggtccggtcttatcggttgcgcatattctctaataaatcaaaacagcttattatgaaatataaattaatttataggtaaaacttttatatatgtattttttttacttaaaaaaccaatactaaaaagagattacgttgaaaatatcttaaaaccttcttcaaaattaagtttgaaattttaaattatggttttgattttgaattattaggccaaccaatgaggctctaaatatgggcacctaaaaaaaatcatttgctagtctatgcgatatcaaaagaaaaagagggaaacactacgggatggcatcgaaaatgagcttggattgacaatcttaacctaaacggcaacaaccacttcacggtgaatttaatcaaccaacttgtctccctgtggaacgcaacacagggcatcatccttgataaaaacgaacatgaccaaatcaccaggaagctgtcaaaccatggagaatactcgatcgcttcggcttataaagcgcaatgtatggaaccacgggcaccaacttcaacaccttaatatagaaatcttgggctccccaaaatgcaaattctacgcatggcttgtgatccagaatagagtttggacctcggatcggctggtggctagaggatggccaaacaacggggcatgccctctataccgcacaacaaacgagtcagcaagccacctccttgtccactgtagatacactagaaggatctggagtatgacggccacctgggtggcatatcacaactggatccaagccaatgggatctgtgtcagagcgtccaagactggtgggaaatgctatccaatatcaagggtgtccccaagaaaggcctgcgaacccttaccctactaattgtctgggaaatttggaagaaaagaaaccaacatgtctttgaacaaaaggagaccacagcccctagccttatggctaaaataaaagatgaggcaagaacctgaaccatggcaggtgcaaagatgctcagagaatttcttcctaaccggccgcctgtagatcttgaaaatgttgaacagtctttttttccttcacccctaggggttgtattttattccttctatattcaatgaaatagcacaatcttgtgctgattcttttcaaaaaaaatatttgagttttagttatttcaaattcgaaaaataggtttatttgatattttaaagcaatttctatatagaaagttttcgtacgaaatacactgtttagcaatttgaaaaacgtgctaacggaaaccaagctaaacatgtatcttaatcagatttgcatctcattcctgcagaatgcatatgtctaaccgaagaaacgaacattggatttagggtgtgtttagttcacgtcaaaattgaaagtttggttgaaattgaaacgatatgacggaaaagttgaaagtttgtgtgtaggaaaattttgatatgatggaaaagttagaagtttgaagaaaaaattttagaactaaactcgaccttagatgtatctaaattctgatgctttctccatccaaaaggagagtttacatagaaacaaaactatggttgactttagttttttttttttttgccatcaattagctgcaaaatatccttcctacaccctagtagtagtagccagatggtcggccgatcgatccatccacacgaggagtcaaaagaaggccggagattgccacgaaacggacgcgtgcgtgcgtacgttcgccaagaaagaaattcagttgatcacttcgttacaacttgaaactacaagacggattccgcacgcgcacaaattatatgtgtgggtcgcgtggacaattaactaccttttcaggtcggcgcgggaaaaaaagcccagcccaacttgcattttcacgtgacgtggattttttttattctcttccaacaaaattaattcgtgtgattcagagagtgccaacacaacgactgcgaaattagaatatgcatctattgttgcgtatatgtgtgtggagctttcagcctttcactgaataataataataataattggataggatttcattgccgtctgcaaaagggggggaaaaacaagataggattcggtgggcgcagctatctactccgtatatcgtgctaataattctgaaaagctacaaacaataacgtttaataatttcaagacatcgggatacgttaaaatagctctgtttagtcactttgcacctatttaaggggtttctagctgctgcaatttctttcagaatcaaagctccccctaaagctccccctaaacagttcattttttttaagattctatgatgatgtagttgtataatctagaaaatgaactaaaagtcatagactggaaaacccagctttttcattttttataacttggctactaaccagtagcttcttagaatattaaacttccaaaacaggtccaaagctatgttcttttggaggtgcagggaacctctcctcttcacgcggaaacgcatgaaaaatgcatcactatatattttttaaacaactttcttataaaaacttttgcaaataacacattatgtatgaaagcgtgcgcgttaaaaaagaaggaatatgagttttgagaacttagaagaacacaacctaagttaagagaagaaaagattgaaaagaaagttagtagtagtaagtcgtttcagttactctacactagttaagacatgatggcaggtcaaacaggccgacccaccacctgagccgacgtggctgaccaagtcacccccgggggtatccgtatcccgacgtgtgctaaccatccgagctgtcaagatccgacgtgggttgtgaaggcacatggccacacccacacatgtgcacacgcatcgtgggagtcgccccgtccacgtcacccttcccttcccaggccgacccgaacccgctaaaaagcagcggaggcaaagcagaagccgaagccgaagccgcaacctgcaaaaccaagtccacctccgcctccgcctccgcctccgcctccacccaccaccaccaccgccgccgccgcgccgccggagatgaacaggatgacggcgccgcacggggggatgccgccgccgccgatgccggcggcgggggggctggcgaggtacggctcggcgccggggtcgctgctggcgtcgatcgccgactcggtgatccggggccgcggggttggggttgtcgatcagctgcatcatcatcagcatcagcatcagcttccgccgccgccgccgccgcagcagcagcagatggtggggaggtacttctccgcggagtcgtcggggctcacctcctgcgagtccagctgccggacgacgacgacgacgtccacagcggcggcggccgatgtcgggcggcacccgctcgagcgcgcgtacggcggctccggcgagatccacgtcgacgcctcctccgccgccgtcccgctcttccgccacagcagctcccccgccggcctcctctcccgcctcatggctgacccgcacggtacgttcccctccctccccggcgacgaatccgtcgatctcgccgtcgccggcgacggcgacggcgacggcaacgggtttagctttgcctttgcgtgtgccaccatattcgctactagctttttgcgtgcacttgtcgccgtccgattggttccccgctccccgcggcgactcgcgctccgccgtccgatcgatcactcgcgtctctgatacgtgatagcttgcctttgggtggctggcaaatgtcatgaagggttgctaggactaaattattttaatcaaagaaggaaacagagagtgagagagagaaaataaattatgtatcctgattagttatccgagaacctcatctcatccatattagtatcatattctactatcataattgacccactattatattcatgcgagtcccccactggcacatactccaggggcatatgtgctgttattactgtacacaagtaagcttaattaacttcaataatggtgctcgtgacagtgcaataatgcatctctggcaagaagtagaacaaaagaaatggaaaagaatcccatcctcgcacactgtatctagtgtactactcctatataagtgcatcaggtttatagttattagttcgaccgttatatttccaattgtagagcttgagtactgcctagcaagtttagtatgacttcctccgtttttccaaatacatgtaactgttaattagtattattatagcttcaatcactaataatttttaaatattttgactataaaaagtcatattgtttatatttaggatgttgatccaaaacacaacaacgacacagatttatagtaaaaaatgtccgttactaatgtaacttagggctaaatataggtagtctccagtaattacagctgaaggaatagtactaagcagcgtgacactgtcctatacattatgtgctgcaacatacttagtacaatgtacagtattatcaagttgatatgattaggctggtgcattgtatgttgccgacatgactgcgaccgtttattggcgcacttgctggcggccatctgcttgcagcgaacctggacacatgtcagtgtccgcagaattcatttcctaacaatgaagcacgtaccactcggttcactgcacctgctactaaacctctctctatcgcaccagaaaaataattttgttgtcgatcaaaacgggccccatggatttaatttttgatttattttcgaaggtgcaagataagtcccccaaaaatgccgttttcttatatttattcggaaggttaagataagtgattcttgttggtgcaggtaggagtatgatttaagataagtgtatcggttagtttaacctgctggctctgtcagctatgctccaatcatgcataatgcaaatgtcaccaacaaaaatatattgtttgtttttctatggtcatggttaattcagaagggataaaacgttatagtaatatcaggttctcgttgagtttgaaaagtcaatccatttttgttgattaatgtcaccatgcataaggtgagtgacagcaacggcagacatatcttgtcgtatgagtcatgctggggccaatagtatattcgagcaatactgcatcactgccttttttcagcatgataaaatagtttgaatataaacaaaggagtataaaggagttttttttttctgtaaagcaaaggttaaaaaaaatattaccagggacggcattaataattgctactgcatcgatcatggtaaattcattactgttgcaacttgcaacttttcatcatgggctgatatatcggatcagatgcattcacggataagatgtaaaggcgatgacaaatatccagcttgagtaatggccaggtgctatgctagatctagcttagattaagccttggctttagcttagcttttgtttatgccttcatggggtaggcttttagataatggatgccccatactgattgtctttactctttagccgatttacacagacatttgctgtttgatggggccaaaaatagtttcttcaccatctgtgtcgtttcttgcagtactgtttggtgtccttgctttctgaaaagaaaattgttcatttctagttttgtatcaatggttagaaccaaaagttgcaacaaaaggttcttgccaaaatcagtcacaaaagttaacttaactaactctgtttagtttcagataatgatgataattaagataagatttttatttttttagaatttttactaacataatgaaagaaactttcaaataaaatttaaaattttctattaaaaattaataacatacctaaaatttaaaattttcaaataaaaatttgaaactctaaactcagatttgaaaactttcaactcaaatttgaaactttcaacttaaattggaaaactttcaacttaaattttaaaaccttcaagtcaaatatttgaaaacacgtgtgctgcagattgaaaaaaaaatcgaaaagaacacgacaaaaattaaaccgcgcggaggagagacaacgcgaaaataggagaaaaatcacaaaaaaaaaaatcagcaacgttatagttcggcacccttggtcccaaaacaaatttatttttcacctacttatacttattaataaaaaaaattagaataccttcacttatcaaatttaatgcaattatttgtctttttatctactccaaatgtatttatccactacttttataaattccgatgcaacaattattaaaaaataaagttaacttattttgggatgaaatagaggaaacaaatgaacttattctggaacggagggagtaactaatcttcgaggtactacctctatcccaaaatataagacataaccttatattttgggatggagggagtaccatactactgtagtactgtatcaccttgaaagatttttttttttggtaatataagagatttatcgtttatacagtagtttgttttaaagattggccaaaacttacaaaaactgacgtgattgttatgagttattagttatgaccactcactgacagaagaatctgttgcaaaaactgacgtgctgcctgtgatgaattgcaggcaatggcatggccgcgacgagagggatgggcggctactccggcggcggcggcgacgccggcgcgatggcgcacaggaggctgagctcgcagtggagcttctcgcggcaggacctgccgcagatatcggagatgggcggcctcatccccgacatcggggagagcatcgtcaccggcggcggcggcaacagctccagcgatggcgccggccacggcgcgcagtcctcctccttcctctcctccaggaacttctccatgagctcctgggacgacaccaactccatcatgttctcgcccccgagcagcagcaagaaggcccgcgtcgccgccgccgccgccggcgaccacggcgacgacatggtctccagcttcagcaacatcgactcccaggtaatactccacactgccatgggtacaattcagatttgtgtttttgcccttgtgctgaaactgcatttcttgggattatccagtttggcttgtcgaagcagtcgtcgctggagatggccggcatggatgacttcttgcagctccagccagactccgtcgcctgcagggcccgggcaaagcgcggctgcgcgacgcacccgcggagcatcgctgagagggttagtcataatttggcaattttcccttcacccatctttgcatatgatatgattatgatacgatcgatgttggatgctggtatggagatctcatgttttctctgtgctgttttaggagaggagaacgaggattagcaagaggctgaagaagctgcaggatctcgtgccgaacatggacaaggtaactcaatgaactgtttgggtcatttctaccaattgaacctgacaattctgaacctgattggagctgtgcttgtccctcggttataaatcgaaattagttcaaaatgtttgatgtgatatttactggattcttctcaaatatacagcaaacgaatacatcagacatgttggatattgctgtaacctacatcaaggagcttcagggccaagttgaggtatgctagctccacttcagaaatctcttcagagaaaaaaaaaaactcccaacaggtttcatttgcatgtataggtagagttattagtaactaagttacagatatattcagggaattaaaatggaactgttacagaattacatctgaaataagtctctcatatattgaaattgatttatgcagaagctaaaacatgaccaagcaaactgcacttgctcaggcaagcacgattgctgaggctggagaaccagatctccgagctaatgttgtaatgatgtgattggtgaacccaaagttttgcttcagaagattagggtgtaaaagcacttcacatgtcaagtggcctccatgcctcgccctcccctttatcggttgtgttatggacagcgtcaatgacttgaagagtaggcggtgacaaagtagattaattgttgtattttaattgatgtaaggcagtggcttgtatgtaaaatcatccatttcaacgccaatgggattgcttcttattatcattgctcttattaaaagtatcctcctctttggcaccatttttgtgaattaccgactcattactgttgtttttgctgtaaatcaccttgtatgtctccttttcgtttttccaacaaacttattagttgttgtgtcatttccatgatctaaaaatacaaatgtttttgcagaaccaggattctaagtatgcatatttttttctatacataatgtcaggtatgtattcaatttctggttggaagaagagttgcacatctgaagtttatttatcatcagccttgaaatatgaaatatggaacagtaaagccaggctagcatttcatatgtgtcacaataccactatacagtttgtgaaatcatgtagcagaggatcttgatactgtccttgagaacaatcttaggtagcgtaatcttcggttatctgtattcctctcctgcaaattttacagggggatggttcctcaaaaagaagactgaagcaaaagaacttaatagcatgagtaggccattgtcagattttgtacagtgctatactcacagccttgattgtgttcttacaagagatggctgcagcgcatcgtagtgtccgtaaccatcgtagagcacgcagattggattgtccttgccatactcctgaccgtattcggcgatgatcctggggctatcagagcccttggtatacatgtaaacagtgataggcatcctgcaatatggcatcactcaataacaattgcaattatgcagaggaagatatggataacacaagaaaggtacctacctaagaacatgggagcacatgagcagttcaggttctcctccccaaacatgaggctttcttatctgtctcacatagctctcgaaatctccttcaagaaacctatccatcataatgaagattaaccagaaaaaaaaatacattatctgactgaggcttttttaaaatttatggttgaaacatcattagactatgagttaacaatgaaatccagaaggcaaacatgtaggagtaatagctaaagccagtcgttgcatgagaatttcacatatggataaaccagcaaaagtgattagtttgtcattttaagcatatttttagttatactccttctgcttctgcaaaagtatcatcaaaggtaaaagatgcatcaaatagacaacaggaaggaaaagaaaccattcagtgtcccctcttctcctgacaaactcatctgctacctggaacagacaaaaaaaagttcttcagtggatcacacaagttcactgaattgcatagccatcaagtgatgaacattgaacaatcactttcgatcgaagctcatcggcaagctccttctggatgctatcgcttggcgactgctttcctctccttaagcaggcaccgtacgcaacagacctaaagaggcatctcccatcgcctgtaattcctgaaatgtgaagacgacatcattctagctacatcctatgttcagcaatctagagcatcaactgaagcaaaaataagaacacaatcagaactgataagttagactgttagagagtgcagtgaaaaaattattccgatgcacaacaggacatatgtaaagaagaaagtcactattttcttttcttctttcaaaagggaagagactgatctctcatctaattttgtcaaagcggacaccaaattattttaagctgcgaccttgaccttaaactagcatatagtatacacacgcaacagggaaagaatcgcacaagaaaagcacatctaggagcgacaggaaaggcatcttgctacccgattagtttatcgcttcagattacagcctttagactgcaaatcaacactgatctctcctttctcccatatctactttttttatccccgaatactaaaatcagtgatctctcttaccactaatcacaaccaaaaagaaagcccaccttttcacaaatgggtaacaactccctaatagcaaccttgcactaatagcaactaactcatttgcttcctctgcagcatccaatcactaaccaagaaaataaagaacccaacaggagaagaacaagaaagaggtaagaggaaagatcaaggcaatcaaggatccaaggggatcaatcaaaacaggagccgggcatcgcatcatttcgcgatcggcgtcacgtacggatcgatcgcagcgggcggagctcccgatccgacatccgccgcgccgcgatcctcctctttcctcctcctcctcctgtcgtcgccggagacgaagggggattggaatgaggcagagaggggaccaggctcgtgggcgcacgagaggaggagatgggggggagggaagaacaaattgggcgtggagggggggtggggagagagaggattgggatggaattggattccccacgcactccgcttctgtccctgttcggattgccgcctctttttttttttcttcctcttttcttttctttttcttttctagttctctcttgcctgccacagtggcgctgccgctgagtgggtggaggcgttgccgtctcggatgctcgatttcccgccacaaataaatggcgggagtgagggagggagagccgtgggccgtgggccgtgggacgtccacttttgaatcttgctcctgggccctccgtgtcagcggcgcatggctgatttttttttgttaaaaaggaaaagaaaaaagaaagccctccagaaagcgttccgattttttttaatctaagcacatgcgacctcataattccaaatgtgagcatatattgtcctgaattctgtttctaatcaaactagctagcaggcacaaagcaaatgatccattaacatgtttcgctagtattacaattaactttgttgatgcagcttctatgtgaaacaaatcaagatttattagcacacataatattatgattttgatgatccaagcagatggattatatttcaaccgaccgctacagttccaattttcaaaacgaaaacaacatccaagtcaaatatggattaagaaaaaaaatgacgaagaaagctcgagactaacggcatgacggtacggtgccctatctcgtaatggttgatccaaccaattgcaaatggtaataagattttcttttctgacgacaaacaatcaattagacctaaacaagttgctacgagctagtgatttgtccaatgatcagcagccattagtttgttatatttcgtttgacattaagtccgatggaagaccactgcacacacacatgtgggcttcttgattaaaaatagaactacatccattacctactcatatttggaattagaaggttgcatgtgcttagatgtaaaaatttcgggaaagcgttagaggtgtagtagagatctataatactttgaaaaaaatattttttatattttaataaaaataagagggctgctacaaaacggaatcccgttgcaacaggatagacatattaactattctcttgcacgagtataacaggtatcaggtactacgtattacaggtactgggtaacaggtatcaggtatcatgcagctggtaccacaacaggtatcaggtactgtcttgtaccgttatctaggttttctgaaaataaaataaaattatagtttgccatgtgggttgttgttcagcgaaattgtgttcccatgcacacaccttttttttaaaaaaaaaacgttcatcaaaaaaaaatcctgaaatagtgtgcgctgataacacaattgtgctaaataacatttccagtttgccgtgatgccatgtccttggaatgaaacggctatttacctgcacatgagtatgtgacatgtgtttccctagttaaagtataaacaaatgcaattgacatacctatggttcagatttgcaacatggaattttttcgtagttcatatcaaaattgtattctggatacggaattcgtgcatttcaaaaaaaggttatgtatatgtaaccgttaattttctcttgacacgtataaataatggtttatatagtcgtcatcatataatttctcttgttttttcgtcgtatgtacatgatattaaagtatgttacttatttattttcttacgtagacacgtggactaaatttatccttatagtccccactaattcttccgttccatgagtctagacaaggaggggaccatgccattccatggtcttctatggattgcttgatactcgagtggtctatttgcttttcaatactccatcctttttaatcttgtcgtctattttttgtgtataaggttatcagaattatcgttgttttttttaatcttttgacaacatccttcttagattgccaagacgtttttacctgtcaagttctccacgagccattttttttctttttggagaactcgttctaatccatccattccattgtcaaatagtgtccaattatcgaagaccttgtcatttttcgatcgtcaaaagtgatgggtggggctatcctccaacaatcacatatccatggttcatctctatcatcattgccatcaacctctcaatagcgcacacctatatcatgtgttgttaaagcttggatccaatggccaagaaaattcaccctcatatgtctgtgttaataacaagagatttgctagatttaagggcatatgaaaatttgtaatttttcagtcacctaaaattacacattgctgagcttaaaattgtagtgttatgcaatgtgcaactttatttcattttatagttttaatttattttcatctgagtttgaattctttttacatggaattttataaatgtgcgtaattgtaaatttatttcattttaggttagtgtaatttattgtttaaccttttatatatggaagaatgtatgttgttttgaataattaaaagtggaggtgatgagaaccatccaattgccattcatgggaagagaaaaagcctaagaaaaataatttcagacctgttcatatagatgtatatgcatcgcactactggaaaaatacttggtccagaattcgtgttgatgtcaaagccgacacatacttcctccgtcctaaaatacagtaatatagtatgaaatatagtaatatagtacgagtttagatatattctaatactacaagctctttatagaggcctatctagattcaaagtgctagcttatattacctccgtctcaaaatataacaatttttggctatgaatctggacacacagttgtctagatttatagctaaaaatgtttatattttgggatctcattattttttgagataaaggtggcatcatcatcatcatcatgatcatgtcttgaccctaagagacaaacacaacagaggtctctcttgcacaacactagtagcctgggcccaaggctgaaatgtcaccaacaaactttgaaggccagtccacgagttttcttcattcatgtcggccctcgaatcactgtcttgcctcctgtggcattttcttcctttttgatctcatgtcatcgtcttcactggcttggcttccatgtcctgtcaagccatagcctaaccctgcatcttatcactgttgcatcttgggacaaaactataccatgaggtactagcattcaacaatatttaatttaattaactactgtaccaagattggtagtactaccttcttgagctgtctgatgttgaatttcttgagcagttgggcctcctgaagacaagtatctgcatgagtgaacctgtatagagtatagacacgttaacatgttagttgtgattcataaaatctgatgatctgatctgaacttgtgaaatgaagtgaagagagctatgaacatatggattcaggggagacaatctgatgatctgatctgaacttgttaagtagagtgaaagatgagctatgcacatatcttggcaaagaaaaacaaagaggaaatggcctacatcaccccaccgagaagggggggaagatagttttactttacacaaggaaacaacaaagaaggcaaaaaaaaaagaaagatcaagagaaacatggaacaagaaaagatgtacatatccactgatcaaactcagctcaaaaatctgctagcattggtacagggagaagctcctgttcttccacagtgagctcagagtccttcctagcttcctcgatttagacttgcacagctgttttgagtcgcggcggcacaccatggtgccgttaccggtctctcccgcctgctgctgctgctgctgctgctgctgctgctgctgagcttgctgcggcacaggctgtgccccatctcgctgcctttgctcccggaacagcttgagcagcttctgggacttctccttccccttgcctgtgccggttgccgagatggaaaccaaggaaggcaccactccttcctgcagcaccggtgcgatgcacttgtcatcggctgagcacatcaccaaaaggcaggacaccgactgctcctgctctgttggctcgccggtgtccagcagcatcgccaaggtgctgatcagacctggggtggacatgatatcttttctgccagcttgggttgccgcaaggctgatgagcactgcaagggccttctctgtccaacccaggccctcagacgccagggactccgaaaggagagagtgaagagcttccacaatgcccgcagacaaaagcgacggtacgctggcctggtggttggagagattgtatagtgtgtatagggcatcatgcttgcaagagctgccttttgtgtcgcgggcctcatgactgaacagacggtctactaggaatgacacagcctggctcgaaccaatgatgttctttgcctcaggtaggcaggaaaggttaaggtatagtgccgtggctggagcagataggcgtggatttgatatcatctgctcaagttgatcgattactccagcagacaataaaagtcccttgttcctgaaataaacaagcaaaggttaagcaaaactacagattaagtagaaatactgaagatgaactcagctagttgtaattgataagcagcacataaatggaaattaaattcaatacctgttattgttgacagcaaggttaaaaagagccatggcaccaatttcctgtgccttctcatttccatcttgcacagcgttcctcaagaactgaactagtgcctcagcaaacccatttgagcccatctggattctagcttcctcatcatctttcagaagatatcttatctgctcaaccaacctgcactggatgtgtaagttggttttttcatgaagcattagcagtaagtttcggtacccctcattcatatcgaaatcataacaagagctgtcgtccaatgttcccgattcgttgtttgctggctcttcttttctcacgttgtccaatggaactaccttgacactcttcacgttgatagagtcaaaactttcaagagacacgcagccagtcgcttcggagtcagataaagcaagtctccaatttacatcgaaggatcctggtggaccatcaggaacaggaaaatcattctgctcacaccagctggcaattagggccttaacacagtaatttggagtcaaagacaggtgagataattgctgctgagtctttggacaggtgctgtgaccatcattaaaccatttctcaatgcaaacacgctcataagtttgccctgatgaaatgataactgggtcgtacatcagttgtagggaaatagggcaccggagctcctcaggagggatcgacatgttttcggaccttggaccactacgcctacaattgaatgacccaagcctagagttgaaagatccaaaccttgaattgaatgattgaatactcgaaagttgtctgctgaatgctcggccattaccatagggtccatacatgtcctccatgcctaatattgtcggcgagcatggagacgatccttgagaatcagtatcatcaccagcctcacttctgaaaaattttgagtatttcctcattagattgtacaggtatgacacaacatactctttccgcttatcttcatcagaacgagccttctcaattagcttcttcagggcccttctctcagtgagtgctgccctggaagacgtaattcccagctttagtgcagccatatgaaaaacctcaagctccccactatcactggaactattcattttcctgtttctctggagcaaattgatcacctcgtcaccagcttccttctctgattgatccaatgtaaataccacttcttccaactcagcaataatctctacaatctgttgtgcaccaacaggtccagatgtcaggaaataccatatggtgtactaaattgtaaaaccataacataacttgggcagagttggttttgtggttcaaagaaatcaagtactaggaggataggattttcacatgacataccttacaaccaatttcttctgttactatgccctccacgcgtctaagactctcctgaagttgggttcttgctttctcaaatttcaaaagcacagtttctgcagttatggcctgaaaatgaacaatatatttaagcatataacatttttaatgatcccaatggcacggatcttctgaagaactttatggggatgctggtaacataagcttaccaagtagagcctgctgcaatctgcacaatgttgaagaagacctttggctttatctagagctacatgtagagagcatagcgcctgtatgccagatttgcttctgggtcttgatgcttcaatgaaagggaaaatcgctacaagttttgagaccgcaggatgaaatgctctgtacattccggcatgcaactgcataaaccacgatttccttagatcatgtatcaacaaatacatccagaaaaggttgataagattccagtaaggtggctaatgacagtaggtcaagaacaaatatatactctcattgccatcaagataaaagcactgccaagatgataccttagcatcattagccagaaaaggaccttcctcggcctccattgcatccatggttaattaccaccagagctccaacatctgattacaaagattcaagagagcaaaaaaaccatcttagatgaacagatcgctcccagctattctcacactacagataattaaacagatagtagaatacaagttcccttagcactaatgcattgaacagatttggacattagagaacgggacaaagcagccttccagcctatgagcacgaaatagaagagataagaatgccaaaagaagaaaccagccgctgcaagcctacacaaatagtgctccctaacagatcgatacctatctttcggctaaaattcaagatttcgagctcctggagcccatgaatttggaccaatctcacatcttttgaactaatccaaggcactcgactgttcccagaatgctgcatttgaccccatatcatgcctcatttttttaaaaaaaaaattcagataagcagacgtcggcagcttgctttaagtcttccccaaactaagtaagaattcaacgcagcatcctccgtgattggaagggaaatacgataaggtgtgggctgcgacatcgttttcaccactcgaaatctcccccatctgaacttcttttttttttttacttttaaccgcgagacaccaaaaaaaaatcagaggaagaaaagaactcggcgacactggaaccgcggtttaacccgagatccccaagaccacccccaatgcacgaactcagagaagatcagaagagaagaggatgagagaaaacacgagacgaccctcgcggcgcggacgaacagctcttgtccgcgacctccaaaaaaatcctaatcatttgcagcgaccagaacacgagcggaagcgcgaggaggatgaggagcagcagcctacggggaaggtgggaaggcctcaccatttcnagcggcgagagaaggggaggaggaggcagctcggcggcaggggcgacgtcggccagcggg

SEQ ID NO: 60727 - DNA, 2330 bp, Oryza sativa
gcatatatcattttatagacatactctttctagttgtataatgtgagacggttgacattagtagttgttggttagggtccatgtgtgtgcttttatatgtgttgtgcactcatttatttatttatttttgcatggaatgtgcaattcaaattatgcactggaattttggaagctcgggatttaaaatctggtgtttttttaagtatttttgtgttcttcatttgggtcttgatttagtcaatcatgtactccagcattcaactataataaactgtttctaatatcattatactcaatagctggtttatatattcacttggtccttttttgaaaagcgatcgtatattataattaccaataactaccacctaagctattttttgttgcatccgaaggacgtacatgccgcacacatgtagtaggttaaaaaagagatcctgctcaaattaaagcacggttttttttataaaaaagaattcgatcaaattaaatcaagatgatttcatggcatgtcgcgcgtgatgtttcttttctcccatcacttcgtcacgaaactgatgtttaaacaaacttagttgcgtacaactgcatgttcaaatgttttaatcagtctcttttactttagttatcttatcagcatatttgaattcacagttatgaatagttactctgatcactaggacaggagattaaaccaaggtgatctccacaaaatttcatagttaattattagaattagtacttgatgatctcaaaaaaacaaacgctgtgacctactgatgcatgcatcagaacaatttggacaaccaacacatgtttctgccaaaaacaccccaaaatatgccaacttgatttcgccaaacttctcccataaacccaagctttctctgaatattagaataatataatgtgcaggaaatggcgccaaatcgatctgatcccagatttgattaacaactcaagccagtgtaattaacagagatctagcttagctagtgccagcagagtggtggtgtgcatctcaagttggaacattttgttatgttttactccctccgtttcgaaatatttgacaccgttgactttttagcacatgtttaatcgttcgtcttattcaaaaacttttgtgagatatataaaattatatgtctatataaaaatatatttaacaatgaatcaaatgataggaaaagaaataataattacttaaattttttgaataagacgaacggtcaaacatgtgataaaaagtcaacggcgtcaaacattttgagacggatggagtactttgttagctagggatcccagctgattccatcagatgccaaaaccaaacatggccatgagacaggaagaatataaaaccaaatcttaacatgccaatcaatgcattatgtactaatcaagcaattaactaaggaggattgtgtgtgtgaaaggccacccccttccactggcttggctcctagcctctcaatgattccaagcatttccccctcagaattttaaatttgtcagagttagatcaagctctgctttccagtggatcctcacacacacatcaaatcacccaaccagatttgattttggtttgtctcaggagaaattaagaaaggtcatcacttgctaattaactccaccaggaaaaaaaaaagctctttttcctgagaagataatataccatgaggcctttaagagacaagcacttggagccataggtgatagagatattgcttagtagacttgtacttatgtgtcaaggaactattagcaactttgctatagcactaagcagagaataagggaaaagatgttactgtttgatgggcaagtttggttgatgggttagacaaattattaaaagggggagggattagaggattgaccactaatttaattccatgatgtaatgcattgcccacccatttgattaattacatatgtttgctactttgatagcaacttactgatcatctagtcttagatttctttttctttgcttatcttttatggctcttttttttttttttgcttttgaaagcgctggatgtttctgcaccaacaaacttggcgcaagaatattgcccactaactttgattcagaattcatggagaaagctgtagtagcttgcaaggagaaattaattatttaaaactgagacatgagtaacaaagaagcagagtgccgacctaatttcagaaaaatggcaaaagtagctcgctttctggggggaaatttttttaaaatattattgttttgaatatcaattcagaaccgggtaacacatgtatacagagaaaatgcagagatactggagggtacacaactg

SEQ ID NO: 60728 - DNA, 9960 bp, Oryza sativa
aaagaaatttgtataatttaacaacatgtaaattatatattatgaaaaaaaatatggtgagtctgaaatcatatataattgtacggatttacatgatggttaaagatataaatttgtgacttgaaaaaagaaagataagtaatttaaacagaatgagacagtactactcatccgtcgtgagtaggaaaagtatattactgtcggcaagaactcgaatttctagttacccatccgtcgttggtaggaaaagtcaaaccgacatcactgatgcccatcatgcagatatggtggcctaagctatttactattaatttcaccttttacgtacaaacagtacactaagggtgtgtttaaagagaaggggattaggtagatcgaaaagatacacaaaacgagccattagcacataattaattaagtattaactattttaaactttaaaaatggattaatatgattttttaaagcaacttttctatagaatttttttataaaaaacacaccgtagtttggaaagcgtccgcgcggaaaataaaatatttttctctctcaatcccctggatcgcccaggaacgaacgaagcctaaacaaactagtagcagtaattaacaatgccatcaacagctgacttaacctctcttatcaacactgaacagttgttttctgctggtctttcgatcacttgcagtatactacaacatcggccatttatttgcatctctcatttttaggataagagagagatttagcaattttctgttggtcttttaatcacttacagtacaaacatcggccatttatttgcatctctcattttctgagataagagagagattagcaagctggtttggttgggttggttggttggatcagattgatcatgtgttgatgagaagaacatgcagtacacctacgtggcaatcagacggagccacgagctgaggcggcggcggtccgaccggccggccggccgccggcggcgtgcatgcacgcacgcgcacgagtaattgggcggcgccgctccgcgtcggcggctggcccggcttgtcgtccccggccacgcggctgtcggtggcctgcactgcacccagcaaaaccagtgtttgagcatgttcggcacattttttatactccctccatattcatattcaaatgtatgacgccattgatcttttttatcaatgtttaaccattcgtcttattgaattttttttacaaatataaaaatatttatgtcatgcttaaaaaacgaatactgattaaaaagttgatcagtatccgttgatcaaaaagttaacggtgtcatacatttaaatacggagagagtattattttaaggaaaatactatacgacgatatttgtttggacgggatgatacctcaaaaatattacatgctaattggtacgtatcggttgatacctcattcggacgggatgatccctctgagtatatacctcttaggtatcattgcgtccgaatgggaataccgtcatgtagcatcctccttattttaaaacacggtacaaacgcttacgacgcacgtgcactcatccctatatttggtacagtttgaattcgaggttttaaacctacaggtatctcttctaaatccataaatcaatgaatgcatatttgtgagaccataattacatcgataacatttgataaataattttgtttctattttaaaaatatataaaaactttagaaccctagataacttacaaacactaaaattttctccaaaattcagcatgtatgagtgatctggagcattgccaacaggtacttggaacatgttaaactctaagctcctgtgtttcgatttcatactacttgatttgccactactatccgtataaaaactggccagactttcacaaactcagcattccaattgcattgacagcccttgattcaagaggagaaaaaaacaaaggtcattttccaaaaccagtacaccaacgagggcaatatcggaacaaaactgttagtactgtacttatggagccacatcatatttactaacgaaaattaatttgtaaataaaaattttatatatgttcttagcaatataaaagcaaagactaaaaaataaatttcgatgaaaaaacattaaaatcagctttaaattgaaaattcacattattggcctgtgctcccgtggacggggagacacgccacccacgggatcggacacagcagcgttcgcgtccatacgtagaagcaactgacgggtggggcccagcacgcgcgctgaccagagaggcaagcggggcccaccacgctggagccaccctgtccgcgccagctggcatggccatcaatgcgacaggtcagcacggggggctgtacacgcggcaggtcctcgtgctttggagcctgaccagtgaccaccactctgctacagctcagctgcactactggtccccatgcacgcgttgaacttgccggccaatcgggattcagaagatcggttcgagtccttggagaaaaaaaaagagataatatttttagataaaatttgagcaaaaatttcatactcctacttatttatctgtgtggtacaatctatttgaaaattgtgtacgttgatataccgatgaatgattgtttagtgtgggagtgtttgtttgagatgaacagagatacgctttctgagctttctgtgtttgtttggatgtgttatgatttgagcttttaaaaattgttttatatatgaatttcctaaaatattgttcaaagtctatttttaaagtttacaatgtataattatttcgtttgtaccttcaaataaccatcacaaattatccagttattcagagacgaaacataacacacaccctttaatttggtaagagattttttttccttacacatagtatatacacgcacgcatgcatatcactatatacacaacaccacacttacacaccgcgaatgcgctttctaatacatatactcaaagagacaaaaaccaataactcatctttgatcttattaaaatcatgttgaaagcttgaatgcatacacataaatatttatgaagatcattatttaaaactgtataaagagaattattagtagtatatatatcaattataactacctgaagcatctcgagcaaatctagccgatctcatgtaccactaattaattagcacggttctgttatgagccccttttgtctcaccaaacttaaacaccttgctaaccatctctgtgatacccacatgcccctgcgagattcttgcgatatcagaggcagaatggaattatatctggagattaatcagactgatctcaagcttaattagtaccgaccatatgcatcgatcatgggatttcaggatttcaggtttaggttagccaagcatccacatgcatcgccaccgacagcaattagtagggctcggagaaaggggaacaggcggtcgaaataaatcaataaataattaaacaaaaaactaccaattaatcctgcatgctttcacgacaatctggtgtaaccgaaatggagattaggctagatcgatcgatcatctcactgcatgtgcacgcacttagaatatcgttgcgagccaaaagaagtcacagataatcagggttaaagatcagttgattaaattcagtttcattttgggcgactttgtccgtcgatccatctcattatttttttgccaaggcgaattcattgatctcaacatataccactcatctctcatatgtgcgcgtatatataattgtagacttgtgtgttttcttaaaggtaactatttatgtttgtgtatataattacctgcataaaagttcatttgtagagaagtttgagagatcagaaagttaattgaattacgaatttaaacacatcataatgttgtgtagaggtctcataaaaccctgaaacacgccttaattaatgatgataaggagtgtgcacgcaatgcatccctaattaagtccacgtgcattcggaccaggagcagcctgcaatcctgcatgcctatgagacatagtatgatgcagctgcttaattcctagcttaattagcttcgtcgattacgcgttagagtagccagctttgccattttgatctatcgatacatgcatatcaccatatctcttggattaatacacacagctgaacactaatcactcacaacgcgttcacaaaattaagctcctcaccagctcgaaatggagattggacctaaccaattcatgaaccccatcgatccatcgatagatcactgtctttaatcaatcacttatccgtgatcattaatccaatcgaactgaaaacctaagctagctacgagagctgcaaaggatagagcgaggtagctaatgatcatcaccagctagctgggcctaaatttccggccagccaagcttgaatcctcttaacctttttaggtttggtcaatctaattaattcgttgtacctctaatatcattttgtgaggtggaatagatatgatcagttgggaaacgattaaatgaaaatgactaattataaatactacgacctgcctgcagctagcaatctaactaagtattggttgtactcgtacgtgtacagctcgatccttaattactcgctgacgtggcacaactagaacacatacatcgtactaattactaatccacaaacaaacagtgtcttaataattaatttgtttgtttatgcgtgttcttgacgggatgaaagcgattactgatgatgatgatgataaagctctagcttctcggtcaaaccgaactttatgcgtgtcaacttcaaccgtgcgagattagattaattgattaattatcatttttttggggctgattaagctgtccacgtcacacatgaaaaccggagatgctacgaaacgggtgaaaaaaattggcagctagctcacacatcacactcctagctagatagctatactgatcaaagaatggactagctagctcatgcaaccagtgtcggcttcggaattattctaagatgcattatattttttaatatgtttcccagctttatgtttcttttttcacgaacacgcaaaaggattgcacgttaatatattagaagaaaaagagttttagttacacaccgcaatcagccagactagcttatactaggggaaggaagaaaaagcaaaagaagaaaaaactgaagcttagagaaactacggcggctaaaaacagacttcaagcagcgggaaggggctaagccacgctagacttccaacaaatccccaaaagcggcgacgccagctaaagactatagatagccctccacatggatggactccagaaccactgggaccgaagagagagcgtagtcgaaaacctagagttccgctccttccacagacaccaagagaccaggagctccagggagtcgaagctgtcgcagaggtgctcaggtaagcaggccctggaggacggccaccagtcctggaaccaactgccacggggtgaagagagggcagaccagccagaaggcggcaacactcggagccagacctgccgagcaacgaggaggatgtggttcgccgtctcaagatcctgagcgcaaaaagggcaagccgagtaactatcgatgccacacttctagaggagatcagccatcccgcagcgctgcccagctttgtgtttcgtggaaaatgaataattctatataaaattttcttaaaatacttttctaaaacaaactttcaactttttaatagttgatactctcaaatagctatggttagcgatggtcaagatgaattaatcattttctcccagattttgggcaatgtgcagtagtgcgtgttcatctgatcatctcctctgaatagtcactagctagtagctaatcagtgctctgttcgtactgcttgctttgcatggcgcacactaataaacagatagagcaattcaatattttttcaatccactttcatctgaattccccggcatttctggtccttttcttcatccctggtgcctgacagtttttctctgagacgatgttgcagttaattttgaagcagccgagctttaattactggcagagaaaattgtcgatggtgattaagttcgagcagatgattgtctcgcagagagaggggccggcagggaggagtaaattgttcggcgccatgtcgtctgatgaatgaagtggtggagtactgtcaaattgtcaatgcacacctgcataatatcgcccggtatcccagctgacaggtacatctgattttaatttcatgcagatgcaatgttgcaacttactacaactctctgaattcagttcatctgatttaatttcttctccattcttgatggtactagcttagtttaattctgatccattcttgtagtctctgtcagggaactgtagaattagtggttaatttagcatgcatgttgggactaaataaatggtaaaaatcagatttttgataggaactcatacttactataaaatggagtcttctgcttgagcttaagatgaaactagcatagacctgccaaaatgtagaagaactcctatagtatacttatatattagtccaaactttagtttcatgtcatgtatcaccagaagaaaatggagcaagctgggattgtgcatgcaaaaaacacaagtttcggcagcaacctataaacaaagacagacacacacacagtgatatatttcagtcctctctctctcactcactgcacaacacactggccaaacaaagtgacctagcagtactaattaattaaaacaacaacaactactgctcctacttagtactgctaaccataactatatctacactaatgacagtgtttgtgtgcttgcttggggggcataaaactaaggggagataccaaaccatcatgtggttcttccccctttggtcaagatcaagaggccattgagaattcgcaatggttgcctcgcatgtgaggtgcatatggcgatgttccctcctccctgcatcggtctcggtctccacacagaaattttaatggcgaggtgaggtgagagggtgaggttgatgcctccaggctccaaggtgcagagcatgtgggacaaggacaagagccacacggacactgtgccatgctgaatttcctgaatgtatctgaatttttctgaatctctctgaatttcttgaatgtctgaatttctgaatgttgcatttgccctggtttggctgcaagaacaagcagaggccggggcctgggcatgtgtggttgtgcgtattaacgcctggatatgctgctgtgttgttggtttcatgcattgagatttggagagggctgcagccaggacaggcctgattactcatgctgctgcttcagatcagtcttctggttgtggttggtttgctactggcagtaacattttgttgatgacctatttttgtgggtctttgagaaaacattttgttaatagcattttttaagaaaacttttaaaatttgttgtcgatttcgagaatgtagccattgttaattttgctatcatgactactagaattcatccaggaagaactgagatatttagttgacgaacaggtgggagtagcaaggtagtatctttattttgtccaatgtcattagataatgcacatggcactcgaccggaggcaatgctattttgttactattgtttctatcttgtcaataaacaatactcacatgacattcattattgttgttgacttctttagaataaatgtgtcaaccaatggccgaaagacgagagagattatcacttggatggatcatggatggactaggtgagtcgtactacccccttaccttctcttctggtctcaaagattaagaaaaggaggccatcaagcttaccaactaacgaacgaaaagtagcattaatactgccacgtggaagaatgccattccttgaaacaaggccatttttgtttgagtaaattttataaaactacatgtattttgatcaaactatcgtaaagctacatatttaaggcgttgtatcactaaactacagatttagcaccatatttatcataaaactatacattcaaggttaagtatcacaaaactacatatttaatattgaagttatcacaaaaatatagcttctagagtttaaatctctagcaccattattatactggagctataaatattattgttttatgactaaattgtttctaaacccatagttttgtgacaatttagttactaaacatgtagttttataacacttcatcttaaatgtgtaattttgtgataaatttggagtaaaaaatgtagttttgtaatgtaccgagttaaatctgtagttttgtaatagtttgaccatagtacctacagttttgtgaaatttactctttattttccagtaagaaaataaacatagagcgttggacagtaccggctaagaaatgggccgtacaaacaagggcaatgcatcattctgacttccaaagcaggcctaaccttgtatcatgggcatattgcagctttgtgttcaccaaaagcattcagtcccaaaacaatcgcacaggaatggaaccggaataatcaaatatcagaagcatttagtaagtgtatctcaagccagaaccgacgaggaatcccagatatgcgacatatatacatggttacattctactaataaccctttcaatgtctaaatagccaccatacaagtccatacgtaagccccccggtccttccccggctctacctcacttcgctccaggcatttgacaactgaaggatgttcaaatacgaattccacacattctatatgcccggtgcagccaaaatgacatctccaagaaccaaaatatgtatggttcagtggaataactgctcagcgcatattccttcttgttgatctatcatcactgattaagcatcactgattaagcttctattacagctgccagttcctcctcggaggatgtttcagtggcgagactctcttcaggcagatcactcaggaaatcaccttcatcctcctgctttttaggtgcttgagtttccatcaatttccttaaattcgtctccagttcttttgcgatactttcattttcgttgaggtaagatttaagggcatctttaccacgatatgactcttcgttgaaagaataaaatgcaccacccaactttttgacaagcttgtgctttaatccaagttcaataagctctgaactgcggcatatccctttaccaaattccagctcaaactgtgctgtcttgaacggtggggcatgcttgtttttcacaatcttcacaagcacttgactacctatagtctgcaaacagaagtaaaaattgtcagtaacatttcaagaagcactacaatatgttgaagctaaatctgtaaggttactaggtctgtaattttgattgatgaggttataaaatcatatggctaaatacaaagcatgcatgtgccacgtgtctaacagtgttttggagatgctatccaaatagatatgacgcaggagtgaaaaactaggttccaaagaaaccttgatatgggcatagcagtgcatatatgtcaagtattgactaactgtctaaataaggtaaatgtcaaggatatgacttggttaattacctcttcgcctttctttaccaaaccaatacgcttgatgttcattctaacggaagcatagaatttaagggcatttccaccagaagtaacctccattggacctccaaatcctccaaatgtggtcactttagacctgatctataacacatacaaaggatgcaaataatataaaactgagagaaatgaagcgaatagactgcattgattagtggggtacaaagtatttaatttttttctgggacaggttgaatataagtctatagtaatgatgggacagaatgtattgaacgagtgttcaaatgatcactctgtgagaactcatgatcgacgaacaagattcaagtagaatcagttgcatcactgtaaacaa

SEQ ID NO: 60729 - DNA, 3323 bp, Oryza sativa
aaaaaagcaaattcaacaaacactaagagcagtgcccagtgcacatgtttaatacctggttaatgaataacaaaattgtctgggaaagtgagagagagtggctcagcttgcgaagagcttggctcatcaatctagcctggagagcaacatgtgcatcacccatctccccgtcaagctcactcttagggacaagagctgctacctatgtcacaaaataagatgcactgcttagcaaacttctcatataaatgaagttgtatttattaacgttgagtgtcgataagcatgttccaactgctaattggacattgttattaaaattttaagcagaaagtgcactattatcaatttgaaagaaggcaatgctccgaaaagaaaaataaaaatgggagggggatagatggtcaggttcttacactatcaacaacaacaacatcaacagagccgcttcgaatcagtgtgtccacaagactgagtgcctgctcgccacagtctggctgagagagaagtaaattactggtgttgaccccaattgattcagccagagctggatctaaggcatgctctgcatctacgaaggcacaataacctagaaaaatagcaaaaacaaaaactcggtgaggtatatattaggttcgtccaaattctattttagatgaacttgcagttgtcagtgctcatgatttccagaccaaatggttcatggttttttgaaatgctccattaaattgcattacaggcagattttcccgagtaggttctgtgcgtgtttgaagaccaacattatttggtgaagctagtaatctagaagtatgaaggagcaaataacaccttcatatttaaatgtttacactgaattaaactatataacctctgtgagctcaaaacatagcattccctaacccctctgagcgaacgaggacaaaagcccacgacaggtactttgcatatgtagcttatcccatggttgctgggctttgagctaatattgggctacacaatgtcagcatattccatgttctaaaacactaaaactggtttcgtcatattccattctccaaactccaaatataaagacactataatgctattggctattacacagataccaagctgcttggtaaaatacatagcgcaccgtgggggcctcccctgctgatgatgtcaacaaaatactcaatggtacaatattttgaacagacaagtttaagaactatgttcacatcataattagcaagatcactttcactgtcaagcagttgtaagccagcaaaacccttatgcatactacataaaaagcatctgactgactataccatcacaagttcacagcattaagcacatggtaataatttttatacgtattagatgttgttagcctaaatctttggattaaaggagaacacagaataatctgtaccttttctcatgtaaaatatatgctattgctaaaatatatagattaggttcgaagtgctgatattaccgccatgcttttgtgcttctgcaataacgtgaagtgcaagagttgtcttgcctgaagcttctggaccatacacctctataacacgaccctacagagaacaatagcatgacattcatacaaaacaaagtatgttttgtccatgaaagaacatttgcacacttcatatgatgagagaagactaatttttagggtagttaacactcagcagaacttagatttgcaaagaatatcatgcaatacaaattaaacattgatacaagtgagattctacttacaagatattttgtaactacataggaatccttacctttggaagtccaccagttcccaatgccaaatccaaagagaaagacccagttgacacaacaggtacttctctacgaccttcagaacgaccaagccacattattgcgcccttcccaaatgcagatgttatttgatcaatagcctggtgtagagccaagtctttctttgacagattctcttcaccagagtcagttccactggactttgtcttctttttggctaagtagatgattcaaaaagaataaatataagattcagtagatggcagcaataaaacataaatcaaaagaaaaaaaatcatgcagttcaatttcatcacaaattcacaatgtaacttatgtgtcaatacaggtaatatcaagatttaagatgatagcaactgagccatgggatgcagtatttagtatatctaaggtaaggtatgcacataataaatcataaaaggaataagtgtctactacctttagacgagaaataccggcagtggaaagtagagccacagatcccttgcttatagctctgcacaaagattgatgcattagcaaaaccatatcaaggtttttatgtgaaagattaaacagcattgtttcattctcaaccggcatcatttaaagctaattatgaatacatatcttccagccgcattaatttcattatgcatactgtgcgtatcacaaatgatttcagtatttgttttgaagtgcacactatgagtgaatctcttccattctcatcaatttcattgtgcatactgtgtgtgtcacaaatgatccagtatttgtcttaagtgcatacaaatacctacaagtctgaaggtgcaaacaaatcgtgaggtcaggataaagatgacacggagatgtgttgcaacctcaagaaaacccctggaggctacactaatctaataacctaaatcacctttggtgttgcaggttaatctattgtaagcaaaaaatatatttatggcgcattaaagggcatgtacaaatagtacagatgcttaggaaaaaaatcccttagcatctgttcaagagccttgatgtccaatagagaacacctattttacggacgctttagttatttcaggtgcttctccactccatttttcatgcaggcgctcgcaagcatcgactgtttcacttggcggcaagcacctcacgcagcaccagcgtggcaaaaatagacacagtttactcccctaagcatctgtccaagcacacagattgcacatagccttaataggcatttctccaaaatcccggattctaggtttgtagtacaaaataaggggaggggtaccctcagtgatcaaaatgggggtcattcggtggcacagagcaaatcgccgagggcatataagccgcgcggttcaccaaacgcaagcgatcaaaccccagcaaggatgccaaatcgcaatcacatatggcacaagctgccagtaggaacactccatggccaccaaggggggcaaaaaaaacacagtcaaatacggcggggagagaggaggggagtttcgacctcggggcaaggcgcg

SEQ ID NO: 60730 - DNA, 3326 bp, Oryza sativa
cgccaaccaccacccgcggtcctctcgggtggggcccacttgtcagcttcagcgagctatccttcaacccgtggaaatgggccacagatgctggggcactttctgcggcccagaaggaacgagcccatgaacgattggagattacggcccggcccgtggagcgccttcttcttcccagcctggaataagtctatttatctccctcgtgtcttatctttgatcgaaacgcatccctccaccgcaaaaccgggtgacagccaacattatcctctctagatatgtgtcgaatagtaaaagtgtcaagcgatatttaactatatctagacattggtccaaataaccattcaatagttcataaaaacacttaaatagctgttaacttgctcaaccactgaaggtgaatcgccaaaagcatgaatatctctctcaacttcaaaaaaaagtgcaaatctagtctttagtgtcctccaacttcaaaaccggcgtaaacatgatccttcggtgaacaccgatttctgaatatggaagaggcgttatagccagttttgtgattgatggacacggttcgatatatgatggaggcaaaatagacttattcctcgtagcctcatgggtgctcaagttcatggctgatctgagagaaatgttcgtggacctaagaagtagctctatgatccagtgttcatcgatcctccatgtgagattcgcgtgagagttcatcgtctttgcttgctcggataatcaatcaccaatccagcgggcggccggccactggcttgtggtttggttttgggggagagattgagattttgcttactttgagtgagatctagttcttcttgagttcttcctcatcaagaagaggaagcagctcgcatgcccatctcccctctcctcgcccacctcgctccgtcctcggttgctccggcggcatttggtgcccgtccggcgcggcggcgcttcgttggtaaatccgaattcgcgtctccaagctctgctatctttttgtgctttgggttgttcatctcgtgcaaggtaggagttgttagggttaagctagagaaatggtttgctagctaatgatttttacttgtacttatgattcagcatgtttctgaacctttgggttttatgactggagcagagagtgaagagtaatctggactagttttttttaaaactgtgtgcacttgccgtgttgttcgctgcagcctacagcatagtttcagctcaaatgacttgaattatacagtacatagaaagatgaaggaattggaacatttgttaatctgtgttactcataatattgtggagcttctattgaatgcattacagtagaaaaaaaaaggtcaactatgatatttatgttgcaggaaagtgtctgatgtttttatagtttgaaactgctgctagctgaaaggaaaacaggcatgggcaatagaagttttgacttgagttgttctttgagaaaagaggaggaaaatggcacaaatttgtcgccatttgtccgcaaactttttaaagaggtttgtattgttggctcctcagtaacatgaatttaatctagcccatctttgatgatagtgctaaccggagtgaaacatggatgattgttatatagtgggatgaccgcaaggcaaggggtttgtttcaccatgacatcagttcctgcgagacaaaggtgttacattcttctccaaatagatttatgggcactttctggtgaattgattgattctttgtagctgaatcccatataattatgcggcaggtactacctggtgaacacaattttgtggcgacattaatagaaggacgtgaccagaagaagcggcctactcaatttggaatgaaccaagtcctgcagccttttgatagcgtgaaattcaatttcactaaagttagcccagaggaagtgatcttcacattcaaagaatctcagaatgactctgtaaagtacttcgacaatgttcctcatgctgttgcagcttctcctactgccattttgatcaatgttagtgagtgctacacccctctaacagttatgcctaaatcctaatccaatatggtgcacacatgatctgtttttgccattgtttgtttgataggtgagtccaattggctactgccatgtgcttctgatccctcgaatccaggattgcttaccgcaaagggttgataaagagagcttcctacttgccatgtatgttgcaagtgaagcaaaggatccattcttcagagttggttacaacagtctgggtggtttcgcaactatcaatcatctccacttccaggttggtcatgtcataactttttcccgtgtcctaactctaaatttcttatgatgtcctgctgttgacacattaattcgtaggcgtactatctgaaagtgcaatatccagtcgagaaggcactgacggagaagcttacgactctggggaatggtgtcagcattattcagctggttcagtatccagttagtggttttgtatttgaaggaggggcatgcctggaggatttgtccgatgttgtttcaaaagtctgcatcttcttgcaagagaataataaacctttcaatgccctcatctctgaatctggcaagagagtgttcctgctaccacaggtactaccctagaacacttattgcataacttctgaaaataatttcacactctatatcacagtagcaatggataacaaacattttgtctccgtctgattcgatcgatcagtgctacgccgagaagcaggccctcgggagagtgagccaagaattcctcgacatgagaataaacccagcagtctgggagctcagtggccatttggtactgaagaggaggaaggactacgatgaagcatctgaagcaaccatatgcaggtttttggtcgaagcgtctctgtctgaatcagaattccaagaactgaagagctgcatcttggagttcctgtccagtgcagctcctgaagaataaaggaggccaaacagttattcagagagataccgatttgtaaccgtaggtgcaataaaaagttggcccgagtctgttcttcagactgatgtacaattgaaacctctttgataaattttatataacagatgttggtgttagatcatcgggacaattgtcttcagccttgagttattgttgttgaaggtatctcaaggacagtaagtttaattatttatattatgactcgcttctgttcaacgtggcctattagctcagctggttagagcgtcgtgctaataacgcgaaggtcgcaggttcgagacctgcatgggccaccttttgcttttatttttatgattcgatttcatctttatt

SEQ ID NO: 60731 - DNA, 3328 bp, Oryza sativa
  unsure (1)..(3328): unsure at all n locations
agcaattccgataaaattttacctataaattacttcctccgtttcacagtataacatttttttaccattgtccatattcatttagatgttaataaatctagaatatgtatgtgtttatatttattaacatctatatttatttagataatgttagaaagttttacattgtgaacggatggtgtattttttattcctaaaaaactaaaatccgggtaaccaacgaggatatctgtagttctgtactgtacccgactcaaccactgtgcgctccgtccagtccccggctccgtggaccgtgcactagtacaaagcctaggatttccgccagccacgtctccaacatcctctcctctgttcgttccccgccgcgaacggaatccgaatccccaatggccgaccgcgcgccgcctccgcctccgccgcccgccgggatcgactccaggagcggcttctgcgcggcgacgcggatcttccacagcacccgcgccccgggcgacctcccgccggagtcgctcccgatgaccgcggcggcctacgccttctccctcctgtcgtcgtcgacgctccccggccgccccgcgctcgtcgacgccgccactggcattgccatctcctacccgtccttcctcgccgccgtccgctccctcgcgggggggctctggtgctccctcggcctccgccccggggacgtcgcgctggttgtcgcgccctcgaggttggaggtccccgtgctcgacttcgcgctcatgtccatcggcgccgtcgtgtcgccggcgaacccggtgtccacgcccgaggagtacgcgcaccaggtcgcgctgtccaggccggtcgtcgcgttcgcggcgcccgaggtggccgccaagctgcccgagcatgtgaggtgcgtcgttatcgggtcggatgagtacgggaggctggcggcgtccgacggccgccgcgcggcggctccggcggcggtggcggtgaagcaatcggacacggcggcggtgctctactcgtcgggcaccacagggcgggtcaaggccgtcgcgatcacgcaccgcaacctcatcgcgctcatgtcgctgcacgccgacaaccgggagaaggtcgcgagggaggccgccgaggccggcgaggagccgccgccgccggcggtgacgctgctccccatccccctgttccacgtgttcgggttcatgatggtgctccgctccgtctccatgggggagacctccgtgctcatggagcggttcgacttcatcgccgcgctgcgcgccatcgagcgctaccgcgtgacgctgctgcccgcggcgccgcccgtgctcgtcgccatggtcaagtacgaggaggcgcgccgccgcgacctctcctccctgctggtcatcggcatcggcggcgctcccctaggccgcgaggtcgccgagcaattcgcttccgtcttccccaacgtggagcttgttcaggttaagcaaagcatccatccaacaatcccgtgcactctctctgcagcagaataatctactgaatctcatcaaacttacaataatgttccagcagaataatctactgaatctaattaaactaacaatgttctgtacgattgcagggctacggtttaaccgaatcgtctggcgcggtggctgccacagtcgggccagaggaatcgaaggcatacggatcggtcgggaagctggggtcgcatttgcaggctaagattgtagatccctccaccggtgaggccctcggaccagggcagcgcggcgagctttgggtcagaggcccaatcgtcatgaaaggcaagtagtgactatgcattttttgtttacttgtttagataataatacagccaggaaatttcaacattacatccaacaatgacgattcatggcctgaaactttccatacataatattatgttatcgtttgattctttctgaaaggtgcatacagtcaattatttgtctgaaaggtacatacagtcaattatttgtcatatataggtcttgtaagaggtccctcgtatcacgtaaatgttgtggtcaatagttgtttgggtaaagtgtaaatgattagctcgttttgcctgcttgtgctttgtggcacgacaccttcttctttaggctgtgtttagttcacgccaaaattggaagtttggttgaaattggaacgatgtgacggaaaagttggaagtttgtgtgtgtaggaaagttttgatgtgatggaaaagttgaaagttcaaagaaaaagtttggaactaaacaagggcttagttatcggtgtagtttcagaaaatgagagtttgtcagaccaaatagtgatggaccatgtggtagtaatagcatttgcaacagataattggacacttgttcagctacttgacggctagccagcatgccagtaggagtaggtatgctctcaagttgtttatttgtatggaggcatcacttactggtcctacatggattttgatatctgatatattactaaacgtcatccatgctttatcagagagactagaaagttagtgctggtctagacatcaagtttgttttcgactatccaattgaacttctggaattgtagtgttattagtttaaaaagcgcttaaggatatagaaatctgaaataattaaagccaatatttagcttgttgatggatttgaccttttggtagtaggccttcccagtgcagcatatacaaggacatctagcatatctgtgctttgccttaatacttgagccttttcttgattgtatcatttttggggatgctttttcaggttacgtgggtgatgatgaggcgaccgcagcaacggttgactcagaaggctggttgaaaacaggtgacctctgctacttcaatgaagatggttttctatacatcgttgatcgactgaaggagttgataaagtacaagggataccaggtaactgcctgccatagctgcacagctggttcaaaactacattcacgccagccacctgggtaagttgtcacaagtttctgtttgcatgatgttggcctttaaattttttctcaggtacctccagcagaactggagcatattctgcagtcccatcctggaatcgctgatgcggcagttatcccgttagtatcttaagaaaaaaaattgcagatagcttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60732 - DNA, 1087 bp, Oryza sativa
agtatttacatacctgcaatataatcaaaatgcatttgttatgaatgagttttacataactgacgaattgaatgggcaattctccaatataatctatagtcgatagagttatatactactacagtaaccaatttctctcttcttattttcataaatttagcagtaagctccttgtgaagtgcactggtactgtgctaatactcttacttggacgtcgtactcatggtgcaacttaagataaactttgatctggtcaaatttttaactctcctaaaataccccagatactatatactgattttcagaattaacatttacaaggacaattctcctgaaagcaatagatgactaggaaatagacagacgtcatggtaacacaaatcagataacagaaaataaaattgtgcagagctacaaggtggaaaggaaaactttaccaagcactgtctgcatcatctcctgtacagaacggtggtgacctcaagagcttagcatcttgctcgcattgaatatgatttataggctttctccaaaccgcgattgtaccgttctctgaaaccttcgaccagcaaagttttttcactatctcttccaaagctaattgttcacctggcatacccttggctgtacggttcaaatcatcatactgtgttttccagctgattggtggcatagccaatacccaatatccaccaggtcggagaagacggtcaatttccagcatgtagagttcatctgaaatcagctataggtgaatgagaacaaactaaagcacttcaccacacaataattcttctcactgatgacaacatctgccaactttcaaagctattgatatatgcaaccaatcaaaagctatacatggagacgagtttcatgatcaacaagatatcaagaattatcacagagtatgtatctttcatgtcctaccatgagaattccccggaacaaggcagcctgcgcagtgcaccatgtcgaacgacctcgtcggataaggcagcctgcgaacaccgagtgctccgatcatcgctggcagaccacgctccaaggcgagctgcacttgtgctttatgcctatttctcctatc

SEQ ID NO: 60733 - DNA, 2668 bp, Oryza sativa
taatttttctggttgccagaaatatcaactgagctctcctgtgcataaatcgtaaatttcctacctgtttttggttactggacacacttatgagtgagtgccctcatgaacaaaatgccattatcaatatgaaacctcgcaccttttgatatggtttgtttaaaataaagggctctaatatcacattccaattaatcgactaccgtaagacgtcatgacaaatggtttgctgcgaaccatttgtcgtaaaattaccagagacggttcgctatcatggatgtctctatttgatagttcactatcacagccgtctatatttcactgctgcatcaaaatccatcaataattagtactataagagagttttgcggatgtgacgttgttgatacttcacagacataggtggtgctcacggtaataattgtctatgatggctgaaaagtctataacaatatttatcatccctagtttaaatttctcacaaatgaattctatagccctcttttctctcctttttcttccattgccctcctcttctctcatgtggctggaggcgtcgtgtatcaaggaattttgtttaaacaatagaatttgctctagtatgattccctgaattatgccagtttcgaaggaacccaaagcatcatgaaatttgcgacttatgaaaattagttgcatccaacatatagcaaaaatacatatcaaacacattttttccttggttgcaactattaaagatggctatttcctttctgataatagttcatagactgatagacatatctaccaatccgtctctgttagttaggcaacataggctgcgttctttccacaagtttcccaacccctttccctcgttttccgcatgcacgcttttcaaactgctaaatggtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagcctatatagtagtgtttgcactccttttttaataaaattttaacatttaatctgaaaagaaaaggtcaagaggtactaagctaagaataaaagcagtttatgagattagtaccaacaaaatcccagtggaaagcaactgggaactttaattttgggattgggtcagcaggaatctctgtgattatgatctagtaatacaagcaactactactcattatgagcaatcttgagctaagtactagttctgtatgaccagtagaattggcatctcaaatactgtcacgccccgaactagtcccgaccgaaactagcccgtgacgctccaaattaacctgttaatcgataccagtcccaggaaatagtgctggtatcacaagaagacagaatatcacagcaacagaggtctctttattatagagtaggagtacagtcatattgggctacggacagattccgagctcacaactgcattacaaaaggggaacggaagccaagacttggaccaaacatcacaggcgagacttgggaactaggccgaaaccctaaaactcatcgtagccggcttgctcctggaagaactcctcgtcagcgggatccgcttcatcttcttcagcaattggggggattatttatatagagcaagggtgagtacgggagtactcagcaagccatgggaaataagtgtttaatgcaggcttcaaagaaaggctgttgtttttgcaattgattttatttaaactcttttctgaaacaactaagtgagtgcttctcaaacgacacgaatgagacagtgcgtctcgtccggtcggagtatgtgcaatgtatcagtcttttgaatcgatcaaggttggcacccggccaacaactttcaaatggccacccgggcctggctgatcccatcagccgcagattttccaaacatcagtcccaaaccacatccgcaaatttcacaaagcagtagtcaaacaaaactacgctaggaatcacctcacatccgcccatgaccgtgggcacggctgttcgaacagtttaataacctctgtagaggaggtacactttacccacacgacattactaacccggatcatccagcccgtgcagaacggccacaactagagaccttaaggctttcatgacaaggcatttcgaaagccgacacaggttcaccatatgccaacgagaggggtcccagaccaacaacagattagatcccagaccatactgtgccaggaagcccagggatcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcgattttggaaattcatttaggttcgcaagcaccgacccaggtgtcgggttttccaagtcttttataaaacccaagttttacccaagatgtttctcagattttaagtttgaaggcgaccgtcgatactcgtacagagtgcacgattaccgaggcgcaactaggtggttacaagggaa

SEQ ID NO: 60734 - DNA, 2027 bp, Oryza sativa
gggggggaaagcttgggtttatatgggcgacaatgtcggtttgggagaggggaaccgactttggacggtcaagccagcgagttggcgctccggctagcagccaaatcggcgacagggaggaggagaatgacgccggcggaggaagaaaaaggaaaaggaaggaagaaaggggacttgccccttgccactttgggaaaaggaggaggggatgggggcgacgcggcagagggaggaggagctctgcctccgtcccttggaggctagcgtgcggagtggcgggggccgggtcgatgacgacggcgatgacggcggggcggtgtggagcggagcggcgacacggacggcaggcgtgggcaggtgcggcagaggctgacggcggcggcgaccaggcggtcggccaccacggcacgcgcgcgcgggaagcaacgggcggcgcggcgatttgggcggcatcggcgggaacggcaggagggctcggcgcggctcacgggcagagcggggagagagagagagagagagccggggagggagggggagatgggccgagagggattcggcccatcgaacccgagggaggcaaaatagacttttgcggagggatttgatttgggaaggatttggattcgggattgaacttgacgatagatcagggatttgagatctgagatagcacggacactagacaacaagcaaagaaacggatttcgcaaatagggtttttaagagatagttttcccgctaggcgctacgacggaacgggcgctacaaatactatttttaaaaaccagcactaatacttacgatggtaagcatgttcccaagtactaaaaaaagtcatggaaaaatcacagcttaattcagtggcaagattatcttagccatatgaaaattagcttatctgattaagatgctttgttgcatggatgccatttttctaggaaaaagaaaactgaaaagaagatctatggcatccttgcatacgttataaataaataaataaacaaaatgataaaatttgatgaattgtgccaggctgccagatcgtccaactggtgtgtttccaagcaaaaacagatatacagtgacgtacaaaatatcatcaaatttgttgtgtcacacttcaggcagcttaactgaactcatcaagtttaaggcccatttgggacctgcttcatacggaaatcgaactgtttcctgctcagatttgggcgttctggaacggggacaaagagaagctgagatttcaaaatgaatcaaacaaattcagatcagtttttgttgtttgtgtgtgtttacatgctctgctttgaggctcatgaatcatgatctctctctatgtacagtgtgaaaaaaacagaacaaaaaaaaaaggggttttttcttttttgtgtgtgtttgatttgagatatctctatgatggttgatctatctatacagaatcaaatcaaagaagaaaaaataaattcgaccataaaaccctcgaataaaatgtcgaagaggattagtggtctgttaatcttgattagccgtcttgacagtggtgggttaagactctgtcagattagcccgagcgtctgcaccaagccgcccatctgtatcatcgccgcgtcgtgccacggcaatgcgccgccgccgcgccgccgacccacgaagtccatcaccttggcgagcacgccgccggcgtcggcggcggcggcggcgggctgcttcttgtcggcgccacggaggagggagatgtaggtggcgaggtcgtggacggaggcgaggtcgccgaccttgaagaagtcgagggggagctcgacgccgacgtgggtgtagcaggagtggcgccacgggcggagcacgccggcggtggcctcgttgaggaagacgccggggagcttggtgatcgggtcgtgtacgttggtgacgcggagcgccttgacgccgagctcgtcgcagcgcgccttgaacgccgcgttccccaccctcggcccgccgaaagagaagacggtgaccggggcggcgcggttgaagccgagctcggc

SEQ ID NO: 60735 - DNA, 871 bp, Oryza sativa
tgaaacctctctctctctctctctctctctctctctcaattcctcgccatgttgccgggtcggaagagaaagctttgaaaagcaggttaagttagtgagggagattaagagtaagcaaattgctaattaggagtggtactgtttcaattaagaattcttttgggtgtctctgtctcaatctaacctttttgtgtgtctctctgactgaaagtttggcagggtgattgaccagaggatgaccttttttttttgttgttgttctgaagatatggagatgtgtgtgtttttcttttaaattattgttcagagttactactgcttcattagcacaatttctttatgactggggtttggttggggttggttggtgaagaagaagaagatgaagatgatgatgtgattcgattctcggagagattggaaggtcaaaatcaccatctcaattcttggagagactttggaacaagagaccaggaggaaaggaatcttgagattggttggatcctcgggtttctgaagagggagcagggaaaaaggcagggaagcagagcaggaacattcagacaaaaaagaaaaagaaaaaagagatcatcttttagtagtacaaaaatcattcagaaaaaagctgttatgatcactgctggattttattcttggattaactagcttgcttgattgcagattttacaggtcaacattcagaaagaaaaaaaagaagcagagcaggaacattcagaaaacaaaaaaaaagatatcatctttactgcagaaaatcactcagagaagctgttatgatcaagtgctggattttgcctttggattaacttgctttgattgattgaagattatgcaggtcaaccatggctagata

SEQ ID NO: 60736 - DNA, 17056 bp, Oryza sativa
gtgatgtttggaaccagatacttaactttagtctatatatttagacactaatttagagtattaaatatagactacttacaaaactaattacataaatgaaagctaatttgcgagataaattttttaagcctaattaatctataattagagaatttttactgtagcatcatataggcttatcatggattaattaggctcaatagatttgtctcgcgaattagtccgagattatggatgagttttattgatagtctacgtttaatatttataattagtgtccaaacatcccatgtaatagggactaaaagttttagtcccatctaaacagggtctaagtccttctaaatctgttactcatataactgtctaactgagataaagtttaaggttgtcatatcatatcatcgtcacgttatatatatgatccctgcacttctctttttatagaatggacgagactcttttttctgtatatgtagcggtcttgtactcttgttagtaccattttgcgtcccattttgacgagacgactggcgtgccattttgcgtcctggttcattacagtctaatttggtgacaaacaaacaaggaacaaataggtcccatggtctagcggttaggacattggactctgaatccagtaacccgagttcaaatctcggtgggaccttaattttctcggttttattttctgcctgagcttattgtcctcctcctgattttttgttgttgtctattttctctgccggaaaaatgtatcaaactcgtcgattctactcgtttgagagcttagtgtgatattgtccttctcctgaagtttctattttttactctctctgttatgaaaattttcatgctagaatgatttacattgtgaaatggagagagaactcgtttgtgcttatttatccttcccctgatttttttccacaccaaaacatatattgtgataattgagtatgctacgcgtctgacgtactacgagtttactccctccgtcccaaaaaaagacaaaccctgagttttcatgtccaatgtttgatcatattatttgaaaaaattatgaaaaaaattaaaaagacaagttacgtataaagtattaatcatattttatcatataacaacaatgaaaatactaattataaaaatttttcatataagacggacagttaaacgttggacacgaaaatctaggatttatttttttttatagagggagtacgaggtaaaaatcgtcctcagcgccttcagaaaaaaaaaggacaaaaatcctcagcgccaaccgactccgctccacagaccacagccgcccaagtgtgcgaggacaacggcggcggcggcggcggctaggtttttgctgcacccgacgccaccgcccaccagcgagtgtggtgggccgcggcggcccataaaagaaatatctaggcggcccatgtagcgccagaaaatatcttctcccccgcctcgggatccttatcctccgcctcgcgcggggtgccgtccgatcagatcaggacggccgcgtggggctataaaaggagggggggtagggcaagcagtgcctcctcgtgctctctttgaggtgggttggcttctcctccccctctttaccttttcctcctcggttcggttccgtggttcgtctagggtttagtgggttgagatggcggcgccggatgtcgagtaccgctgcttcgtcggcggcctcgcctgggccaccgacgaccgctccctcgaggccgccttctccacctacggcgagatcctcgactccaaggttcgccctcgctctcctacgccgtgtcttgtgatgggttttttttgggtggtttctcgtgttggctggatctgtgttgaatttgtttgggtttttttgttggtttgctcggatctgtgatcctggggggttttgctcgtgctgttctgatctcgttggtgccagatctgtgtggaggggttgatttggtggtttttttgggtggatctgatggggatttgtgtgtttttgttttggttgtttgcagatcatcaacgacagggagacggggaggtcacgtgggtttggcttcgtcaccttctcctccgagcagtcgatgcgcgacgccatcgagggcatgaacggcaaggagctcgacggccgcaacatcaccgtcaatgaggcccagtcccgccgctccggcggcggaggcgggggctacggcggcggcggtggcggctacggcggcggtcgtggaggcggcggctacggaggaggtggcggcggcggctacgggcgccgtgagggcggctacggtggcggcggcggctacggcggcggccgtggcggcggcggcggcggctacggtggcagccgtggcggcggctacggcggcgactccggcgggaactggaggaactgattggtggggcccatcgtggccagttatccttagctatccgtgtcagaatcatcttatcatcgagtcgagtcgttatcgtgtccagtggctctctcgagtcgagaagccctctatccatccatccagtgttaggtgttcttcgtccgtgatgttaccatgaattgagttcgctttggttatggtgtttgaactgcttgttgctatctatcggaatgaaatgaaatagaaaacaaggagaaaaaaaagagttcgaaagttttgttcgcataccatatatttccttccggtgcgcgctgtttattcctcgctcagcagcaagattgtttgatcgatattgcagcaagcaattacacaataaatatattgctacactggtacttcaaactacactggtggtcggtgattttcaatagcatgaaccttaattgaacatctgtgtagcttacatctccttcgaaagctgcaatgcttgagaacttggaaagaaattcttgtgatggcagaagctattcactgtccttcgctgcatttacagtccatacagacacagcatttccattttgcacaagatagagaacaacaatcagccttttaggtcaatcccaagtgtgcatcttactgattgtcgaatatgtgctaagaacctgcaagagagtgaggatttttatcattgattgattgtcgaatatatgctaagaaccttcaagagagtgaggatttttatcattgatggagctttgtttctgtaatccaagatttgggaaacagtttatccatgttagggaaatgatttatgcaaacaatattttggagcaaaagttagatagtagtatatgtctgccgacgacctcaacccaaaatattgttttgaggaactcttggattacagaacaaaatactgattccaaaatgatttatgcaaacaatattttggagcaaaaattttgtttctccaagaattcagagaaacaatcatacttttttaacacaaccatcacattggagatttcaaaacagcagagatgataggatctactctttccatgtcttcatccaaacttaattaagcttataattgtccttttatcaatttgcgaagaaagaatgaatgttgataagcagtcaatgcaaatgtcaattatatgaataatatctaaagtttagcatgccaactaaagcttgtaatatgccagtatgtttaaatgagagattgaaaatgtaggggagtatagtcgatatagactttcagtaaggcaagaagaaatgcaatgtcattatgttccaggataaaagggtcaacagaaagacatcatcatgatctcaagcctttgcccgcttcattaggaaaatactcagcagagtgtagaatcttttgagcttaatgaccaaaaatctgcatgaccacatggtaacgtaagtaaattcttttctactttcagtttggagatttagttgttcacacacctccaaattaagaaccaagatgcattgattcattctgaaggactgaaaaatggaagaaaaggaaatgatggagaagaaagaggagagctcgtgccatttggatctgttcagtttcgcccttagcagtgtcgatccaaattcagagatccaaaaatgatttgtgaaaaaaggtacaactttggtgtgattgaagcagccgatgacagaaccataagagcaagatgtacactaatggtggtatgatcaggattacctttggccaagctgttccaagagttgtaatttaggatacaacagaagtgcttaatgcatttggccagacaaacaactatcagcaaacgacgaaaatcatacagtatcatcactaaacactgaaggcgaatcaggggaaattaggagaatagcatacctctctcttttttacactcgttataatcgttcaaactgctgctggcccttgcttttgtcttggttggcttccaaacctgcagagccaacatgaagttcatcagagattaaccacacatgcatggaactctccaaaaaagtatgatgactgtgaagggggtcgaggagatgagggtcgttaagtgaagattaggacggatggattcgcttgagggaggtggtatactggggaagcagtcggaatcggcgatcctggcgacgctggggtacgggccgggacgtcgccgccggccgccgcagccgccgccgccgaggacactgggtgggcggagtcatggccacattcaccgtcgccaccatgatgtcatcttttttcctcctcttggacgcctggtccagtatcacgaacaggtagatcgagccgtcacaaacccgacgcagacatcgctaactccagacctcctcagtcttcaccctcttccccacctccagccagggttcactttctcgttttcggcctttgtatcgggcaatgccgatatgacgaaataattttggtccgaaatttctaaaatttaaaacaaaatctaatcaaatttgaacaaatgttaccaaaattcatgaaaaattaaaataaattaaaaatttcagctgaaataatatcgtattggaggggtccgaaatgacccgaatttccgaaattttgatcattccgaaatttccaaaataatttaggaaatttcagtccgaaatgtgaaaccctgcctccagcttctcgccgcttgcagccgccctccatcgccaacgggggagagggacgacgcaccacggggccgagccatcctcttcaacacttcaaaccatgaccgggtagaacagccgcagaaactcacaccatggcttaagctctgataaagagagcagatctgaagaaggaattggaggagagtgaaagggatttggacatgatggtcagtgtaagtggtgcacattttctcatgatctttttctcttgatttactctatagttctggcttatggatgatatttataccttatttcatctaccgatcagtcttgcatcatagtaaattatatagcgagtgaattgacagcctgctaatttgttccatgctgcaccctgcattttttttctcagctcatccattgtctgattgtttacatggaaggcttactctgttttggttgaaaaagcttagttgggagaatctgtcttttctttgtatgatataaaagtaacatactctttggacgtgctttttctgcattttttttttgccttacacacgtccagatgcaatctaaccaatagacgaagagagagaaggacggcggccggcgccggtggggagaagggccgcgatggcgaccaacagggatgagggcatgaccagcgggaaggagttaggtgacaaagacctcatgtcccttcgagcggcgacggtggatccgcccatcgcctttctcccctctccctcccggcatccttcctccctccccgagctccctggcttgccggtgagcgcacgtagagagagaaggacggcggccaatgaccggtggggagaagggcggcggacggcggccatgggggagaagagcgacgacgacctcatgttccctctccctccctacatccttctgcctcctcccctttccctcctggcatccttcctccctcctcgagttccctggcctaccggcgagcgcgcgcaagaaagagatggccggtggttggcggccggcggccgacggggagaagggtggcaggaagcggccatcggggagaagggcgacgaccttgtctcccttcaagtaacggcggtggagccgcctgccgctcttttccatctccgccgccgtcgtcaccgctggccgcatctggtgcccatccgcccccctctccggctctctgcgctcccaccgttgatgccctccccttttcccgcgtcgccgccgccaaacctccccgtgacctcatggcacctagagaaaagaagaggggagaggggagaaaggaggggggggggggggggggggtgttgagaatgacatgtggggcccatgtgggccacatcattttaattattttttttaactgacatgtgggatcatagttgtattattttccaaatcaaattaccacgtcaatgccacatcagatgaagaccgagtatatttagccacgtcagctaaaaccgccgtccaaactgccatgggacttatattgcactgattttgacagttgagggacgaaaatcggactcgttcataagttaagggacctcagatgaactttttccattcagtcttggggagtctaggggattatcggagtatatgggcctgtgaggtcacgtgctctggtgggcttttttctttttcaaaatgggcctgcgtaaggtttattgatttcatttcggccttttactaatttatgcccaacccaaaactttgtatgggtttcttttagatataagttcagttcaggtcccttagtttgtctatgaattcgattttcatctttgaacccaaaaaatagatatgatgggcccctcaactattaaaaccggtgcaacattagtctgaaggcactatagatggttgttttgtcctatgtcgcacttggactatggtcagcctacatggagcgccacataagcggtcaactctggtcaaacgcactttagaccaactatggttcactaaaacaagatcatcgatcttaatacgtaattgataagtctacggacctatatgatacatatgctcaagtttaagtatcgaccatgtattttactcttaaaattatttccataatcatgcaccagttaggaaaagcttcaacaagcaagcaagccgaacgtatatgcgccgtattttggacaggggagtcaaatcaaccacatcaccatgcatatttctacatatacactggtcattttttttgggtacatcggaaatcattttcaccggatttagcccagacaaccagtatcccaatgagtgattaattacttgtattatactcattgttgccttgttggctctttgaggtcagaaagggacaattgaaaggcctcgattgaacaaacgttaggacatgatgcgcttctatataaattcaaggaacaaaaaagcaagctaattaaggttttgtgttctgcataattaatccattaagtatagtgagatctgaggtgaggagaggattaattaagacaaaatctagccaaacttgtgtgaatctccctctaatccatatgcatgatcccccccctcttgctttgcaaatactgtgagcttaattaattccatgtctctctctaattctgcttttgatgttgcaagttgcaagaagcttcacctctcctagggtttatacaagcagcggcatggacgactcgagcctcttcttgcattgggcggtgagcacgctgcagcaccagcacccggcggccgtcgcagtcgtggccgacgacgacgccacgttcttctcgttccaggagctctgcgacaccgaggaggtggttgttgtcccggtccaggaagaagtgatcacggaagcgcatggtggtggagccagcagaatcggcctcgccgtggccgtggatgagcacggaggctggtcaaggtccccgaatccgggggccagggccgccgtctggtggatgcggcagcaataatctgcccctgatgagctgggacttcagcgccgcctcggtggcggtgcaggtgcagccgaacggcggcggcggtggcggcgcgccggagatggcgtacgggtcaccgccggcggccgggggatccaccaccaggaagacctcggcgcccacggtggggcggcggcggcgtacgcgcagctggagcacgtcgtcgcggagcggaagcggcgggagaagatcaaccagcggttcatggagctctccgccgtcatccccaagctcaagaaggtataaaaaatctcaccaattcctcaacatgaaatgctccgatcgaatttgctttcgtctcgtgatcgatttgatgatcagatggacaaggcgacgatcctctccgacgcggcgagctacatcagggagctgcaagagaagctcaaggcgctagaggagcaggctgctgccagggtcaccgaggcagcaatggcgacaccgtcgccggcgagggcgatgaaccaccttccagttccgccggagatcgaggtgcggtgctcgccgacgaacaacgttgtgatggtgaggatccattgcgagaacggcgagggggtgatcgtgaggatcctcgccgaggtcgaggagatccacctcagaatcatcaacgccaatgtcatgccatttctggatcagggcgccacgatgatcataacgatcgctgcaaaggcaagttcttcattattatattaattacgagtaattaatatatattacttgtgagtaatattttatgttatctgtacactatctcgtgtgtctttccaaaaacagattagtgaatgctttaatcggtcacatccgtcacgcataacgtcactgctgatgatgctcttatatggtaccatatggtatattatgcatctcatgtgagtcatgttgtttttggcatttgttttgggttttggttaacaacactcaagagatcaatggaatatctagctgttagattcgcaccacggttcatgcatcactagcctctagcatcattaataggtgtacagataatcttatctgtaacataaagtattagtactagctaagtagctatatatatcgatagatctgtaatcatggtgatatttagaaatcaatcggtctgaggttaaagttcaagatttagagcaagatcgattcgagaaggcgccattgcaacaatatggctattagaaatgagagaaatagcgttatccaagatgagagagagggagatagcgctgagctgagcttaattaattaggagaggtggcatggtgacctttttttttttcggacacggatgtgtaattcaatcaatggcaagatgaatttgtgttttttgagatgttggagcacattttagccattatggactccttgtggaatgcaacagtttgccatgaatttcactgaaatttttgcataagtttcacaataaatagtgcattttgctcaggactattttttttttagaaaaaaactcacattctaaagaagccaaaagataggtgcggacttgctgcatcttccatatataacatcttattgaaatgtgtagagctatattacttttttgtaagttaattccttgcggaagaacattgtcaagtgtcaacaactcaacatatactgtttccgtttttcttgaagagacatactgcttgcatttattgtcttatgtgtatattatcatcttaaaagtgtttacaccacttatttggaacaaatggttgataaattaaggaattttgtaggacttttcctatttgatcctatggaacaaagctagtatcagggttagtttttagaatcttatgaaattcccaacccagttatataattgatcaatacgtaggaatcttagagggaagtgtgagatccaacctcatggaatttactttggtctgtattttcctatactttctttttgtctatttctacattttttttctatgctttgcaatccctttttgtgcacatggccacatgtattcatgctaaatcccaacattttccctatatattattgtgttaattcctacattacaaaggagaaatctttgaaagagctggagcaatttcacctaaattcttacattccaaagagttgggtcctagcttttaaggttgagagtaaattaatggagttctaacatttctactcttttatgagtaatttattgatgagttcaatattgtaaatcttatttctatttgacataccactagctataggtaggagaggaaatatctactgtggaaaaatcgtgtgctaaaacaaaaacaatcatacatatatataattcaaaaattaccccttttttaaaaagaaaactttgtacttagttctctgaaatgaaattgctcagaataaatcattcttttcatataatcattctttctcatatataaactccataaatattttaggtagaggaaggcttcacagtcaaggcagaggagattgtaggcaggcttaactcagctttatacaaacaagacgtcagcactgctattgaggaaaacagaaactaaaattcgtactccctccgatttaagatgtaagttgttttagctttctcaacttccccaaaatgcaagtcattttaaacttctttgcatttttcatcttaatttccttttgattattcatccttgtgaaaaaaaatgactattctttcccaataatgcagtatacgtatgaagagcaagaagtcatttgaactatatatcgcacaagtttaaaatgacttgaacttgaaatcagatggagaacgctatatagtacatctacatcaggggttaattaatatatactaccttcgtttcaggttaaaagactttataacactactcacattcatatatatattaatgaatctagtcacacatatatatctaaattcattaacatatatatatgaatgtgggcaatgctagaaaatcttataatatgaaacggaggaagtacgtatgtatagacttcctatacgcggtatacatatgcacgtgaaaatacacatatgcttggatacaatggagcttgtacttggacggtcatggtatatatatttgatgggtcgtctttggaacggatgcatcccagttgcacgtacatatattcataaaagattgcaaatttgcggcatgagaatcggtacgatcggtcgacatgcaaattttaacttggccagcttaattgggcatcatcaactcacatatttggtgtgcaaataatacaattgttagttaattattgcatcttactagtaccatgcaaaaagaaaaatgatgacatattgattgatgtgctacatctcttgcaagttgcaatgtgctcgcatccatcgggatcgacttaatttcctgcaataaataaagatcaaattgtgttaatcaaatccttaatttgctgatgtattgacatgcagatctttactttgattatataatcgacaactccaggtggccggggtactaacgtactataggaaaaaataattttaggaaaaattacaaattaccccgtgaaccattgggtgagtacgaattgttggaaatttggtcataattcggcatattttaatccaaaatattaagacaataaacatgacatttgcaatatgagtagatctagtgatagtgctagatgtatacaacttgagtatgcttaatatgaaataagcatcaacatttacatagtaacgcaatgctgccattgcgaagagtattaacaaagaaacatctaatagaatcgggagaatgaaagtataccccgagaacgtcccaccgctggattttgaggcagtattgcctccgttgatgtcgttcatcttcttctctccaatctccattgacatcttggtgaaggtaccgatgcagtagcagtagccgcgaagaacaagagcagtcgcgtttgaagcgctacccaaaaacttgatcgcccacctacccgtgcaacttctcaagcggacggagttccggagggacctgctcatcccgtacaactgtgcgcgcaggtgaacagaaccggggaaggattctgcagctcaggaacagaggaggaggaactcgaagtgcaagagtcgtgaagaacttcgttcgtccttctggttgctgtggagtatatatatgcgagcgcgagagtaacgttcggagtcatcaaccgcggtgtttaatttcgtaaccgacgtgctcgttaatacggaatcaattcacggcgtttaattccgtatccgacggaatcaattcatgacgtttaattccgtaaccgacgtgtttattgatacgaaatcaattctccgtgtttattaccgtccgttacaaaacgagagagtgcagcagcagctgctgtctgcctcgcctcgcctcgccccgcctggttgtttgcgcaccatctcaaccggtcaacagagactctccactagctccgtatttaagttgagacctcttcacttagatttccaaggtggtattattacccatagcacttaatgtgggccaatggaatttattaggatttaattgggcctagcccattaatctaacaatccccaccaaatttcatggctcacaggaaatgttctcgattctgatcctgtttgttataccagtgtttcggtgaagactgttaagttgaacttccacctaggaaaagagctacaccagatcacaactgaacaatggactatgccttgaattgtcagtcttgtgcgattcaggtttcactcaaacccttaactggtactaggctgccgtttacatcccctctgtttggagcatataagtcatactcctggccttttcatgagtatctagagatcacctagatctcatagactgtgactagcagtcgaactcatataggtgtgttccctctaagatgttctgtaggccaatatctctgctttatgaaaagccactcggatcacattaaggtgtataccatcctaccatacagattagaagagaagtgcatcatgaagataagcccattttagggtctcttctctcagttacacaatagtttgtttcaccatccaaattcatgggatctccgatcacaatggataggtttccaccattgtgcaactctaagtgggtctcaagcccatctcccttgatgcacagtctatcacattacgtggtagccccttggtaaactgatctgccagatttttagccgtctggacatagtccaatgctatcactccggagtttttctgctttctgacagacttcagtcttcttttaacatgcctggatgacttcatgttgtccctcgaactgttcactttaataatcacactgtttgattatcacagttcatcatgattgctggtactggtttttcaaccaccggcaagtccataaggagctcacgaagccattcgtcctcaactgtggcagtatctaaagctgtgagctctgcttccattgttgacctcgttaagatggtctgcttgcaagacttccaggaaacagcgccacctccaagtgtgaacacatatccacttgtggcctttatctcatcagcatcagatatccagtttgaatcactatagccctccagcacttttgggtacccggcgtagtgaattccatagctcattgtcccttttagatagtgcattactctttcaagagcatgccaatgatcatctcccggatttgaaacaaatcggctcaacttgctcatagcaaatgagatgtcaggcctcgttgcactagctaagtacatcaatgaaccaatgatctgggagtatctcaattgatcccttgctattcttcggtttttccttaatagcacactaggatcataaggagtaggagctgccttgcagtcactataacaaaagcgactcaagaccttgttcacatagtgatattgcacaaatgtaatcccaccctcatctcctctcagtagtttaatgttaagaataacatcagccactcccaaatccttcatttcaaagcttttggacagaaagtccttgacctcctcaatcacattgaggctggtcccaaagatcaatatgtcatcgacatataaacacaagatcactccctctcccccaccatagcaatagtacacacatttgtcagcttcgttcacaacaaagccagcagatgtaagtgtattgtcaaacttctcatgccattgcttaggcgcttgtttgagaccatacaaggacttcaacagcttgcacaccattccctcctgaccttctagtacatacccatctggttgatccatatagatctcctcctccaactctccattgaggaaagctgtcttaacatccatctgatggacgagtagaccatgagaggctgccagagcgagtagtactcgaatcgtggtcaagcgtgcaaccgatgaataagtatcgaaaaaatcctcgtcttctttttgggtataacccttggccacaagccttgccttgtacttttcaattgtaccataaggcctaagttttttcttgaaaacccatttgcatcctataggcttgcacccatatcgacgctcgatgacttcccaagtaccattagatgtaattgagtccatctcactgcgtaccgcttccttccaatagtcagcgtcaggagatgaatatgcctcttcaatggtttttagagtatcatccacaagatatacaatgtagtcatctccaaaagactttgcagtcctttgtctcttactctttcgagttgctacaatgttatcctcctcaggattttcctcaagcgtttgatcaatgtgttctatcggcacaaagtgctcaggggataaaataggttcttgactagaagtgctaggtgcatttttcataggaaattcattttcaaaaaatgtggcatctctagactcagtaattgtaccaacacgcatgtcgggtactccagaattaactattaagaacctatatcccatactgtggatagcataaccaaggaacacacaatctacggtctttggtcctagtttacgctttttggctataggtacatttaccttggccaaacagccccatgtgcgcaggtgagagagatttaatttcttcctttcccattcctcgaatggtgttactttcttatgcttagtaggaattatattcaggacatgacacgcagtcaatattgcctcaccccaccattccttggaaagtccagcactgtctaacatggcattcaccatctcagttagagtgcggttctttctttcggctaccccatttgactggggtgaatagggatgcgtcctctcatgaataattccatactcttcgcagaaagaagtaaactcattggaaaaatactctccacccctatcaaaccttaaccgtttgattttcctttccagttggttttctacctcagccttatagatcttaaagtaatgtaatgcttcatcctttgttttcaataggtacacatagcagaatctagtgcaatcatctatcagtgtcatgaaatatttctttccccctttagtcaacacgccgttcatttcgcacagatcggaatgaacaagttctagtggtgccaaattcctcgcctcagatgccttgtgaggcttgcgaggttgtttcgattgaacacaagtatggcacttagagcctttgactaaagtgaattttggaattaaactcatgttggctaagcgtgtcatacaaccaaaattcacatgacaaagtcgcgaatgccacacattggactcatcatcatcatcgcttacatggttcacaactttattacacatatcatccaaggaaaagcgaaacaaacctccactgtcataaccttttccaataaacgttccatatttagatacgacacatttattggattcaaacacaagtctaaaaccatctcacacagtagagagccgctaactagattcttctttattgaagggacatgctgcacgttctttagctgcacgatctttcgtgaagtaaacttcagatcgaccgtaccaacaccatgaacagccgcaagcgatccgtttcccatcaacaaagaggaacctctcccgacttgataagaagaaaatagggaaatgtccacacacacatgaatattagcaccagtatcaactcaccaatcaggtgagtgacagacagagagaactgtaggtaaaaatttaccataccccaatgttcctccaccctcactaataaccatgtttgcagacttcttgtccttgcgctcaggacaatccttggcccaatgcctaggcttgcacacacaaagcaatctcctttttcctttcccttgcttttcttcttaaaattggttgtagcctttgggttttacgtcaggtttgactttcttgttgttgttcttctgcaccaaattggcgctagaacctccctcgatctttttgccccagttgtcctttgccctcgcctctcctcaatacccaaagagccaatgagatcagtaacactgaactcttgcctcttgtgttttagagaagtagcaaagtccgaccaagaaggtggcaatttggcaataatgcctccaaccacaaacttgtccggcaactcgcagttgttgttctcaagttcctttaccagcatctgaatctcatgagcctgttccactatagagcggtcatcgaccatcttgtagtcatagaactgctccatgacatacagctcgctgccggcgtcggaaaccccgaacttggcctcaagagcaccccacatgtccttccctgaaggtatgtgcatatacacatctataatattatcggagagcacactgatcaatgctccacggaacaagcaatccgtagcctcgaacttagcctcctcctcaggagagagaggcggttcactcggtttgccccgtgagacaaagaaataatgcatcaccgtcaaccaaaaaagtgcatgtgctttccatcttttataatttgaaccatcgaaagcatgtggttttagtgatgcaacaaagccaactaccgaaaaagacctatcaagtttttggactgttggaaatttggtcataattcagcatattttaatccaaaatattaagacaataaacatgacatttgcaatatga

SEQ ID NO: 60737 - DNA, 16373 bp, Oryza sativa
  unsure (1)..(16373): unsure at all n locations
ccgctggattttgaggcagtattgcctccgttgatgttgttcatcttcttgtctccaatctccgttgacatcttggtgaaggtgccgatgcagtagcagtagccgcgaagaacaagagcagtcgcgcttgaagcgctacccaaaaacttgatcgcccacctacccgtgcaagttctcaagcggacggagttccggaggcacctgctcatcccgtacatctgtgcgcgcaggtgaacagaaccggggaaggattctgcagctcaggaacagaggaggaggaactcgaagtgcaagagtcgtgaagaacttcgttcgtccttctggtcgctgcggagtatatatatgcgagggcgacagtaacgttcggagtcatcaaccgcggtgtttaatttcgtaaccgacgcgctcgttaatacggaatcaattcacggcgtttaattccgtaaccgacggaatcaattcacgacgtttaattccgtaactgacggaatcaattcacgatgtttaattccgtaaccgacgtgtttattgatacgaaatcaattctccgtgtttattaccgtccgttacaaaacgagagagtacagcagcagctgctgtgtgcctcgcctcgcctcgcccctactggttgtccgcgcaccatctcaaccggtcaacagagactctccactacctcctgatttaatttgagacctcttgacttagattgacaaggtggtattatacccatagcacttaatgtgggcggagctcggggcggcgataggagggggccgtggagggtggagctcggggagcttggggccgagggggctgcagagctcggggcagcggaggacggagctcgaggaggtggagggggcgcccgcagtcgctgacactcgggacgacggcgggcggagcttggggccgagggggtggcacgaggagggggcgccggagctcggggcggcgggaggctgggacggcggagggcagagctcggggaacttggggctgaggggactacggagctcggggcggcggaggacggaactcgaggcggcggagggggcgttcgcagccaccggtgttctggatgaaggcgagcggagcttggggccggggggcggcacgaggagggggtgtcggagctcggggctgtgggaggaggggacggcggagggcggagctcagggcggcggagaggtgcccatagccgtcggcgcgcggctcgtcgaggcagcggacgggacgcccgcagctagcgatgctcggggaggtggaggggcggtagagcgagctgaggatggcggcgggcggagctcgggctatggaggaagcgcccgcagccaccgccgcgcagctcgtcgaggcgatggagggggcgtccgccgcgacgctgccgtgcctcagcgccctagcccgtccccctctcctctgcgctccggagccgacgggcaaggaagccctcccaccgggggcacctccttgccgcttctgcggccacgatggctgctctcatccattgtcgtcgaggacaggaaaaggggaggtggaggaaaagacggcatcagaaaaaggggcagtgccgccgctggggagaggaggaggagaggagtgacagccaggggagaggaaggaggaggaggaggggcggcgctaccggtataggaggaggagggggagtggcggtacgggagagggaggaggaggagggacagcgccgtcgggagagtagtagtgcgtctgcgtgtgagtaagagatgcggaggagagagaggaggagagagagagagaaatgttgtagcgattgtgcgattgaacggtgttgagtggataagagcaggcacaatagcagactataaaccagctacaaacacatatcgagaagataaaaaatgagagagaagagcagtaggctacagatttgtaattagctgcagcacggactccaagacacaatgtgtgtatgacagttgggaccatgtattaatagtgtacatatgtttataggtaactattgtatgaattgggtattaagttgactatagatgatttggagctagtaattggctatactattaaacttgctctaaggatagatgcctgccagccctctctttggccggcttggtttttttatatatgtaccagttttttaaaatattatagatattggtttttaattaactggtacctataatatattatatgtgccggttcttttaaaaacaagtacctattgtattagtaccggttttttctctaaaatcggcaccgatagtgctcaaaggtgttggttctattttttttcatcgcacgaagatgggaaagggtccaatgaattggcatttataaatgagtgtcaaattattatggcaaataaagttcatataattcgattgaacatagagcacgatcgaattattgctatagctacttttctttccaaaaagaagttcatcgaattgtattattgcatactttttcatcacactaaaaggcgctcaatgatctgaatctgaactcgatagtttaattagtttattagtggtgaagagacaagatttatttgactgcgattatttcctaacctctcataatataataagacctgtgagccaaaattgcgttgtcctttgcattggacgcagttgctaacaacagacacccttcttttcagacgttttctgctgacaggaacggctcaaataattgttacctaaagttaataaagataatggggttcgtatatatatggttttgcagatgtgtgccttgcggctacattggattcgtcaagctgtcctttaattttaaaagtacaggggggatcgagttccaaatgacgtattaattaattaaataatgcaatgagtaccatagaattcaacaagctttctaggagtatgtactactagtatgcaatgtatgggatcgatatagtacttctttttatgaaaaaaattgcatccatatatatgtcggcaatctctcctttttaggttaaaatctactgtgctgcacaaagttacctagatttcatgcagacctgccattatatatttttagggccctttgaatcacatgtataaaaaacggaggaatagaaaaaacacagaattttgacaggaattgaagtgtgaaacagaggattgaaaaacacaggaaaaacacaggaatggtcgtttgattggagcgcaggaaaaacgcaggaatcggatgagagagataaactcaaaggaaattttccaagaggttggagctcttgctaaatttcctccaaaatccacatgcaatgtgccattccataggaatttcataggatttgaaaagcttcaatcctttgaattaaatggccaaataggaaaattttttataggatttgaatcctatgaaattgctatataaatcctttgattcaaaggggcccagactctttatctctcctctaattcctgtgtttttcctatggtccaatcaaacggctattcctgtgtttttcctgtgttttgcaattctctgttttacacttgtattcatatcaaaatcctatatttttcctattcctatgttttctcattcctgcgattcaaaggagcctaaaaccggtaaaccggtctgctgcatgttcagttcaaagcatgacagacaatatatgtgtgtgtgcagcgcagatcgggcaccactgtcctagtgtctgatatgtacttgaacgtggaataatgtacagttgttacaacttaattttaacgcatattcaactggcatttgcatgctcggtttgtggaaaagcttaggtaagctagagaagagaccagaggaatcgacatatatatgcatccacgggctaaccgataagaatgttaatttcagtaatagtataatttggaatgaaaaaaaaatcctgaatataggcatgttaataattgataccaaataaacactcaatttcagtagtatagcttagaatatttgatataactgatgcaaggcagcaagctgggttagactacaggaaacaatcgcttcaataaaatatgtcattagttggtgttggttcgtaaaagtgcggttatcgaatcggcaccaatcttgatgaggtgttgttgggggagggggacgtcattagtgccggtttaagaactagcactgatgtgcccacacgagtcaaaaaaataaaaagggatgcttccctcctccaagaatcggctcagccggcctttggaggtccataacggtaatcaatttccatcaccatccaagaacagataaaagaaaatctaataagtcacccgatcaattttcatcccaagaatatatcaagaacacaatattgatcctcattccaagaacaaataacactagaaccaattggattgaacttgatcaaccaataaatatcacaatacacacatcaagaactcttgtagctagtctgttcacaaatcaacagctcatacaaaactcatcgacgcgactatcgttgtcatcaagccacgaccgtcgttgatctggggttgccaaatctagggtcaccagatccacctcctctagcatggtcgtcgtcatcttctgtccgaaggggggggggggggaggctgccgctctttcccttgccattgcccacccaccaaatctcttgcccctcatctccagacgatgagaacacaggagagcgaaggaggagacagaagcgacaccggggcaacgacaatggggcgaagccaggattggacgaagggaaggcgacttggagatgagtgtcgtcagcttctgagctgcaatgagcgtgttgccatccgagctatgaaccgcatgcgcccttactacagccagccgaatccatcagtggtaaggctgggatcggcagatccgacatccttggcctcctcagtagcgaatgcggtagtggcagtggaatgcccggagtaggataagacgaagagcacagttaggagtgcaaagggtgatgccactggtggagaaatgctttttagtcacggttcgcaaccctctgtagtaatccgggactaaagatcgctatctttagtcccggttcaaatacccgggactaaaaatagatctttagtcctggttagtaacaccaaccgggattaaagagagggttgcggcagtgagatgatcccctttttcttttttttttcttttttatttctcccaaatcaagtgggatacatatcccaaatcaaacccccaatccacaaatcgaagtaacatcaaaaatcaaagttacttatacacacaaataaatacatcacaaatcaaatacatcacaatatcctaagaaattactcaaatacatcacagatccaaacaatgaatcacaaatttgtaacttctcagtcaaatacatctcagtgaatcatcacaaattagaaaaaaaaagaatgccgctgccgccgctggtcgccacgaacgacgggcgcggccccactggccgtcgggcacggccccgccgcccgccgccgggcgcggccccgccgcccgccgcccgccaccctccgcggccacagccccgccgcccgccacgcccgccgccgtgcgcggccccgccgcccgccgccctccgccgggcgccaccccgccggccgccgccggccaccgtagtgcgcgtccccgccactggccggcccgctggatgggaaggggaggccggccgggaaggagagagaagggggaggagaggaggaaggggaggagttagagaagagagttagaaaggatagatctgaggagagggggtgagtttcgatctgttaagttgtaactgtggaggagaggataagggatagggattgtggaggagaggataagggatagggattatatactacgtgtttaattttagtcccggttggtactatccaacctggactaaagacccggttggtagtacctggctggtagtacctaccgtgattaaagtggtgatctttagtcccggttattgacaccaaccgggactaaagatccttggccccctgacatacatctgacaggggatgaaccgaccaaccaggactaaagatcaaaatttttataaccgggactaaaaacaatctttactcccggttctttttggatccgggactattgtggattttaccggaccgatcaaagatggtttctccacgagtgtgcggttgagagaactagaggggagggggacaggaaagggcgatgtagtggagcctagcgtgttgaccgtgggatcagctgcaattgagagatttttatttccttcggttcagctcacctcgccttgcctcaaaaccagtttggctcaaccggttttttatgtggttcaactaaaaatccgacaccaatacttatttttctatacaattcatctaaacaaccgatgctaaataatacatcagtattggttcatttaaattaggaaccctacactgatgaccgtcacttgtgcgaggttttccactctcgggatgcgcacaggttcggatggcagaaaatctcatattagtgtcaggttttaactaaccgatacgatgctgatgtggtgttccgtagtagtgaataaaagtagagtaaattgagtagaatacttgatataacagtggcgatgatcactgtatcctcacgctgctatgtagacgaattgaattgaagaagatgtcaagccaaccgattgttacataagaatagtgagtagagatatgtgaagatgacggtgaatgtaactaggatacgggaaattattctaaactcgaggtgacatcccctcgttgtttgcatgtcatttaaatagttacaaaacaattgaaaaaaatcaacaagataaattaatgtgataaatatttaacatctacaagtttcaatgaaaaaacaaatttgaatatacgtcacaaacaaaaatgtgatcgaaaaaataaatagtagttccatgctattcataatattaatattaatatttaacatctatcattgcccacattcatataatattaatgaatctagacacatattatatgaatatgggcaatgctagaaagtcttacattatgaaacggaggaagtatataatatctatattcaagtatgtgcattgaacagcccagctctatctatacgtgccgaaggcccaaatatagcactttgacccaattaacttacaagtcaacaatagtacatgtactgcatgcacctgtaggggcggatccaacgtgggtgcaggggagactcacccacaaaacccatggatacccccagagcaccccttcggtttttcaccatgaatgataaactaaaagtctctaaatggctggaggttgaaaaaactgtgtaattgagccctcccagttttttttcctagatccgcccctgcacctggccgtttctctcatatgggcaaatgagaaaaacgagcgagagagagagagaagagaaaacacaaataaaaaggagactgaacgctccatgcttacgcgaacgaggctctgcatgcagcattaatgcagtcgtctttatattgacatgaatttgatataaaaaggagaccgaattaaccgtgctccatgctagcaacatcaccctctctagatctgattaatttggtaagactcatgggtcatgtcaatgagcatatatcgttccttattaattaatgtgtgaccatcatattgtgaagtagcttatttgaagcatggatttgacatgattttataggaatcatgtactatgttgttttacgaagaaaatctcatgctcaaatgggattatttttcacgaacacgcaaaaagattacataatcaatatgtgctcaaatgggatcatttttcacgcatgcgtaaaaagattacacatacattaatatatattagaagaaggagaattcgattacacactgtagctagccagagagccattgtccggggacagggagaaaaaaaaacaaactaaaagacgtcaatatatggtcaaatgggatcatatatttcttgtctatgaaatgcgtttgacatttcgcctcggtcactagatcatgactaggtgatctgattccagctcagcattagtgtgattcttgaccatcgatgccaactcagttcaatccgtcatagataggccgttaagactggaccgatctggtgttttcgaaattaaaacacccccctgctaactatgatacaacgttgatctttttttttttacatttcttcccaaactgaaaaaatatctgtgcgttgcaatgggtgaaggttattttaatattattatagttatacggtttagttaagatgaaatttactctgagaattcgcttggatatatattttttaaaaaaatcataagctgtaattagtagtccgatcatgttaagttagcatgcgagtatttttaaagaaatatcttatacgactccatctgtatttccaaaagtgaacgaacttaaaaccccgtctcaaatatgaatctgtatttacaaaagcaaataaatttaaaaaccgatttatacacagatgacgtaccaaaatactgataaaaacatcttcgatcaatttttataacagtattgattaataagtccactctttgttatttattgccaacccaaaacttcgttgatctgtattctgacaataattttgctatgacccattccatgcatggtttgggtgggccgtaggtattatattctaatacaaaggctactgcattctagatgtcggaaagtctaatgcgcgatggatcgctaccgagatcgctctcggtagcgatcaccacctctccccctccctccctccacgttttcttttttggcaccgcattacttttctattttagtaaatttatgtacctaaagtttatacacctaaagtttatagatccaaaatttataaatcaaaagtttatatatccgattcaaatttaaatttgaattcaaatattttttatagtatttctatacatctaaaatttatagacctaaagtttataagtcaaaagtttatatacccgtttcaaatttgaattatatccaattcaaatttaaatttgaattcaaatattttctatatatagtatttctatacatctaaagtttatacacctaaagtttatagatccaaaatttataagtcaaaagtttacatacccgatttaaatttgaatttgaattcaaatattttctatatatagtatttctatacatctaaagtttatagacccaaagtttataagtcaaaagtttatataaccgattcaaatttgaatttgaattcaaattttttatatatagtatttctatacataaatttttctaactttttgtttttaaatttttttttgtgtggtttaagaaggggaggagggaagagagggggagtagggggacggacgggcgcccaatatatatatatatatatatatatatatatatatatatatatatatatatatatatatatatatatatatatatatatatatatggccgtgtttagttcaccctcaactacctcaaacttctaactttctatacatcacatcacatttaaaacttttctacatatataaacttccaactttttctaaactttcaacttttttcaggaactaaacacaacctatatatggaactgtcaagaataggcacaacttgtcttgtccttgtccttgtcaatttgtcattaattgagattaatcactccatactgtacgacgataataactcctccatctgttccaataagcatttaattttcttctatcaaaatacttgtcatagatactcatattttattatttttagagagctaactttcccttcctaccatacaaccacaacaatactagttactccctccttccaaaaatctgagacctatttctttttcattaaaactaagaagtaattaactcactcaccatgtggcaaaaccaataaacatacaaccaataagtactagaatactttttggtttctgatcaaccatttaatttagcacatagtgattacaaataggacttagatttttggaaaaaccaaagaatgaaataggtctcagatttttggaaggagggagtacttcacacgaggtttttgtacttgttttaacaagaaaaataattaggacataattaatcaaggtaactgtatatgtaatttgtccttttttgttagaattataagtaaattgaaacagggaagactatgctccatatgtcaatgcaaaagcacagcatgtgccatgagaccatagtacaaaaaaacggtatcgggccggcggttgagctggaaaaaaccggaaccggcgactttggtggcttggttaaaaaaaaagaccgcccctgcaatcaaacaagtaaaaaaccagtgaaccgggcggttttatgggagccggtgaaccggtagttgttttttaataatcgaactggtttaaaatttatcctcgcagtatggcattatgaatttattatgttacaacgctatatttttttatgttgtggcgatataataatagatatactagtttatttatacatattttcactaatttgtgatgattatatatttaaaataatgcaaatcaaatataatattaataaataaaaaaccggtggttcgaccggtgaaccggtgaaccgacgactagagcgggttgacctccggtccggcttttttactatgcatgagactgaataagtacggctcagtgccgcctaccatttcgtcattaatatattttctctcgaatcaaatccatattgtttggccggaagttggcacttctattactaaaaaaagaatagaatccagtatatttttagtacgtatttcattcaagcgtcgccaaacgttggttcagccagccaatcaatcaagattatccattttgaataaattagttcatggcgagattcaccatctagtttagtaaaccaagctgaatgattgtagtggcctctgctctaattggcaggatttgctccgatctgctgactgataagtacgtacgtgctacgactttgcctccagcttttgatcagcttcacactaataatacgtcatcgttccgtttcaaaataaacaaattgatcttattgatatgctccctccgtttctaaatatttgacgccgttgactttttaaaatatatttgaccattcatcttatttaaaagtttaagcaattattaattttttcatatcatttgattcattattagatatacttatatgcatatatatagttttacatatttcacaaaagttttgaataagacgaacggtcaaacatgctaaaaagtcaacggtgttaaatatttagaaacggactagatttatttattttaatatgagggaagtacgaataattcacgataacatgccaagaactcctcaatgcaaaacggcacatacgtacaaattccttgcacacgagaacttgttaggaattttttttatttataattttttttattaaaagttttacaaaaataattttccattttgaaaattgacggaaatagtcgcctaccgccctctgggagggcgattnttcaaatcgccctcccagagggcggcgaaaatgacgtggcagacggccgttcgctctcgggcgacggccgtcaacgaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaaaccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatgtacttacagtgaactggagcaaccaagccttgctaggcccgactgtagagtacagaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtcccccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccacatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaat

SEQ ID NO: 60738 - DNA, 21828 bp, Oryza sativa
  unsure (1)..(21828): unsure at all n locations
tcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagcaaagcatatctaattacaactgcggcaatgtgagagctgttccggttaggagtacagggattctccttgtgttgtgatgccgagcttgactagacgtgatcacaaatggacgaaacctactatagtactagtagtaggagcactacttctactctagctactcctcgagcccagttattccatccatcggattccttccacagataggcagaaactagcaagcctataagttttttctttctttttttttctgaaataattacagaaggccctaataaaaaaaactaattataaaatccgttgttaaaacagcgagacgaatttattaagcctaattaattcatcattagcaaatatttactgaagcaccatatcgttaaatcatagagtaactaacctatatttaatattttatgtgagtgtttaaacgtttgatgtgacatattgtaaaattttagcgtgagaactaaacagaactaaacagggcctataatacttcctaagtactgtactaccagcttaatactccgagaaagacgtttatcaatgtttgaagtactattactgtactagctgcggcaaggggtggtgttcagcttataatacttcttactttacttcggctgtttctagttaagcgtaaaatttagattttgtttgaaattgaaaatgatgtgacttaaaagttatgtgtgtatgataggttgatgtaatggcaaaggactaaagtttggatctaaactttagatctaaacacagccttcctctgtctgctagtagtgtagtattgactttgtcccaaaatatatttttaagttttgactgatatacagttatccagatttataatcagaaatgtttatatttatatttttgacggttgaagcagttgtgaactgatcgttacaaagtctcatttattctaaaataagctaatttttgagtaattattatatctaaatttacgaaagtagtagaatatatagatatactgggagtagataaaataaataataatggtactggaatttaataaggtagaggtactcttttcaatttttttattggtgcaagagaaaaataaacttactttaaaaaataaacggcttcagtactgagatttaataaagtagagctatcatactatttttaatttcatattggtgcgagagaaaaataaacttactttaaaaataaacgaagtcagtactgtatatattttttttactacctccgttttaaaattatgttcatctttcaaccatctcacatataccaatacaaaagagcctcgtcgattacttatattccctaataaatcaaaacaattcattagagaataaaaattaatttatagataaaaattttatatatttgttcgtaacgatttaaaagccaattgaaaaaggaaattacgttgaaaacatctttgcatcaactttaaaatcaagttcgaaaattcaaattttagttttttcttggcttattaggctatctcatggggctctagaatatccatgctttatcaaatctcaatgtaactactttttatttttatcttttctcaatacaataattccttacttttatatactttgatgtaatgtttactccaaaaataaatttattaacttttgtatatattttttttataaaaacatacccgtttagggtgtgtttagttcctaaaaaaagttgaaagtgtgaagaaagttgggagtttggataaaaaagttggaggtttatgtgtgtagaaaaattttgatataatatgatgtgatggaaagttggaaataggagagaaactaaacacggcctttagtagtttgaaaaacatgcaagtgtaaaaggagcgaagtgttcattcaaaacttttctacttacataaactcctaattttttttctaaactaccaactttctccaaacttctccccaaattcagaaactaaacacagcctaaagttggataaaaaaacctatagtcgctcttaaaatgggacaaaagagtacttcctccgtcccaaaaaaagacaaaccttggtttccgtgtccaacgtttgactgtccgtcttatttgaaaaaattatgaaaaaaaataaaaagacaagtcacgcataaaatattatgttttatcatctaacaataataaaaatatgaattataaaaaaattttatataagacggataatcaaagttggatacggaaacccagggtttatttttatttttattttttttgacggagggagtatggctagtgctactacccctattaattatgcaatgtggagttagctactagctctagtgtagggagacaagatttgcatcgctagtctagattttagatagatcgagtattatatatggtgatgcatgggtgtttgaccataaaaaactaattacagaatccgtcggtaaacagcaagataaatttattaggtctaattaatctgttattagcaaatatttactatagcactacattgttaaatcataaagtaattaggattaaaagattcgtgtcccaaattagttaatctgtgcaattatttttttttctatattaaatcttcatagttccgttgtcgtgtcacccggcgcaacacgccaccatgacctgtcctgtccaattgaaaggccttttccatagctgcttctgctgtagcagcagagcgaaagcagccagaggcccagagcttcagcttcagcctactactagtactctactactcccaactccatggccttcgttcgcctgcacgacggcacaaccaaaatgcgcagaaactcccaatactcctgctactgaacacaggaggggacattgcaagaaaattatactagccccagcatatactagcctgcacacaggagaggcagcagctgaagaaggaagcaaaacagtcaagcttttgcattgcaagcagccgattctgaattctgaaagctgtgattccttgcttgcaaggcagggagtcgcacacgggcaggcaggcagagagaggcagtggagagcgtgggtggctgcatcctgcaggcaggaggaggggaagcgttttgctccaaaaggaaagctgaaaaggcctttggcctcgcgctgtgcgtggccgtgttgatgttgagtagcgcccggccggcgggcgttcccctccaagctgcgcgccagtggacagtggtggccatggccattgcactactgtgcagcgatatggctgggcgctttaaagtaagtgcactgcactgcactgcgccgatgggctctttctttctgacctcctcggttgttctttacacgagcaagttgatagtatagccaaatactactaactccaaatcatttatagccaacgtaatagctaattcatacaatagttgtttactaaataattaatatctgatcctacttttcatacacatattacgtcttcaagttcgtgctgtagctaactacagatctatagcctgctgctcctctctctctttctttatctctttaaaatatatttatagctggcttatagcatgctattatacctgctctacagggcattttggttttcgatggcatgtaattttagtgcccttaatgaaaggattaaaatgttttatgtaatttaaggctgagttcttcaggtaactttcccaaattaattttctcatttttcgagtgcatattttttaaaatattaaatggtgcgatttctaaacaaaattatataaaagttgctttaaaatataactagcatagtggctagcgcatattacgcagctagcataatatattttctgtagtataatagcatatatgttttctcattatattattcaaatatattaaaatgacaacataattttaaattttgcaataactttacgaaactactaatgtgtaatattcatattgtattttatatacgtgttagttattaattatttttaatatcagattttagttatttgttatttatatatattcctatatggactatagactcgtcttttaatatttcttttttaaatttcgaattttctgtaaattgtatttctcttcttccaatattatttatttttatttatgaatttttattatttctaattatatttctatgtggactctaaactcatctttcaatattctttaatttttaattttgaatttcagttacttctaaattgtattcctatattgactttaaactcatcttcccatgtttttcttaattacgaattttagttatttgtaaattgtatttttatatggactctaaactctacttttaattttattatatttattccgaattttagttagttttaaattcctatatggactccatactctatttctaatattccttattttgtaattccgaatttctttttttcttaattgtagtctcctcttctaatattccttatttttaattccaaatttcaactatttcctaattgtatttctatatggactctagtctcctcttctaatattccttattttttagttccgaatttcaggtatttctaaattgtatttctatatggactctgttttttctttttctccgattaatgtgagaatttctatgctatgagagcgaacgtggaggctcctttttctattcctttaataatataatagatattaatttatttttaagttttttaagttaatagtacttaattcatcatatattaataaatcattacatatgctaattttactagaactctgtcaaaataagtgtacttattaagtacttttttaaagaacttggaaaatagattaaaatattaatgaaaaattacctttttgaccttatgatatactccctctgttttattttaagcgcactgtaactatgagttttttttttgtccaaatttgattgtccgttttatttgaaatttttttatgattagtattgtgttgttattagatgataaataagacgaaccattcagttagacatgaaaactaatgacgtcaattaaaatgagacaaatggagtactctatccgttaaaaaaaggcaacacctctcctagtacactgtcgctgtggaggtccttatatacgcacgtcccgtctcgtttggtccgatccggtgcggtgcgggtgcggtcacgtcgttggccagagggcctgtcccttctctcgggtcatctcagcgacgtcgccacctgcagtagcctccatggtaacctgtgcgtcgtcacgctacgcagatgctaccctcgctgccgtaaaaaatccgtcgatcgatcgccgagatgataccgatgatcgatgggaaaatgtgcctgataccgctggctcgctcgctgcgcggcgaaacagggatcccagcatgtgactcgccaagtcgagtcgccagggtgtagtcggtcaggccaattgcagagatcgatcgatcggttggtcagatacgttgtgccggactgccggtgtgtgtgactgcgcgtggttgtggtagatcggaagaattcaattcaacggtgcatagacacaaaagttccaacgagagaagacgagaacacaaaaggaattaaacataaactaaactttaatccatccaagttatatcggatgaatttgaagtattaaacgtagactacttattataaaactaattatataaatgagagctaattcacgtgacaaatcttttaagcataattaattcataatttgcgtatgtttactgtagcatcacatagcctaatcatggattaattaggctcaatagattcgtctcgcgaattagtgcagggttatagaatgggtttttattaataatctacgtttaatatttataattagtgttcaaacatccgatatgatagggactaaaaagttttattctcatctaagcaggaaagattttgggactgaaatttctccgtcgattggcagttgtgttctttttttaagtgtttccttcatctagaatgtagcaatttaagatgggatgagatacatccttagacaatatatctagatataccttatgtccaaatatattgtcctaagatcctagatgaaggtagtagttcctaactcactttctcgtctctcctgtgtacgtttcccaaattcttaaaaaatatttatatacgaaaattactttaaaaaaatcatattaatgtacttttttaaaaagaaaaaaagtttcttatattttgtaacaaggctagtagtactccgtggtatatgaccaattgttggtgtcctgcgccagagtgacgccccagagtaaattggaccggaatattgttgaggcccgaacagcaggcctagatttagttgggcccgacctggatagcgaggaatgaaccagcccagaactagtcggctaggtcgggatgcgatgggatcccgatgtacgtgttggacttggacccagcccaatactcccaatattcaagtttgaggcaggccactaatccgtcgcagcattcgagcccattttcgtttcgaatcaacgtatctgctttggttcacaggaaagatttaaatatccacgcatttcaaacgtgttaaaactaaaaggccatatgattttttttctcagtcctgcgaacacgcctacgaggttactagtgagtctatggtggcaacttattactcattttctgttagctaaacaaatacgctttcttattttttaaaaaactaaatagacccatttttatttgttataattgatatttaattaatcatatggtaattacttgcatcgtttctgtgccacgaaaaatccaactcactagggtgtgttattttcttccactctttagttttcactttttgattttctgcacacgcttcccaaatcgttaaattgtgtgttttttttaagaagaatatgaaagttcatttgaaagtatcatattaatatattatttgatctttttaatatttaattaatcatgcgttagtacctatttaggtttcgtgtgcctaggaaaatggtatccaaacccctcaaaataacacagcaaagtctgtgacccgcgtggtagatccagccatccaggaattttaacaatcgtgcacaaacattttataacaatagtaacaatctgtacgactgtaccttatttgcgcttgtaggtgtcaacggtcggtttggaaaaaaaaaaaacttccaacggccggaatccttcttccatctcctcatccaaatcccaacggtcatctctccgcccttccccccacttgtcccctagctccgccgcgataaagtcttgtagccgttggagatcaaaatcaccaagcaatcccatcccccgcggcgccccttcccccccaattctccgcctcgaattcaccctctctctctctctccccccgaatccacagatcgagatggctgcggcgacggcgaggtctccgtcccccggccccggcgcgaggccgggctgcgccgttaggaggagcgccgactccagccccgccgcctccccctgcggtaacgtctcgttttgatttgtttccggtttcgttttcgaacaagctttccgtttctgcggcgagcggatctgatctgatggtttcgtggtgattttgatcgagtcgtgtttttttttgtttttggttggatgcggcagatttggcggcgctgaggagctccgtggtgtgcaggaacgcgtcgccgcgggcgtcgtggtgcgcggagaaggagaacagcgggcagcgcgacgcggcggcgagggcggcggcggcgcccaagcccgctcgccccgcggccggcgccgcgaagaacttcatggcgccgaccatctccgcggcgtccaaggcctcgccaaggaagaaggtgctcggggagcgcaacgagcagcagcagctctaccccgtggcctcgtcccccgtcaagcccatggcgtccgaggcgggcgccccgcgacgcctccggctctcgttcgatggggcgcccaatactgccccacccgccgcatccacgccggtcaccgcggcggccggctccaggcactcgttcggcggggaggaggagcggagggtggagaatcccccgtgcaagaaccaccaccacgccacggccttcgacgacgctgcttccgcggaggcggaccagggtgcggctccgtacgatcccaggacgaactacctgtcgccgaggcctcggtttctgcactacaagcccaacccccgcatcgatctgtaccggcaaggcagcagcggtggcgtgaggcggctcgaggacgggttcgcctccgagagcagcgaggaaaccgtcaccaccaccaccaccaccagcagcgaggaggaggtggttcttgtagacgaagaacaacaagcgcatctgtcgtctgagctcggagatggcgccgctgttcccgcggctgatgcttgtgccctgccgctggagcctgcgtcgggttcaccgcgggctcgcgtgctgacgccagagccagcgacgcgttccccgcgcgctcgtgtccagacaccggagccggagcctacggcgagctccgagcgagctcgtcgtcccaggaagaggtcttccctgaggttcctggttgctccccttgcgctggtcgtgttcatggctgctgctctcatctgcgtgccgccgccgccggtggattctccggtcatgccgctaaccgccctgtcgaaggtgtcggactttctgtcagttcaagaattgcatcctgtggagttggctgcttggctgaagcaatggtcaagcagttcgttgaatctggtcacatcctactgggaatcccttgtttgggcgcaagagcaagagttctttggtccgcacttcgcagccaatttgagtgctgcaactgcaagtgcgcacgagggtgttgatctctactgcaactttgttgaaacaaggccagttctaatggaagatatcggtgccagtgcctttgagcaggattccaagatccaggaggctgtttcagcaagtgattctgagttgatttcagagatcagtgatgtggagcaagaagatatcactgataagggagatgtgatcgatgatgggttcttagcagaggagcttaatgttgagatgccggaagaagacgctgagatgtcacaagaagtttcaggtagcaatggtgaagagatggcatccttcagtcaggatctggagccctcccaacctgcaggagaagctgagccactagagaacattgaaactagcacttcttccttgaagcaggatgttcagactgatgattctgagggtgatcgtgctgccgacggagaggagagcccagaggcggatcatggaatgaagtcagaattggggatgtggccaagctacctggacaaaatctcaaagcctgctgctgctggcgcagctctggctgccgtcattgttccagctgcactggccttcctcctcatgagcaagaagcaagatcaggctgtcgcaaatgctgccgctgaggcaccagctgatcaagctgaaccggttgtcgagaagaccctatctggttcggggagcagcgagggtcatcttcgtgtgaagggttcacagcttcagactcctcctgtggcagatgaaaccgagagattcggcggcggctccggcgcttcgatgtatagcagcagcttgtcttctggctatggcaggaggaagagtgccaaggaggacgagagcctgagccttgatccagtgtccaggagggattctgccgcgcaacccacatcgtcctatggtagtttcaccacctacgagaagatccctgccaagaaggtatacaattaagcggttgctgtttatatcctgaattcatcctttgaaagtttgtttgtgctaggttgcatgcttaattaatttaactttgtttgtgcagagaaacaaggatgatgaggcggtgaccaccccagtccggcgttccagcaggttgaggaatcaggttaaatcaccggaggcgtaaagatgggcagccccagtgctaactacgatctgtaggggacctaactatcagcttgattttagcacttgctgctttagcttaactgctcctcagctttcattgacattgctttagcacttgaattcgactgatgtatgatgataaataacagctctctgctgttcttttcatcgaaaaatggattacgatttctgttttttccccccttctttttagttgtgtctgttgagatgactgctttcgtgcagctttgttatgtttgctacctgaatatgaatgtattaatccaggacatcgctttgttaccattctgtcagtttctttgtgaccgtgacatcatctattgtcttccgtattaatgtttcagaaacatgctgtttttcgtttggagtatttcgatggatttacgattatggtactagtagttctgtagtagccacgacaaaacactttgaaacttccaactttccatcacatccaaaacttttctacacacataaactttcaactttccccaaacttctaactttttttaggaactaaacatagcccaggttagattcatattgaaatcagaaccaagcctgccaaattcacttagcattaaaatttcagatttactatgcaaacacttggaagctgtgctgtaacaatcgttcgtgtttctgcaaaaccgtgtgcaaattcacataaaactgctcgaattcatattccattgtgatgggtgtgaatttcaacgctgctaatatttgacttttgacaagttgccatcctgtggcgggaaaaacaagcttaaaaagaaaaaacaaactcaaacaacatttgcctaccggacccacatgtcagcttccaagtagcccaatccgttggctccctgacaggtcggacccacttgtcatctgccccaattcggttcaactacccgcaggagtcggtctccccgccctcctcgcatcgcatcctccgccgccgccgccgccatcaccctcctctccgccgcattagcagtagaatcctaagccataatggcaacctccgccgccgccgccgcgagcaccttgccttacctcgtcgccgccgcctcctcctccgcggcggcgcgccgccgcggggcccaccggatccgggcgtcgtcggcggcggcggaggtggagggggcgatggacgtggtgtcggaggcggagctgcgggagaaggggttcatggggctccggaagacgaagctggtgtgcacggtggggcccgcgtgcgtgggggctttgccggcgctggcgcgcggcgggatgggcgtggcgcgggtcaacctgtgccacgggggccgcggctggcaccgcgccgtgatgcgcgaggtgcggaggctcaacgaggaggaaggcttctgcgtctccctcatggtcgacaccgaggggtcccagctcctcgtcgccgaccacggcggcgccgcctccgtcaaggccgaggtgtgctttctccattttcttgtcgatttggttcccggcattgacgtccggggattatttcatataattgcgcaacaatgccccacaccttcaaatgtgcatcctagaaacatccaatttggtattttggttgtccaaatttgaaataaaaacaattggtgttttcttgggagtaattttgtcaaatttgattgaatttgatctagccggtgaccagatttgaatcataacattcgggtaggatgtccattcatttgggattgttttgctaaatgacaattgttgtacagagacattgttatgactttcatttagcagatggccctttggcatttgatttatttgtatgcatattttatacatcctttatattgcaaaagactaagataaattcagtcttagttagatagtatattccttaataaaaggatagctgctagtgtatttctcgaaagaaggacagtggctagccctttcagcctttgtaatgctaaagcagataagtcttcacttatgttcctccattatgccgaagaagctgaagtaactagattttttgctaacagcattcttaataggacatattcatggttaaaaagttttacggacttggtactactagaagtactagattattatttcgtgcttatagcttaggtttcattagagtatggcactgcaagtaaaaaaagatgaactttggtcatctcgatctttgtaatttacgccttcaaccattcatcaagttattgtgtgaggtagcaaaatttatcgaattagtcctgatctattaccatacactgtttgagttttggttagtatctactcttcattgatactatcatttatctgtaattgtctcagcatctcaatatcattgtgaacatatttttgttactctctttcacacaaatcattccattgtttccttgtttccattaaatattgcaggatggctctgaatggctatttacaagtaaaagaaccgatgaatctcatccattcacaatgcatgttaactttgataagttttctgaaggtctgaagatttgcatggcttttgctggttttccataacaggaatttaaatgttcttttcacaaattacataccatttacagacattctagttggtgatgagcttgtaattgatggaggaatggcaacatttgaagttattgagaaggtcggaaatgatttgcgctgtaagtgcacagacccaggtttgcttcttcctcgagccaaactgtcattctggaggaatggaaaattagttgaaaggaactttgggcttcctacattgtcagcaaaggttaacttaaaatgcagtactttattattgctatttgttcgctttcaatgtagtgtcgctttgttttttcctgaaaaaaacagcatgttttcacttattcatgaagtatttctattaattgaattattgcatttatactgtttccttaaagttgcccattttttttgttttttcccctgaagactgcaacaatttttttggcttattcatgaagtatttctgttaattgaattaatacatttgtactgtttccatgtgacagttcttaagaagtgatagaatttctggatatttccatttcataaattgttctctcatagcatgcttgctgcgtgcatatattatcttgtaggattgggctgacattgaatttgggatagctgaaggagttgattgcatcgctctttcatttgtaaaagatgctaatgacatcaagtatctcaagacttacctctccagaaaatcattagagtgagcagacaactgacatataaagtccttttatagtttgctaaactgaattttctttgcattattgtaaaatggtgtacaattatttgtttcacaggattgttgcgtaatatatatgtgtcaatttattattattatagatgtctatgtgctaaaggagagtcctagaaaattctggagctgctgcagttaagcttataaatcaatgcatcacattgtcttatctagaaatgcaaacctggtagaagtgcagaacgaaagaaaatcgatgctattatttcacagcagagcatattaagtcaattgtttggaagtattcagctgcaatacagaaccacagaactaacttgtgttactgatgtatttatgccaaagttaccaccctattcagtttaggatttgcagttatgttactgttggatagatctttatgcaactgctagctagttgctgtactaatacaatcttgctgtataccagacacatcaaaatattcgcgaaggttgagagtcttgaatcactcaagaaccttaaagacatcatagaggcatctgatggagttatggtagcacgtggtgatcttggagttcagattcctttagaacaaatcccagccatccaagaggcaattgttgatctttgtcgacggttgaacaagccagtgatagttgcctctcagcttcttgaatcaatggttgagtatccaacaccaactcgtgcagaggtaatctatttttttaaggaaataaagttgatataaccacgatgtacggataatacatttcaaaaagaaattttaattccatctacctaacctttttgtgcttctccttgatgacctggcattatctttctgaaggtagcagacgtttctgaagcagtacggcaatatgctgatgccgtaatgttatcggcagagtcagctataggtgcatatccccagaaagctctagcagtcctccgtgctgctagtgagaggatggaatcatggagccgtgaggaaaacatgcagaaacttcttccacaacatcagcttgcaatagctttgcctgataggatctcagagcaaatttgcaccagtgctgcagaaatgggtatttttctaattttcttgtttatacatcctttccagatatccactacctttttctttcgataagcaaatatatattacctttttataatatcatctgatattcgctcatggttactctccctgcagcaaacaaccttgcggtggatgccatctttgtttacacaaagtatggtcacatggcgtcgcttctttcgcgcaaccggcccaaccctcccatttttgctttcactgataatgccaactcaagaaagagcatgaacctctactggggagtaattccacttcagctaccactgtcaaataacatggaagataacttcaatcaaaccatcaagcttatgaagtcgaagggttcagtgaaatctggagacacagtcttggtcgtcgccgactctgatctgaaccgaccccgtgctgctacctcagttttccaatccattcaagttcgaatagtggactaggttagtcattgctgagctagttgctagcagctgcagatctggatggatatttacaaattatacgatgattcttgaaattgttctgatgcgaacttcttgtggtatttggattaggggtcttcatctgcaataagtatcgaatgaaagtgttgcttgtgcgcacctggtattagtttgtatacattccaatcatgaatcatctcccctttttcatactaaaaggcttcaaaaataattctatgttcaaatgttagcgttatgtgcagaatctaaaatgtacgacgttctaaactgtggcccactatgtctatatccaagccaccatgtaatcatacaattttgattctgatacctttgagtcgttctgataacatacgaagtgtatgagttcatgggtattggcattgcaagcataatgccgaagagccctaatttaagaacaatacatacaaaaatttaaagaaaagctnnnnnnnnnnnnnnnnnnnnnnnnnncgtttggtaagcgggaggtcttgaagttcgactctcaacgaaagcataatttatttgcccatttgattttttatgaaatttttgccacgattttgtttgagtttgtgctaagggaagcaattaaataaccatgggtttgagacgatttacttgaagtatatataaccacgatttcattcgagtttgtgtaaggaaatcaaataaccaggattttcttgagtttgtctttaggaaagcatataactaattaaccacaatttcgtttgagttgtgtgttaaggaaagaaataaccacgattttcaaacgctgcgcgcgccacacatgcatgcctgcaagataaatttgtgcacttgtgcagtgaaatctattagtactattcactgtataattggtaagaaacagctagcctaccataatctgcagaagcttgctacaacgccgtttcgtctatgttcattttaagttaaagtagaaaaagccgttcctctttaaagaaagcagtaaaactgtggaacatatactacattcgttttataatatatgacgttatatattgaaaacgaagggattattattatcatcatcatcatcatcatcatcatcatcatcatcatcatcatcatcatcctcctcctatcaattccttttcaatcattttgtatggtttttatggtcatgcctcatacttgtcttcattaatttgcagaaatgagcttatccatgcttgaatgcatctccccattttcgttatatggatgtgaacattacaacctaatatcgctatgtccatggacgtagaacaactagaggaaagttcaagagtgagttggtgtgcctacatcaattaatggaggagcacgcagcaaaatgattcctacgtacccccgatccacaaggataggcaatcatatcttcattgactcaatcggacttataggttgattcttaaagcatcatggattaaagcggatatagcacaagaaagatcatcggggaaggaggacaacacctacgataggaggtctaggattggaagccaaattgagcttgtgcctgttagagatcgagttgtaaggatcctaaccattgtaatatgagtaattttacactccttgaggagatagtgggagataacatattttctaatgtaaaatttggtacctcttggtacctccaatactaagaggtatggaaatttacactaattattttttacctctttgtgtctctcaaggactacaaaatttctcttgtaatgttacatctagaagtgatatatgctaagcttccaatacttttgtgcttgtagtctagagagcttattagaatagtcaacgacgtagggcatgcgcttggacttaagagaggaggagagcaaacagagagcactccgtaatatgctagaggtaaattgtcaaactattttacaattcaaactttgccaaacatgctctaacatcactttgcattaattcattattgtggaatggcatgtagaagatgttgcaaaatggcggctcgccttggatgtcatttaggtggagtatatgtttttatcccttgccacctctatgaaaatcccttaattgatatgtccaagtgtagctagaacatccctatcgagctcaagacaccaagaaggcgatgcttcttcatctcatacccggaaaggccacggctccaagtgatgacgatgatgaagaggagaaggacaacggcaaggattacatcgtatattgtgctgacgagattgggccatctcaacttgacaatgcacctcagccatctcaacctactcaacaatacaacacttgttgtaaccaatcgataaaacttaatacattgcaaattattagacttcccttcacattctcaaaagtaagtccttacaatatgtaggtacactctttggatggatgttattcgacatcaacataaaaagtgaagacatgtttttacaaattgtgttgcaatgtacgttgattactaattgcttgtgatggactacgtgttgtaatatcatgcaatgtgaaagactatgtttctatttgtatcgactatatgttatggtaatggatatgttatgaattgctatggtcaacaatatcccatgtgtataattgggatatggtaattttttatgagatgtgctatattgttatatctgttgtgcttacacaaatatgtataaatgcatgtggttcatgccaaattttactgtcaagttgttctaggaataatatcttcctaacaaaaaaaaaattccaggtgttgccaggcttggcaccagcctcaccatgtgcctacttccacaccttggcaccagaggccgcttgaggcaggaggggaggtcgccagtaggggtgagaattcggtcagaccaaaccaatagtttgttttttttttcaaaagtttatttatctagaaaggataaatgattggttcctagaaaatgtcaaggctgagtgtttttgagtcagttagaaccgaactaaacaaactatcagagaccacgtcaaaaggcaaatcataaaacacgatagtttacattggatttagagatctagaatagatatgagagacaacatacaagcaccaaatccaaaaacaaatcaccgaatcaccatagtttttacaatggaaagagagaacagatctaagagcaattagacatgcatgggagagacatgatgttgccacctaaggatagcagctgggatccaccaccagcctctcctgactccatcgctcgagccatcactgctggtccctccatcctcgacatcggttgtgacgagcagacagggtcgcccggagggaaggtcggagcggcggatcaaaggaggaggaatggaaatcaaggaggcggaggaggaggcgagccactgggcgactgctgcttgcagcctcataggggcgtaggttggcaggatggtggcgacgttttatgtgtggtgggaagtggatgccaagtgggagaggacaggaggggaggggaggggagctaaccaaatattttggttttggtcaatttggtttcggtttattatgcctacccctaggcaccagggccttggctgagatgccggttggggggggggggtcggtgccagcctccttggcgtcgagctgcaacacctcgacgtaagcttcattggcattgagccctagccaccgcatcaaccaactaggcatgggtgccacgaaaagggccaacggggggagggggtagagggtcggcatcgagccattggacctcggcgccaaaaaagggttcgttcctaaaataaaattttcagggtctatttatgaaataagtattcaaaagggccaaaatgtaaagattttaggcttgtgagcactcgtctttatgtcatgtactctagtaagtaatagtgtacatgtataggcttttaatgttgatatttttctatccatatatgaatcaaaggttttatgaaatcgaaatcgattctttcttagatatatagatagatggatggatctatctttctattcagatatcttttgcaattattcctaaatccttgatttggccaggaaataaagcactgctttggccctaggaagcgaagggaatgagctcggctgcttctcctccacgcttctttatttctccgtgccccttctgcatgcacttcacgcgccattggccctttgctctcttcttgtttcttcattggagtgttcggatggacttcgctgttctttcccaatgaaaatggaaagggttgtatcacatcgaggtgtcaatccgttttccgccccaaatgagatggcgattagtcacctttgtcccttcatctttatgaaaggaatcaaggcccaaccaggctcgcgttgttccagtagcgcctcagtatactatcgtgcacagtaactaggagtcctattacacctaaggccaacttccattcaccaaacccaggttcatctcgtgtagtgattgtggactcgtacaaggatatggagtcgacggttgatgtatcagactcgaccctgtctttcgtagcatgcattcccatccgtgttgcaactgatttggtaagctacgtgtccggtgcaaggaaaattgccttcggtcttccaaccttactcatggcaaccttctggccgctcaacaacctataatgctagtcactactcccactggggctaggaagtaagccccacaacccaaagcggcgaagaacaaatagaatttgctacaaaagcctgctaacggggtattcccgtatatgagaacattgtaattgagaaggttatagccaaaataggattcggaattgataagtattgtgttcctttaagatgtacaattaattaagttctgtcaggcatccacagtttctccatgtataatcaaattttggagggtttggttcctaaggaaataattcttatatgatcatttggaacaaaggaatggtttccccaaattccttattagtattgtctcaaatcataggaattttgaggactctcaacatgaggttctaccatactaggtaaaattcctttgtatctatatatatctcttctgatttttgtgtttttcatgtgctccatctttctgtagtttttttttaaagtttttatctataggattggagatgacaaggcactcgtgactcctacgttttccatattcgcatgttttgaaaatccgtcattccaatgaccaaacaaaggagccctaattgtttgttttccaacttctagcttgaattttctaattttgattaggttacttattattctgcagggaaatgtccatttaatgcgcaattgttaacgtgttttcactttcagttatttcggtcgtatcagtacgtgaacatattgacatattactagctacagattgaacaagtgaatgttcattatattgtacaaacatcttaacaagtcttaataattatatatttattatttcactggtactctgctagtacccagccttctcacctctcagatccaacagcctatatatgtgctacagcaaacatcatgagagcatcttcagtgcccagtactacctaacataaagtacactactgcagcttcaagagacttcgctatatacatgagctgataatttggccggatatatacatcattgagtatgttgctggattaaattccattaattatccaaaaaaatagctgacagtagcttatggagatactcctatgaagcagagatttaattaatttccgtctctgcagtgaaaattaattcagaggtacatatatatacgtagttatacatcactaacatacaaagggccatcattgccatttcatatataaccgacatcgcaatattggtttttaatccagcagcagggcaatcgactgtgatagtatcactgccacgaatatgcagtgcagcactgtatattctgtgcactcgtgcagtacttgagccctggagatgctattatgtatggatcttgggttagattctgatcctactgtatattatatatatgtatatatttaaatggttctttccacaaatttcgttagttccaacacacatcgaccgtgcagtaaacaatatattaaagcaaatttaataatataatcaactactagcttcaaaattggaacatcatcaatagctgacctagggcctgtttggtagggctccaactcctaaatcctagctccaaactccaactccagtgggagctagctcctgttggagctagagatactcctgaaagcgtttggcaagcctgctcagctccagaaattctgaaagagatgataagggggagatagacaatactacccttattgttttcttgtttatttgacgtaggattaataacagttatttctccttaatatttgaacactaatatggaaggttaaaatttaattaaaataaaattgataaagttctagttggtgcatgacatatatgtaataatacaaatgtttagaaataataaccggtagcattgtcatctaaacatagaccaaaagagtagaacagccatcatcctgcaatagaccaaaagagtagaaaagccatcatcctgcgatacggccggctaggtcatcacgaaatgcatccatggatacatcactttgaccctcggtagatgtatccgatgcatcttgagaaatgacatatctcctaaatctagatggaatggtaggcacataatccggattcctttcaaacctatgaaaatgcctatccggagcattat

SEQ ID NO: 60739 - DNA, 3142 bp, Oryza sativa
aacaagtggtagttaccttggggaggatggggaaagatatctatatcggttctcaatgcattaaatagcacggttgtgtcatgcatcgagccaggttgtccaatagatgcataggtaaatctcatatcatggtcacaaatagccatcacattctgagtggttgattttgatctaccaatatatctaatcttatcatcatctggaacaactgcaaggatatgagtaccatcaaccgccccaatacaatctttgaagtgtggccacatacgacgatccttcctaattctctcatggacattagaaaagtttggatcctttggacgaacaatatcacgtcccaactccacaacagcaaacaatacttcttcaatttttcttgatattgtctcaccagaatgcttgaaacagttttgtgccctttggtttgatgaaccatcacctagaatgtacaaaaaaattgcaagtgcctccattgtatgcatgtgcacagtaggtgccaacttatatttatcaaccaaaagatcatgtaatgcaagaaaggtgttgccattcatgcgaagcatcctatagcattcacctggtgtggccaaagtttcttgcacccatcccattccactaagtcttgatgtcctaggcgcagccttattcatgtagagagagtgataactctctgccattcttcgagttgaagaaatattgcttgtcacagtttcaaacaattgcatggcaagcaaatcacaatcatattcttcatctgatgaaccatcttcactctcacttgacatctacaaagggagacatacaaaatcaattagaatagtactgcatatctacaattaatcgaacagtactgcatgccatacatatgaaaataatccaagagatatatatctgaaaataattcaataatagtgcatgacatatatatgaaaataatccaacaagattacatgacataggtctgaaaatagtagttcagaacccatacaacaaggtgatacaatccaataatagttcagaactgaaaatcaaataacccatacaaacatgtctcttcagtagatagttctgaaattaaatgacaactaaattaaagtgatacatttcatggccacattgcattcatctaatttccatacttcacatcatacttcttcttaagccatgcaaagcgtcctgcaggagtgcgcaatgaattaacaaacatctctctttgatccttcttgatgaaaatttcagttgcaatgaagtgttcatttgtcccttcaacagcaccacactcctccaccaaggtcataacatcctttatagaacaacccggtggatcctctcttattttagtgaatgattgaatggatgataaagtttgtgcagagagctcgttactctttgacatctcctccaccatcttttgggatccactctttgtttttttcagcttatccaccttcgagctatctcctctcttctctttgcgcttggttcatcttcatccgtctcatcgtcaatctcattgacatcggcaatttgaatagtgccattagtggtggctgatggtatggtgccttgccctaaagaccaatggtcggcaccggtattgcgaatgtcttcaaacatcttctcaagtaactcctcattttgaagccggcctttctaaatttgaggcagcctgctatatcctacatgacatgacattataaaaataagttaatacacaattttggttcgcatttgcataatttaacaccgtacgacaaaaacttacttctttaagttgtttccaacgtgctgctgtagctgtgacggtttgccttgcgtcatcccatcccaaacctgtttgagatttcaacttcttccaacaattgtactcaatcctaagtttatcccatttgttcttaatttgaagcctagtgtacctcagccctgtctttgaggcaaattgctcaatgacttcgtcatacccagaattggataaatgggtatttggacgattacccgcaactacttgatcagcaaaaatctcacacacaactctagtgttgtagtcattccaatcagcatagtcaattggcattttaacactcttcgatggcacattttcagccatgcctgccatccactcacaccatagtttcaaagtttagataaaggttcagaatgcactactataatttcacattgtgtgttcatgcagggttataatacatttatacacctatgtatcaatctgaaatcaagttatacattatcctctcaagcatatacatcaatctaaaatcaagttatacgttatcctctcacactgcaagagaaatagagaacataacatcaatctgaaatcaagttacacatagtactctgcatatttttacagcacgcatctttgcagatttttacagaccatagcaagaaaactcagggcctcctcatggaccactacccgttagatctacaactccatgtgacacaagattgagcaaatatcaagcaatcatccacccaaaaaattaaatccactccacaaaaatcatgctgtcatccgaaggaaagatttggggggatttctagggttttacagatttgataccttgtggtgctgggggatagggaccggcttcctcgagcttccgccgccgtgcgctgccgctgtgagcctccgccgtcgtgcgccgccaccgtgcgttgtcgccctcgtctgcaacaaggtccgccggaggtcaagagagggggaagagacaatgggggaggaaagaaaagaggggaaaggagaggggatttgagagcgcacctgctcaccgctgccaccggttcgtcgccgtcgctggtgtgcctcaggcagatgcgctgcgccgccgcctccttttttttcgcaagcgagactcgctggtgcggcggactgaggggatgcgatacaggcaaggggagggggaggggtggagggagtagttcgatggcatttgcgggtaatttttcttaaacttcagtggtacttctaaaatttggttggagttagagttagggagcggggggaatgccgctccgcgccgctagtacattttttcagagcgatccgcctactccgctccattttttttgtggagctggactgtttggttggactctagttggatctgagatgaat

SEQ ID NO: 60740 - DNA, 19682 bp, Oryza sativa
tgccaatgtatacaacctgcttgtgttactatactacacccgctcttaggaagtactacctccctcttaaaagactgtagttatgcactatttatattcaacgtcaggctgtccgtattatttaaaatttttttatgattagtattttaattgttactccctccgtcctaaaatataagcacttttagctatgaatctagacaactgtgtgtctagattcatagccaaaagttgttatattttgggatagatgtagtattatgtgataaatataaatagtagtttatatgtgactattttttaaattttataataaatttcttaaataagatgaatggtcaaacgctgaacacaaaaattcacaactacctacttaaaatgaaatggaggtatatatattactactaataagggagacatggcacgtgtggttttagcatggaatctgatgcatctcccaaaaggtggtaaatgtggagggccatgcattgcctgcgggagcagcatccatcaatcatactacgtactagttttgtaggtttagtactgatgcaccatgcacaaacatggccaaggacccgacccctgtagtagcacgtttctctgtaactccaccacgacggtcgttgggtcctagctagcttttctgaacgacatggactagtgttattttcttctctctctctctctctagctctcatttttttgggaggagattaaaggcagatggattaattagctgaaattacgtacatagagttacaatacattcttcactgtatatatgaacgagaggatattaattggcaagctgctcatctatccatgctggagagcttgtaaaccctactaattaattacattacattgatccctcttaaccttctgaaattctcacctcagaggatcgagatcagttatatcatcttgttctacgttttccaaaactaggatttcggagatgcatgttggcattttgtatcctaataaatcatttaagtactaaaaatttcagcaaaatctataatctttcaaagcaattcatcctttttatctcatcactaatgtgtctcagaaaccagcttgaactagcccaccactatagtatgtggtgatgtccgccatagctaccaaaaacatgagaacctcagctttcttggcttctctcaccctctgcgcacaaaggacgaggcatttattatataaaaaacccatcgcttgtatgttaaaacatacatcctatctaacattagctatggtaaagtaaggcatagaaatacaaaatacttcccgacaacttgtagccaatgtatttcttgtaagaactgatacacacaacactaatcgactacatgttatttcagagatccattctttaatatggtgtagctttatcgtgatctgcatgtctttcacgatctaggatttaagagaagcatattaggacaacaacattttatatcctaacgaatcatttatattattggaaaagttagataaatctatacattttgaaagcaagctagttatgctcggcatcacttaaataatgtgtctcagaaacccacgctggaattgatccactagaatagtgtgcaatgaccaccattgttaaccaaggacacgagcgtaccctagctttctaggcctccctctccatatgagcaggaaggctgggatgacaagacctttattacactataagttctagagttatgcatgtgcgtacgtatgacactagttgcaacatatgaaacacttatatcaatattagtaatgcatacaaacaatttaaaattagtgcttcattataacatgtagcgaattgaattgtcttgcaagaactaagtggttgttttgcaaggctcaaactcctaaatctaactgtaggagtgaaggcgaaccctgctccactcttctagttctttctagatcaacttagctcagtccactccaatggactatgtaagcaattggtctatggagagagagagagagagagagcatattttcttatttatttttacacatggattaaaaaaaagactaatatgtgaaagtgcaactagggattctagtcataggtcacctgtgaaaattattttttataggtgcctcccttatgaggccgaacataaaactcagaccatttttacaggcaaacttctcaaagatccgcttgtgaaaatcatatttcccaaaccctcgcttcctctctcctctcccctcagacccctcttcaatcacgttctctctcccctcaaaccccccctctccctctattaaccaggtttgcaggcggcgaaagataggtggcggcaacatctgtggggagggatggacccttcctctctctcccttaccatgctcacaggaggcggtggcaatggcaaagtggagatgcggtggtgttggaggatgcggatgcgccatcacggcacttggaagaagtggatctaccagcggcttggttgggaactccttcccttcttcctttgcaaccactgtgacaccgatcgacaagctttgctgaggcggattcatcggcaacaaccttggaaacaccggatctatctgttgtgggctgcggagtggaggtcggcggcaaaggtgctcaatgaaggtgatgatggtagtaggcagatccaggcgaggcgaggtcattaatggcgtcggcggatggatccaaatgaggcaagggtcatccaagacaatgaagctgggggagccctgtatgcaacaagaaccatgtcttcgctccacttcttgtctccaaatacttggtcattcctcaagcttacttgcctttgagaaccatcttatccgcctccaggaggacctcgtctttgccctcgaggaggacctccatgcaaaacagctgatcacctcatcgaacttcaaggtactagccaggctagcttgtacggagtggcttcaaggggaacatttttctctactgctgaaatctgggtttgttggaaccatgccaccctaattttgcaaaatttgagatatgccacccgtatgaatttggcatgtacaatggatgccacaagcactagtggtctcaagacgccacatatgatagaacaacacaaaggtcacactagccgcagtgaaaccactgcaaaacgtattttgcttttcagcccctatctatttatatgtcagtccttatattgtatgttattatcaaacctattaaaactttatattttggaccctataacaaccaaaataagtacatatgcacccctaaacactatacggacccactgtcagcctcttcccccctatcttttttattctctctccctctctcccccctctctccctctctcccgagccatctctctctctccctctctcattcgccatattcgctggtgagctccccatctcagcggcgcggacaagttctcggtggcggatccggaggcgggctcgacgccgccgtcctcctcccccacgacggtgcggacgagctcgccgacggcgtggcgagcttggtggcgtctggctcgccgaattcgggcgcgagctcgctggatctggcggcgggggccacaacggcggcggttcctcttccccttccttcttctcgagcgttggcagcggatccggatgcgggctcgacgccgccgtcctcctctccccacgacgacgcggaagagctcatcgatggcgggctcgccggatccaggtgcaggctcgccggattgcggcgagggccacaacgcggcggttcctctccccctcccttcttcacgagcgtcggcggcgaggagcaacggtggcggcgatgcgaccggacgaggcaacgcacggggctccggctccgccaacgcgtggcctcgggctgtggcttcgcccttctcgagcccaagcgcgacgcttcgagcggttcctctgcaagcgcgaaatcggtctgcggagccacggtccccactgccatggatgcgcgtgtccgacatggagggttaagaccacaagccagagccacgctttgtacatggcctgacaagaaatcgaaagttttatcacctgcattgacatgacttgtgcactatttttgcacgtacgccagcacatgaaagactatcaccggcactgtgccgtcacaagctggttgtaccaaaatagtcttgtcttggtgttcttccaggaaagatgccgccaactaaatttagtaacgtactgtacgtacagactacagtagtttggtccaacgtacacggtatcacaggatcaggtacatggctattctcaatagtattcttttaattaaactccggccacttgggtaaaaattcgggtcttctttgatcagtatagctaagatattttgtaaaatccgtacgtgtaaacaaaattcacaaagctatatatatagagagagctatgatatttctttaataatgaaatgaattatatcttgggacatatataggctgtgttcttcctgtacactttcccaacttctactcactcatttttcacgcgtatgtttctcaaactgttaaacgatgttttttatttttacaaaaattttctatagaaaagttgcttttaaaagatatattaataatccattttttattttttagtaaatacttaattaatgatacgctaatatgttattccattttgtgtaccgtgcggaaagattcccaaccgccacaatcgaacatatagctatagatgataactaaacttgtgccgttcaaaggactcatgtaatagtagcttcaatcaatcctgatatatacaatttaattaaaagaactatcctatagttgtagagtctgaatagatttccattatccagtaatgcacctaaaattcgagcatgagatgactctagctagcttggatattggtggcggcgagctaacttggtttctcacattaataatttacttttaaaaaataaacattcgctctagttggtttgaaataaaaaaaaaattgaagttactgaaagctgagcaatttcttcaggaccccgtattgaaaataattaatacttccttagagcgttgtatatatgcacacgttaggttagcacgcgattaatcaacaattaatagattggctagctactagttgcatcatgagatgtggatatctttgcatatgataatctgacagtgggttacgagtatcattttggtaggattcggccagataatcgcgatcgccagaaatgatttgtatattaattccgtcgcttttggttgtcctttgtggggaaagggaaaggtgatcgagagtcgtatgcataatattagcggcaattttggaggagacatagcacgtcaaaattaaatttaaagctaacacacaaaaggcatctgcttcacgagtgtagttactgcacgtttattttttgtttcctaaaagtaagtccaaagtgcacgtttataaactgttcttccttttgtttagattctatatctagcaacgattttggcgcagtcggtttgattcatgacaaaggcgagccgatatgtataagacgaggtgattcagccaagagtacaaaacaaaatggctcattttcaaatgagaaaattatttacagaaactttggagctatatagccatccaaagttcctttctaaatactacaaacacatgcatactttttttgaatctctttcaaaatgtaaggtacatatgcgtgtaggatcaatatgactttctgccttttactatcatttaactatagtctgttgtgttaggtttttatattttgggatggatgaagtattaagtccaccgccccccctcccccccccccaaaaaaaaaaccgcgctcacacacatttcgtatcctcttttggttcaaatcattaactccataggtacactggctgttcatgaatgtagctaggagacactgcacgtgagatatttcactttgttaatctatatatatggtactgtatagtacaattgatggtactacataaataccagaggtagcacatgcaaatcaatgttttgtttagggagaaattttatggtccttacaagctgtcaaaatgccaatacgaaaaggttaaataaattacactaaaaaattggtacctttcggtatctacttaagaactacaaaatcactcattttaaggtctataatgttagtgataccttccaagtgttgaggtatcaagagataccataaattagtatagcaaatctttggattatgacaactcctaaagtaccatgaaaaatcccatgattgtttaaccaaaatatatgcaattgactaagcaaaagggagcagtcgtcctagtggaggtgctctatatatgtcaaagaagagaaaagcctctgacatgatttatatggagagaggtggttagccagctaggccaagcacaaaaaatcctcgactagtcttgaatggtgttcttcagagtgactctctcttccatacattgtcccaaatattatttgcatgttaagcaggatctgagagattgttgatagatctgcaggtaagtggtactgtcccactgtcttggctacaaacgattctgtgtgtttcacgagctccaattcaatgggcaatctgtagtggcatcaagtcagctactgttcttgtctgtgattgatagctgtatatgtctcccggatgcatggatgatggatctctgtgcttgtttgccagtagaccagtagccaaatagttttctcttcagactggctgcaaaagtttttgttcgaccattcacatctcgaccagtcgattttctgtttgaatcatgtagcttagctctcgctcgatcgtccaattaatcttggattcttggagatatataactctccgatgtctagatcgacattgatcagactcaagagtgaaatgtttgtttgtttgtttgttattttgtctaggtagatagctagtagagttctttttctttggagacatggaggactcgagcctgttcatggagtgggccatggagacgctgcagcacctgcacccgctgccggcgacgccgccgcctgccggcggcgggtacgccggcgacaacgcgacttttccgtcgctccaagcgctccgcgagtcgtcggtgtcgcagaacggcatggccccgccggagccaacggcgcacgaaggccaccgagcctccaacagctggagctcgggcgacacggacagcgtgtccggtggcggcggcggcgcggtcatggagcacgacggatggtcgacgtcgccaaattcggtcaggtgcgccgctggcggcgggggcggcggcggcggcggcggcctctggcccgtgagctggaacttctcgtcggccatgacgcagccgtgcaacgatcaggccacgccgtcgaacccgccgacgacgacgagagcgcgctacggcggcggcggcgttcgatacctgccggccgccgtgtcgccatcgccatctgcacagacacggagagcctcctccaaaggcaacggcggcggtggctccggctcctcgtcggcggcgccgtacgcgcaggagcacatcatcgcggagcgcaagcgccgggagaagatcaaccagcggttcatcgagctctccaccgtcatcccgggcctcaagaaggtataatacatatatctccatttctcgctcatttctctcaccatcttctctgaacacgaagatcgatttgaacagatggacaaggcgacgatcctctccgacgcggtgaggtacgtgaaggagatgcaggagaagctcagcgagctcgagcaacaccagaacggcggcgtcgagtcggcaatactcctcaagaagccgtgcatagccacgtcgtcgtcggacggcggctgccccgcagcgtcatcggccgtggctggaagcagcagcagcggcacggcgagaagctcgctgccggagatcgaggcgaagatctcgcacggcaacgtgatggtgaggatccacggcgagaataatggcaaggggtcgctggtgcggctgctcgccgcggttgaagggctccacctcggcatcacgcacaccaatgtcatgcccttctcggcatgcaccgccatcataaccatcatggcaaaggtaagacaaattaattcgtcgttttaattcgagagaatttaaccaacttgttttgtgtttttttttgtaaatgcatgatatgtcttgtagttaatattccactctggtcaaatatatttgatgttgggagaatcatgcatatgtattaatttacagctagatctctcaatgtcaaatataacatgtccaaataatatggaccagtatggcttatatgctttaaaatttgtggcaccagtcttagggcccatttgaatcgtaggattgaaaaaacggatgaataggaaaaacacaggattttgatagaaatgtaagtgtaaaacaggggattgcaaaacacaggaaaaatatagaaatgactgtttgattagaccgcaggaaaaatgcaggaatgagatgagagagatagactcaaggaaagttttccaagaggtcagagtggatgttaactttcctacgttttgctctataattgtaggaataggaaagtttcctacattttttctttttcttattcctatgaatcaaaggcatgaatagtgtaggatttcaattcctttgtttttcctccatttttcctccaattcaaagggggccttaaacaatttacaagatcaagtaaggttatgaccacacaagcgcttcgatttaagaatatttcgaattgatcatcttcaacaagcacggacaaagctgtaagtaagtaaaaatagtttacacttggtgctggagcataaacttttgctacagctagcatatgggtttgctttgtgctgagaaacgtctaggggtctttcggctagctccacaaggtggtgggctagacgacctgggttcgaagcctcacctcttctaatcaattgatattaatggtcattccctaatattcacgtctgggtttgccttgtgctgactgcaggagtagtaagaacactaaaattcataaggtatatcgtgatgataatcatgttatgtagtacaacatatcttatgactacagtcattctttatgcacttcttatatactttctagttgcaagattttcaattaaaaaaatgctgggcctgtcaattgtaaatttattgctttatacatgcataatcatagtggcttataattaggtggaaaatatttttttaagagaggtggaaaataaaattgattgggataaaactatagtacttggagtagctagtatagttaactaattaatatcactgaaaacaaattttggctatgatatgctatatagggtaatatttatcacctaatcggaactagatcttatacatatataatggcttctgtaatcatcacagtaagaaaaatggcttcatgtttccgaacttgccacatcaggaatcactaaaactaatatttgagttttaatttctcatatcatatactatatataataatatttatagcaataaaataatagttgtacgaaataaactaaatgcaaatgttgatctaatgatattgtttttaccaaatacagtttaatttatattatactccctccgttttataatataagtcattctagcatttctcacatttatattgatgctaatgaatctagacatatatatctatctagattcattaacatcattatgaatataagaaatactagaataacttacattatggaacggaggaagtattaggctaattgtcagttatatatttgaagacttaaatttcaaaatgtccgcccatcttatttagtggaaggagcaagtaaatgcataacttcccccattaaatttacatagatttaaattcttgtgcacatttattttcgctagaaattactccccccatcccaaaataagcgcaaccataagttttcgtgtccaattttaatcgtccatcttatttaaattttttttaaaaaaactaaaaatatgagtcacgcataaaatactattcatgttttataatctaataaaaatatcaattataaaaagattttaaataagacggatgattaaaattggatacgaaaacttatggttgtattttttttaatggagtacgtgtttattgttgattccgtcgtcgtccacttaactattgcatatgtacacggtgtcaaacaaaatattactccggaaaattatggcaagctgaaagacaagtgataattgattaattgatttatgcaccggaaccaaaataattaagaatgcatctacatttatttaatacgcttgcgtggcagcaccgttattttttagtcgatagcagcggtcctcaacaatattaattaattgatgaaagcggctgtgaggagatttttaaaattaaaagtcatacttaaaatcaattagaatgccaaattcatcttttcgtcgtatcttccacaaaatctgagtactatatataactggtcgttgagtggatatgtatagcaggtatatataaatgcgcgtccactaattaagtttgaaagctgtaatatacattgcaccaaaatttataccagtactaatttcttatacgggtcgcttataaaacccttcacgaaaattcgtcaaaacgtactgtcatgaaattaagttctcgcgagtttgcattcgtaattaatatatatgcatattaattatacgatttaatttgcatcaggtggaggacggggtgagcgtcacagctgaggacattgtagggaagctaaacactgtgctccagcaaaacagcagaaatagcgcgcgagaaacaaaaagctgacaaacagcaacaaacgacagctgctagctagcttggctagctactcaatcaggcatgttgccattgattccagaacagtgtaaacacacactctctctcgatctgctcgtcgtgtacttgcgtgcatctggcccgtgatgcatgcatttgcacaaataaatctagcactggatacaatttatcttagtgcaataagtttaaatatatcatatttagtactagatttagttttttggacggagagaatactagctagagctacgaatgcactctctatagccgaataatcttaagatgtaccggttcaactttttttaaagatgttcataggagataagatgtgtgcatgtacatttatatcaatgagtgttttgcatgttatgagtatcatcatttgtacaatgttttttttaaaaaatattatgctgatgttgatcgattggtcaggaggattcatgcattttgcacatatatttgcgcttatatatgttgacactgcacggccagcgaccgatcgatcgatatacgagaatctcttggatgatgaccattggattgatcgaccggcaactagctactctggctagctagttttattagctcgttctcattgctctccggcaccatacttccgctcagatgcaaataattcacttttcaaaagtttccaagctaggggccggcctccatgaccatattcccaatgcatgcatgtgttcagcatagtctccatcttcatgttactattttttaaagaaaaagtacgaattaccgtcttaaattatcatagtcaaccgaactaacctaaacataaaaaccagacatctttcacccccaattttataaaccggataaataatcccctagcttaatcccggtagttttggtcctatgtggtatacacgtgatagtccagtcagtatttcttttaaaaaaaatcagtgcggctcactataagatctctcccctcccacctctctccaccaccaccacacgctgcggccgacgaagatgctgccccctctcccaccaccccccctctcctcatcctcctcctcctcacccaccaccggagaagctgccgccgcggacgacgacgatgacgagggatgcccttgcatctcctcatgagacaaccttccctaccgagccgaactcctcagccttcgccacggtgccctccttctcggcctccgccggcacgtgtgtgcagatgggagagggctggatgatgcccttcttgtagagctttgcacagcatgggcttgggtgcagacggaggtcgcaagtcccaagcgggcagcggcatgtcgtccctatccatgaggatgtgccacttgcggtggagctcatcggccttgacgcggggcatgctacggaggcgcgcttgagctgtgttgccttgacgaaaaattgttgattggactgccacacatataccacgtaggaccaaaaccacaacggattaaatcgggggagggggggttatttgtctggtttacatagttggggcgaaggatgtctagttttcgagtttgggggggaggggtaattcaatcgaccgcgatagttcagaaggctaattcatacttttttcctttttttaataaagacagtttaaatcttgcgccatacctattcgatacaataaatattagtgtaagaaaaaaaagacatatctacagtggtaggacaaacccccgaactcactcgaaaagatgaccaatcaatttagcatttccatatattttttttagataatgaattttcattaatccgatctttatatctatgaaggatatacacagctaaaaatatacaagagcacttagactcacacctcaacaaagaggagaacacacaacaaaaaaaaaagaaaagaaaaacctacgacctcagcacaaccctgcttctcgacatcctctcctgaaatgcccagattcggcgagtggaagttgtctagtcatcgctgcccctagtgtgccgtcattgcgaatctccgctagtgccatgttcatctacttcaagtgagctgacgccacgcgttgccggttagcccaccttcattcgtcatcatccaatcagaactagccgaccagacgcaagctgacaggatctgcttccgcttcgtcggattcctaggcctctgccacccataggccatagggctgccaccttcgactatatccttctccgtctcccagatttctagcccgccgctacccctagggccgccgctgccactgaggaaatcctcttccacccggactccgaggccttccacacctgatgggatccgcctcctcatcgttgagaaccttgcaccggtgcccaggctaccgccgcccctagggttgtagccgccgccgtcgaggaggtcttctgccttgatgcccaggccgccgccgccgcctacaggaccacctccaccggatccgccttctccctgtcgaggactagccatcgacgcttaggtcgccgccgtcctccgccacgttaagtacatgaagataagccctagtataatcttaacacttagtattgttaaaaagtattatcgttacaacaacgatgaattcaagatctttctattgcgtaccaatgagttcatcattgggtgcactcagacatacaacattgtcatctctacaaggttgaggataccgataggactttctcttgctactatgtcacctatggtgttattttgcagatgcttggtcgaaatattgcatcaagtcaaattgttgtagtggtttgttttcatcatgttgtgatatttcattgcaattgttctttcgatttgttgaagcaagatattgcccattttgcatcaagtttttatcgtcaccatttgtgttgcaggcttattgtggacatttacaaacatagtacttgctagattgtaatattaattgttgcggcaggatttgagatattgtatctactatggggagagatagagttcttgtgatatttgattctttttttcgattacacggcacatactactacacaacacacaccatacttatatatatatatatatatatatgtggggcaccatggtgctcgggcaccatggtatgaaattcacaaattcgctcaaaattttcaaattgtgagtatatacctagttataagtattcgattaatacctataccaagcaacaaaacaactcaaatttaactttatttcacaatccaatattacatacctaactaattatatgtttggatgctatatacatagaatcaaaatctaacaaaatcatgtttaaattcagttcaaacttgttttgaactagttaatgttaatacctagacattttaaaaaatttcatactcatttgaattgaatatatactcaatttgaatcatgaagctcgggcaccatggagcacccaacatacacacacatatatatatatatacccacgagtgcatccccttctaacacatgctcaatagatggactgatagagagccaagataaattcatgagccttactaaaacattatcaaaaggcggtgaacctgagtgtgtgctcataattatttatttacaatagtttttgtgtagaaatatatttacaatatataattagtattgttgcatgatcgagtcctaattgttggtgtatcttgtgtgtgggagttcattgtattgtattaggtggttcaggtaaagccacttaagtgagtcaaacgatggaatggacagtagtatgataaaagttgttctgtggatgatgtccgatttgtagttgcgtcctttcatttcgtggatgaatatgactgtttgatacgctaggagctttatatatacagctcctgcgagtgacaaatatcgatagattctctgcgattgaaagatataaatatatatccatctttagattcacattgttatagctgggtctaatatatataatttatatatatatcagtctttgtattgcctctgtatatattattatcaactagattaaaaaaacgtgtgattgtatcagtgtgtgcatttgtacgatcctggcgcaccagcagtatatatatatatatatatatatatatatatatatatatatatatatatatatatatatatatatatatatatatatataaaagcttctagtatccaaatataatacacgcgcggtgtataaacatacgtaatatatatgcatgtagttttgtattgcagttttgaaatgcacatatagcagagtattttgggacatgcatcttaaagtttttggcacatatatatgccgtctatacatcagctgtgagttggtactacaagaatctgtaattttcttagaggcaaaaatcgttaaggatagcataaaaaccgccaaggtaatgacgatttttgtatagtatatacatacgtgtacgcatataatacgcatgtccttccatactgtctacatatgcaaaatgattatgcaaatctacgagcataaggctttttcagttagcttatattatgtcatgtttaattagcttattatatatgctctttggaatatatatacagcttggctagcaaaataatcatgtcttttgttgtgctgcattacatatatatactgaagaaattaggaaagactcaagcatcgacgaaaccaacatttggagtacatatttattttgctgcaaaagattgagatttcgctgatggctgagggtcccagcagctttgcatgcatgcatacatgctcgattatctttaattagaatggttaggagctctgccaatttattgaaaagagtaacttgaaataaagttacagcagctatcaaagatggatacatcaacgccataacataaaggaaacatgcatgcttaattatcttgagatatgttaagttaccaatactttggggatgtgtccccatctgaaactgaggtgaggatattcacaagatcaatctgacaacctcttaggacattgaaccttgcttaccaaaaaaatatatatacatgatacatgcagacagagacacatgcatggccatgctaggtcgatatcttggcaattagtgtgaaatagtccctgacaagcaagtcactaatttctgggccagggcagctagctgaatgtcagcacggtatataccatggagtagtataacgacaagtagtttgttcgcttgatcagatgggccgtgcaccacctaattaaacccgattgagaccagccaggactactgctatctgatttttttacttgactttattcattttttcgatgtgattgccacattcattctatatgattttctagttacccggaacctcctgtccctgaactccggatgtttcgggctgcctgccaggaagttccgggccctgtttaaatttgaccgccgcgattatttttagtgtttttcagttaagcctactcaccctccccccctctctaggttacatcttcagcttttatgtctggcagcggtgagtacggtgtcagtgagcgtggatggctcttcctcctcgccccgactccatgcgactccgggatagtggtaacgttggccatctccttgctctagcggcatagcagggcttgggtcagccttcccctttcgaccatggcacgggagcaagcaggtgctctgcagcagagcaagaggacgaagctgggttgggagggtgaggtggtgcggcggtggagataggggcaggtacgtacttttatcgctatttctctctccatttcctcctaatataataaaataataccgcaggtgtccagcaaataattaccttttttttgcggtgtcctctagcagaaacacgttcttgtggtatcctctagcaaagagagccattgagtgttgagtaaattttgctttgtaaagctgcattggagggattcctcaccgaccgcactcgcgagaaaattaattttcgcatgcgttcgctaaagaaccgtaaaccatactaaaatccccacccaatccctcatcccctatctcacatcaagtccccacccctacctcaccatgccctctctcggcttcctccttcactctctctccctctccctctaggtcgctaatgcgcctcgtgggggtgaccggttgctcgctccatccctaccctagtccaaacctgtggcagtgctcatcaagagaatcggcaacgatgattggacgaggcaatagatttgacaatggcgtgtctagaggtgacgaatctagtagtggtagtgcctgtaggtggcaacctgcaacggtaggtggtgacaaagaaaagacactactacaagaaccctaattggtgtcggttgggaaactcccttaggtattggttttcccaacaggcatcacagaaccggcaccgctgaccttcattggaactcttttcttcttcattgtactattgcttccaccgtcatcatccctgtctccacaattataccgagaagccttgcatactggacattcatcaagatatgcaaaatcaccccggtaaagaatgcaatcatttcgacaagcgtgaattttatgtatctcaagaccaagggaacatataacttttttcgcttagtacgttatttcagacaagacattatccgcaggaagaatttctttcaacaactctagcaactcagtgaagctcttatcagaccatccattgcttgccttcaggtgaagtagagataggaccacctggagcatggtgtgctccgccttacatccattgtaaggtggagcttttgagtcctccaccatggttttgaacatgcgatatttcctatcatcagtgtcagccttctccccgtcgcgcatcatctgatctagattagcttcactgtgatcgacacatgtttggtcctcttgctcacagccgacatcctcatttggcatgtcacagttgcctgcacttccctcgcattgctcctcttctccatagaacttgtccatgagccgccttataagaagatgtgcatggactcgatgcgccagaaattgcctgtctttcttgcaatcattcaatcaaagcatggacaccacagataatccggcgtatccactgagtttgtgctcgtcaccatggcaacgaaagccgttactcccctgatatactccatagagtcacgatccgcttcatacacccatcgtagatccattacaacaggcgggtacatacaaatattacttaatgtagattactctgaatcatacaaattcaatttacccaataacaaaaccgatagatcttataaatgaacaagaaaagataagcaacatctataacaccaaattagttttgttaaatctaacattgaatatattttgataacatgtctttgtattgaaaatgttattatattttcttataaccttggtcaaactttaaaaagtttgacttagaaaaagccgaatgacttataatatggaatagagggaataataatttatcgtttattaaaaatcgtgcagaaaaaaaatacaatgagggttttgtaatttacaagaacattggaataaaatacaatgagaaatgatcattttatccctaagataaaattgatattttttttgaaaatgccatgtcacattaattattcatggttaaaaaaagaaaaataatttatattttccatcaatgaggaaaaatatcggatcatgccatgggtacacatttttccatagcggtaaaatggatattttcttgtccttaacggtgtttcactaacatttgactaacatcgatggcatagatggtagaaaacatcaactcaaatttagcatatcatccaagaatagatctaatgagattaatggacacaaaaaagaaaaagagttatccctaaaaacgacacataattgtttcgatcatgtattttacatgcatacgtagcacacggtattgtaaatcaacaagcaaaagtgaaacggagtgagaaataatgaatttcaccttgtaggcttcaaccttcaaccaaaccccaaaaaaaatcgagcaaccaccccctccccccgcttccagctaatcgggcaagaacaagaggcgctgctctgttcttactcaatcagctcgagtgggatgatatatatgtagttggctcataggtgccggggttctacatctaaaactagcatctatgtctgagaggtaccaacagttagtacaggggtggaggtagaaaggtgttggctcttaactaaaatccagcacttatctctttcaccataaaggtgtcggttctagggtgggccctgcgccaactaatccgatgtgatgggaaataaaaggtgccggattttagagaaaaaaccgacatatttctctaacagggataataggtgccgattctatttaaaaaccggcacctattaggagagataggtgctggttttagggttttggtaggctggcggagggtgtgggcaagataagcactataggtgccgaatttacctactccagcacctatagtatcggcacctatttgatgttatgtagtagtgaggggcaacacggtggagggagcggagtatggcgtaacagcgaagaccgctcctccctctaggtgcaacggcagcggcacgatgaagggtcctctcctaccactgctcgtccactccccctcccttccctctcccaaatcttgctcacgctctctcgctctaccagatcttttggtcgaagggggaggagactgcattgctcggcgaccgtcctcggtagtagcggatccaaagagccatcgtgcttggcaacagcaaccgccccgtctctcccactctcttcccctttgccgttgttcatgtttgcatgcatgcttggcgacaacgacctgatcattgtatgttgatgtttgcatattcattgatgagctacttgc

SEQ ID NO: 60741 - DNA, 1561 bp, Oryza sativa
ttagctggaagtcccttctgatccgaaccgttctgcaagtagtcaatagcccgcaacatacccgcatgacgatcatgtataaggcaaacgttgggcctcatacgcaccactgcaatgtgcactctcttaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcattaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttct

SEQ ID NO: 60742 - DNA, 702 bp, Oryza sativa
ttgcagtctatggagattttgggtgaatcttataggaagcttactaaagacctaggagtatgacttatacgctccacccaaggggtagtctacagtcggtctaggaccagataagactctgagtgaaacttgcttgcacaagacttgcaattcaaggcgtagtccattgttcaagttgtgagtaagtgtagcttggagttctaaggggatgttcaaccttaatcggtctccatcgaacagctggtatataaacagtacattggaaaaggcaaatctacgagggattttgagatttggtgggggattgttggaattaatagatgggctaaggcccattcgaagattaattctttggaaaatcacaaaaacccacctcatgggatggcatgcatgtggagtttagtacaaccttgcttattctaggagagggggacctccttaaaagggaggatgccctcctagccacttgaagcatgtgtggtggagagaagaggggaaacacgcgcgcgctcactcgcctcgcctcgcctcgcctggcctggcctggcagggtagggcaagcggcgcgtgtgcacgacgtacgcgtcgaatggtccgcaaaattggctcctcacccttgcgcagatgcagcctccttttgcagttttgttttgctacgggaaattcggatttgttttgttttggaaacatttcaaaaaatcc

SEQ ID NO: 60743 - DNA, 2232 bp, Oryza sativa
cccttgcgcagatgcagcctccttttgcagttttgttttgctgcgggaaattcggatttgttttgttttgccttttgcagttttgttttgctacgggaaattcggatttgttttattttggaaacattccgaaaaatccggtgcgtgaaaacgtccttttgcagttttgttttgctgcgggaaattcggatttgttttgttttgccttttgcagttttgttttgctacgggaaattcggatttgttttattttggaaacattccgaaaaatccggtgcgtgaaaacggcatggagtccggataggttacgcgcgacttatccggttcggtttacgcgggcgccctgatcaggcgatctatctctatataaaccgagccgccgccttcacgcaacacacgcgaaatcaatctagggtttacctcctactctgtactgcgccgtcgctcgtagactactctatcccgctcgccgacgtgcaccggtgatcgggatagcaggtctccggaacctctgccttcgacgtcctgcaccgggagaagacggcaataaggtttttggaagcgcttcgcgcgactgctccctgttcgtccgcgacggctcgccttcctctccgctcgcgtgcttcgcgccttcgtcgacgctcgcaaccgcgagtagttcctgccgagcaaccggtctttccaccacctcggtacgtgttcgacatgttgcgcatatttgatatgttcatgttttactgcttagtttacatgtgtagatctaatgatgcgttcaatctagtttacatggcttctgcatgagtgagagagtttatcggtgtgctgcagcccatgtgttcatggttgttgatgtggtaaaaaaaaagtagtttggggtggttcaaattgcaatgcaaacaaaattaactaaagatgaggtaaactaatgatggtcaaagtgaaacttaagcaataaaagtagcccaagtagcagtacattctttatttttatcaaaataacagcacaaatagtttgaataaagtcctagataaccaaggaattgaatccaataacatttatagtcatggtgcgtttttataccatagaaacactccattccatcatcgtcactaatctttaaaaacacatccctctcaataaatgtgaatggacaatgattcaagaatcaaattcctgattccttgctaaaatgaaataaaggattaccatgttgtttcggtggcaatgcccaaataaaccgtggatcagaacaccgccaccttgtgatgatcttgacaaggaagtttttggtacaacaaccaaggtgacaattggaaatggtagaaaagcatatttctgggaatccaattgggtgggacaccagtcgctcaagtacctcgcaccagcgctatataaccactccaaagggaagcatcgaacagtctgcgatgcactaatcgacaaccagtggatcagggacataaggcacgagctgaatttggcactagttcatgaattcatcaaagtctaccagtagatttgggaaggtgaaattaccttaacagataaaaccgaagacactattctttggagatagacaaacaatggcaaatattcagcaaaatcagcatatttgggtcaattcagtggcagaatcggatcaagagcagccaacctaatctggccgacctgggcgccgtccaagtgcaagaacttcacatggctgttgctgcaaaaccggatttggacagcggatcgccgacaacgccggcaatggcccaacaattatttttgtcagctttgctacagaaatttagaaactgcacaacacctcttcaaggactgctctttcacaaaggaagtgtgggacaaggtctccttaagactaaaccacaatcacatccctacgccacacaacgacgacgagactctgctggattggtgggaaagaagagctaaccaaaccgaaaagggcaaaacaaaagggatgtgctccctttcacatgatgataaattgggagatttggtgtgaatgaaaccggcgagttttcaaaaacaaagaactcgcaatgccacacttgctgacgaagatcatggatgaaatcaacaaatggataggatgcggggcaaaagatttagcgagattagtgctgtagccttcccgtgatccttgtagctctgctttcctctctgctccctcttggctatgcgtctcctctgttttttcttttggtcctttgtttctcaccgtt

SEQ ID NO: 60744 - DNA, 718 bp, Oryza sativa
gcaggggcttacgacggcgaggaagcggcggcgcgcgcctacgacctcgccgcattgaagtactggggccacgacaccgtcctcaacttccctgtacgtggcatacgcctctccaaaaatccatggcatctttctctgaactgaatcctctgcacaagcgttcttcggaacccttcaagaaatgcacgcacagtgcagcttgtttgattctgtttggttttctgaggaagattgttgctgtttttctcatgttggaactctctgcagctgtcaacatatgacgaggaattgaaggaaatggaggggcagtccagggaagagtacatcggatcgctccggaggtaaatattcagttaaccccatgttaccactgactttcaacaaagagaagttaattcagatcattacaaactttcagaaaaatccaaatcaaaacccattgaaatatgcttctctgatcagacatagtgaaatattcatgtctgagaagctgtgttttgaagtagttcttcttgattaagatcataaacctttttcaccctgcaggaagagcagtggcttctcaagaggggtgtccaagtacagaggagttgcaaggtagttaatcagtactaatctacactgaaggttccagttttctactgaacattgctagtagaatcagttaattaacagctgttttattcaggcatcatcacaacggcaaatgggaggctcg

SEQ ID NO: 60745 - DNA, 1094 bp, Oryza sativa
gttaaattgactcgaaggtagaattcgctatggattccaaaaattatcccagccagcaaggcctagaatgtgatcatggaacaaaaaaaaagtagtcctccgcatttagagtcgatcaacagttatgaccaattgaccacttgactaccagctcagagcaacatgtgaggtaccaattttagcagcattgtagttgcaacaacatgagcaatcaacaaattacaattacttgcaactacacaagcttttatggacataaatgaacatggatatgttagcacatatgatatggcaccaaagatcttaagcacaaacctgcctctgctgctcagtcataaaagaaccagacagatcccgcaagatgctcaagatatcatcaaatgccaccttcccattgcagtcagtgtcataaaccctgaaaataactacagagaaaacatagcatatttctcagaacatctagacatccgggacagaaagcaaatggagaatttaagtacgaactgggaacccacattcaattttttgctgcaggcttgcgcggggactaaacgccgataagaacgccacgaactccttaaagttcagcccatcgagcatcctcagaagcctctgacagagacatcgcatcgattaacaaatagcattcctcaaacatctacccaatcacccaattcattcctttcctaatccctcgttctcaatacagaataagaaaaggtattgaggaacaggctagttatgtcttgtaacctgagagagagggttcacggcgaactcggggacggtcatgaattcctcggcggagacgaatccgcccccattccggtcgagctggcagaaccggtggtacagcgacacgatctcctgctgcgagacttagctcccaaaacaccccgaatcagcaggtcagatcggaggggaacagcggcagacagcatcaatcttcgttgagagttcagaatccaatcgaaagagagaaacacaagcgcgcaaactcacaggcgtggtcgcagtggtcctggacctcctcgatgtcgtatgcgtcagcatcgacgaggtgctccccatctcggcggaggagacggggatcc

SEQ ID NO: 60746 - DNA, 730 bp, Oryza sativa
attatatctcgaaaaaataataaaaaacatgggacccacatgtcagctaaaaataataattttaaaatggtggccccacatgtcagctactcctcccttcttccccctcccttctctctcatattcatcgtcctctcttcttcatgtgcgcagggggaaggaggcgaggcgaggcgacgggaccatcccccacaccgacaccacccccagcgcgccgccaccgccggcatcttcgtcttcctcctcgccgccgccgctgccgctgccgccagcatcttcgtcttcctcctccgccgtcaccgcctacatcttcgtcttcctcctcgccgccgccgccgccgcagcaaccgcagcaagcaggccggcgacgacgacgtggagatggccgaggggaggaacaacaaggtcgccgacggcggcagcaccgatgactcgacgaccagcggcaaggcggacaccaaggtgtagctctggcgtctcaatcgatccatgagcgatcgagtagctcagtagcatgcaatcggctaagatttcctgcatgtgttctagtactacaagtaataatattagctagctaaaaggctaaaacacataacgtgcatgaaaggaaagtactatcctaactgaataaaacagcttttgcaggcacaagtttaacataatatgtctgctttgatctttatttggaagttgtaattaaccatgtttgtaataacgagataattaaacg

SEQ ID NO: 60747 - DNA, 1286 bp, Oryza sativa
tacacgtcgttatttcagtagtacgtacgttggccgcgttcgtggtttttgttcacgatgcagggggacgtacgggttctgtataccctacgtaccttgctggttcaaacatagcaactgtatgcagcatttatactcacaagcaattggcgttttgttgtcttgtgctgcgcattgagaactgaaattgtttggagcaaattttgttgaaacatttgttacgcaaaaaatttatgaagggaagccgccgctggactggcagacgaggaagcggatcgcggtggggacggcgaggggattgctgtacctgcacgagcagtgcgacccaaagatcatccaccgcgacgtgaaggccgcgaacgtgctgctggacgagtgccacgaggccgtcgtcggcgacttcgggctcgccaagctgctcgaccacggcgactcccacgtcaccacggcggtgcgcggcacggtggggcacatcgcgccggagtacctctccacggggcagtcgtcggagaagaccgacgtgttcggcttcggcatcctgctgctcgagctcgtcaccggccagcgcgcgctcgaggtcggcaagggctccggcgtcatccagcaccagaagggcgtcatgctcgattgggtaagcatgcacttccacatttcttctccaattttcagctttttttagctgctgtttgagccgtgatcgaaaagatgttgcactagttcttgtttgacgaattaaaagcctcggttgctttgatcgagcccgtacgtgaatgtctttggtaaagttcgcaaatcttttgcgaaagatccatccagtacactagcatgtgcgttcattgcgcgcgcggtcactggctcactgcactttgaggcgctgctcattcaatagcaacttctagtgaatctgatgctcgaatgacagtagtcagtaggcgccccaactgtcagtctaagattaattgcgagtactatgaacctgacatactaacgcaatcctgcaagcattgccactgcatgtttgaatgctgatcgtcctcccacgtactgttcactctgcatatggcatgcaaatgacttgcttctgaaaaatgacaatgtcttcaactacttaatctccatgtgtaaatgatctgaaaattttcttcttttttgttttcgttcgatcgtgttatcaaaatgaaggtgaggaaggtgcaccaagagaagctgcatgacttgctagtggaccaagatttggggcctcactacgacaggatagaggtggcggagatggtgcaggtggcgct

SEQ ID NO: 60748 - DNA, 3716 bp, Oryza sativa
tacagttcatcaagagcaaattaatactttaaattggacaaatgaaaaaaaaacatacatgtagattttctccaaaaattctttttttttaaaacaatcagaacaagatgagggcacgatgattcattgaatagtgtattaaaaaattgcaaggtcagtaccttagaaggcagtaataccaggaaaaaataccaccaccacacatcgagagcacctacacaaagtcaaagagaaggctagcacctgatcgaccatcactaaacgtgatcggtcaccgctagaccaataaaggaaggtatagccaggacggctcaaaaccaatccctagactgaactcaactctagccacgcctttgaaattgaggaggagagggtgagagaaaaaaaatggatccgctctccccctatggcccgtcaacgtggccaacttgcataagctaggacacagttgcaagaggataaaacaactagaaagagcttgcatcagctgccagagggaagttttggcaagggacctagatgatgtctccagcgagatgaacgatgatgagcaccaccgtcgccgtctattgaggtctcaaggaggaccaagataaggttttcacctggtagtcctaccagagtaagccatgttcttttttctaacaagagttggatgaagattaaaattttcgtggcacgtttttcaaactgctaaacggtgcgttttgtgtgaaaactttctatatgaaagttgctctaaaatgtcatattaatttatttttcaagtttgtaataattaaaactcaaccaatcatacgttaataccacctcgttttgcgtaaaaaaacttaattttcatctttatttttaagagaaaagaacctgctttaagttgcatatcttggacgatcgctacttaaaaaaagaagaattttcataggccctaccttggaggcttggactactaatatgatgctaaaagaaaacaacgtacattaatttcgcctacaatgatttacacaggcaaaatgtcttaggcaacaactcacattaatgtctaatagcataggtgtgccacaggcaaaatgtcttaggcaacaactcacattaatgtctaatagcataggtgtgccacttaaggtaatgcacgtgaaaattacacataagatggtcataaagaggcccgcctagacgaatgtgtatctgtgtatctttagacaatgctcctaattgtccgtccatgacttacacctttttattttcctcatgccactacttccactacctacacttccatcagtgatcacgactgggcttctcaaaattcgaatcacccgactcctctattgccacgccacacctcctcgcctccaactctttgcctattttccaatacatagagtgtaatgcaagtttttcgccgcaatatctccctctctctgcattctcttctatctctgccatattgggttcgagatgccaacactagtatgtcaccgttagcaaatacttttctctgtctcaaattatagagcactcctgtttctatgaaaatcaaactcgttaaattttgactaacaattacactagcaatatttatactaagtattatgcatactatatatttcaaaatattttatattatactaattttatagttattgataacataatattaaataattaataatcaaattatatcgttgaaaaccatgtaaaaaaatagatcttataatgtgatataatgtgagatagaggaagtagaatgtaaagacagagttgaacacaagaggaccgcctcgccccaacaccatcaccatcacacagaacatcgaacggggaactgacgagtatttcttcaacgggtcgcatatgctcaacttggtgtcacaattcaacaagctgaaggtgctagcaaatcatcaacacaaagttcgtttgaggcaaagacatgtgtcttttggttttcctcggttcatttccttgtggatgtaatgttcgtctgaattcacatatgaaaagagagaaaaattacaccgttggtgtaatttttagttgaagttagttcgttgttctctatgttcaggaggggtactgcccctgttgaatgatgcccaataaaatgtgattaacaactgagaagacatgaccaacagattaaccactacttttcttttagttattttgcatgatgtttgtagttcagtagattgttactgattgcttggtatagttatcaactcacaggggtacatcttcagataattcaaaaatcatacaaccatatccacaatttcatatatatgcataaacaaattctatacataaaaataaaattctattatgaattattcatccacataaatgtgtacatcgataggcaagcgcgtagcgcttattaattagtcattcatcaacacctacacacttatttatgcatacatgaataaggtgatctgaacacatagaacacaaactacacaagctaggaacacacaacaatataatctttggtaagcttcacgcgggtcgtgacgagcttacttgccatggccactgcccgcgtatgagccggctctggaccctgcatacgagccggagccggcaccagagcctccatgcgggccagcaccggagcccgcgtacgagccggcttccgagccagcgtacgaccctgcgcctccgccgttggagccggcatacgagcctgcactggaaccagcgtacgagcctgcgccggagccgccatctccaccattcgagccagcatacgagccagccctggagccggcgtatgaccccgcaccacctggccccgcgttcgagccggctcctgactcagcgctcgagccggccgatgagcctcctccacctgacctcgagctcgaacccgagcttgagccagaccacgaacctgacccagaccctgaaccggagcccgagcctgagccagagtaagacccggagcctgagccagagtaagacccggagccagagccgccgccaccaccaccaccaccaccaccaccgatgcccactccaatccccgagccgagtcccaggccaccgccggtgccgacgcccaatccgccgccaccgccaactccgaggccaccgccgaggttgacgcccaggtccttccttgcagcgcggccctcagccgcgagaacggccgccgcgaccaccgcgacgcccaacacgacgccggccttcacggaagccatatcgcgcaaacgcagacactctagccgtgcacacgcaggtgtctcaacctccggtgaccagtgctcctctgctgtactgctgtgtgtggtgtgatgaactgatggcttgatggattgatgagttcgtggtgggatttagcggtgaaatttatagggagcgcgcgcggttgtggtggtacgcatgcgtgcggtagctagcgcggctcgtcgtgtcgtaaggttttagtgggatttgcgtcggtgtcgcgaggttgtggccgcggccggcggagggcgtcgcgtagtggagcaatccggcctgtcccgcagatttgggcgcgctctcctcagcaatccgagcgacacgtacgtaaggcagaccggaccgagctgatcaacccatgtacgtaccgatcgatcaatcgtacgtcgatcattcgatccactaaacacggctagctagcttccaatcgattgaacgcacgagtgtgacgtattcgatcatgttggggcgtgtgacccaatgtaggt

SEQ ID NO: 60749 - DNA, 1418 bp, Oryza sativa
ttttctcttgttgtcaacgaaatccatgccacctggagtagttttgatttgacgaacaacgaccaaaccattagttctgcatatgggccgccaagaagcaagcagtgggccgagcttcaacttgacgggaaaaggtataccggaggtccctcatcttaccgccgagttacaaaatcgttcataaaccgaaaaaaacagatatatatatatatatgcatctcttaacttacaaaaccagatcactctaagtcgttagacggttttatccttggttttacctgacgtggcagttgagtcagcgtgtgacccacgtggaccccttcccctcctctcttcacctatctaactactgggtcccacaccattgttcacgctcagttgccacattcacatgccacgtgggcaaaagtagaaaccatctctttagagtggtaaaaaagagagcaaatctaaagggacatttggataactgccaaacttattagtgatgaaaattaaatttcctgtaaaaattagtcgccaacagctcatacacactaaaatgttactattccccaagaaaaaaggttatcgtcgaacacaaattgtgaatcaataataaaaagtttttataacatggccctggcataacccacaagttttttactccctccgtctcataatataagggattttgaatttttgtttgcactgtttgaccaatcgtcttatttaaaaaattttgaaattattattattattattttgacttactttattattcaaattattttaagcacaactttttatttttatatttgcataatttttttaaataagacgaggatggagggagtataacatggcattcatgaaaggaatttttttggcggggcatgaaaggacttcaatcttgacttacaaggacaatcttaaaaattgtagtaggtggtacgttcagaagaggtagatctctggtctctgacacgtaggtggtacttaaaaattgacgggatataaagaaacacgtatgaaacacgtatggatgagtcgatgcatgagcagagtattataaattgagataatttattgtatcggttttaccccgttatataatagacaaaatttaccacaggacacgtaaaaaaacgtgtaattggctgagagacaccgcgaaaatataatacggctgatggacactaaaaaagtataattagccataggacatcggtcgtattattttattatttccaggtcaaaagaggtgagatattttttaaatgcccatattgccccttctctttccttcttttcaccttcccgttgacttcgccgggaacgacacaacagccacagagagcgcggtggggtgaggtcagcacgacgagttgcgacgacattggcggccagggcggttgatggcatggcgccaccttgga

SEQ ID NO: 60750 - DNA, 1752 bp, Oryza sativa
caaaatatacctaaaacatccttagaaatatagaaggctaacaattaatttatcctacaagaacttaaaaaaatgatatttttaaggcctccttgcacaacataaggatttgtatttgtttgtaagtttcaatatttttacaactataacttatcttttataatctacatacaatactttgtgctcattttttttaatgtaaatcatcatacatgtgctatacgcaatatttgcatggtactatcttttgagtaaacaattcctcgttcatatgtcacacacaaataactttaaaaaataaaacatgaaaacaaatcttaacccatatgctaaaaattctatgcaagaaggctaaaaaattcatatttttaaaaaacttctaacgggattaatcaatctacaatcttctatagtgcattttggccatgtttgagaaagtatccaatcagacgatacattgtagaaacaattaataaacttgatcaatggcatattataaagaaggcaaagttgatggtaaattattaaaccaatacaatgtcagtaatatcctacttcacttcttcttacagtttcttaggacacagtggctcgcaactggctccaaatgttggagatacataaaactttttaagagatagctaccacctactaattcttcatatccttcagcacgaaatttggatctatttgttgtcgctacgttggagtattataatgtcactatactgcaaagcacaaccatgcctacaagcaacttaggcgaagaaaacaaagagctataatctagcttaccttgttaaccacgatcaactggtcagtcgagttactaattgctatcttcccggagtatcttccatgcttagaatttaaggtgtttaggagggagtaggatggcacaatgaataacatattgcacaaaatttccaatgtttgcattttggttctccacatttcaagaatgcatgggatcggaccttcaccaaattagtcaattttatcacagattcagtgttaatcagaaaaatatatggtgaaaccacatgtagggtgaaaattttgaactttcttataaagttttcaaaagaatcacacatatgtcggaaatatgtaaatagacaaccatgcaaaattgcagcaacaaactcaacttcatcagctatataatactagaattatcttagataaatgtgataatttttttaggcgtcactacaaattagaccatcatgggtgtacgaggtacagtagtatttaataattggtgctaaccaaagaatttctttttaaaaaagagtcagttttttaggctccaccccaaatgtacaacaaatatacacacggtctccaacccaaataatcaatacttgattttttttatatataaacatcttgtattatattatgatgaagatattttctacgaaaaatctattcattttcataaaaaataaatacccttaatttatatactgttggcatatataattaaatatataattaaggaagaaagttccactgaaaccgtacatttccaaacaagtaaattgcattagcggtaaacgaatttgttaggagggtgcaatctagcgcatgtcttgaaaaacgcttgttttaatgcacaaacttgtttggtgcgtgcgaaccaaggccaaaatcacacgacaaggtttgatcttgctgatttttttatttgaatgctatgtaaacatgtatcttagaaggattcaaggatatcatgtagacaaagat

SEQ ID NO: 60751 - DNA, 4997 bp, Oryza sativa
  unsure (1)..(4997): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctaaaattagaacacgataggattgatgattcatgcaagacagcaagacaacatttctgcatgaccaagtttgctaccaatactcaagaagtcaagaatcattagtgtcagttggtatggctgtctacaggtagtgctacatggttgtctacttgtctatactacagtataagggacaggggcaagaaatgatgttaccatttagcatcacaagtgctagccataacccattcaaatcaaaaaagaaagaagagtgctgcactacttcgagacagctagagcatggtattctgtagtgagggctccacaaagagataccatgttgcaaatctggaatactcgaacaccaaaatttgtgtggtgttctaaatctgaaatattaccaactgactttgggactgttaaaaatcactactactttggttggtttttgtaaggtggttaacactggtttaacactctaggacaagtatgttctaagctctaactaataaatcacaacatgaatatgttcttttgaaaataaaagacatacttatccttattctggaaacatgttccataacttcaaaaatagatccactagcgtatccaaacctctgagaccagtatcgaccaaatttccatggtctatgtttctatgtacaggatagggtaagatgcttcatttgtcatgattcatcacattacgctgctagctcatctatggtaggcttggtagcataagagttgagttctttcttttcttttattttatttttaaattttgtatcattcttaaaatatataaattatgatgatcattggtgttttttgaaagaaaagtcactttttttttgtttggtttaacctatcagagctgggagaagacagttgattgctacagtcctggtcagggattgatgcctgctagtttcaaagttagatccatacctctagatggaaacagtgaagcatttgaggaggttcttgaccctgactttggagagtcagccattggacgtgtagcaccagttgattcgggtgagtaagctagataggttcatattatacttttgaatatactcttactacttattacgtggatattttataccatcctctttttataaggtctttggtggataatcctgttgcgggcatatggtaaaattactggagactatgcactacaagaaagggttgatgtgcagacaggcatcagactaatcctgaatttatgcttgtctgatggatttgacatgttcccaacattgttagtcactgatggatcatgtatgatcgatcgacggatgggaatccatgggcatcctcttgagatccaggtaagctaatgcttgataatgattttgacaaactcagactttcagtaccagactggtgtttttcttcactgcaagtcctactcacaactcaaatgtagtggtttttgacctagtggtatctattttgcagtcgctattctattctgctttgcgttgtgcccgtgaaatggtcagtgtaaatgacggatctaacagtttgatccgtgccatcaactacaggctcagtgctttgtcgtttcacataagagagtactattgggttgatatgaagaagataaatgaaatttatcgctacaaaactgaagagtactcccatgatgctattaataagttcaatatctatccagaacaaataccttcttggcttgcagattggattcctgaaaagggtggttaccttataggaaatctacaaccggctcacatggatttcaggtttttttctcttggaaatctctgggcaattatctcttctctagctactcaaaggcaagcagagggtatcctgaacctcattgaagccaaatgggaggatataattgcaaatatgccactcaagatatgctaccctgctctagagtatgaggaatggcgtatcatcactggcagtgaccctaaaaacacgtaagcaactgaaaaactcttttttatgatgactacatcatttgttatgtgcagatgcagatattgaaacctaaatttgtcaggaagtattattagcattaaccagatttgcattgcttcagtatttgagtctatttttttatacctttgttattgcatacaggccctggtcgtatcataatggtggatcttggcctacattgctatggcaggtaaaaatctaaaattgatatatcactaaccttgttaacgcttccattattttttccaccgattgtatgtttaatcatttgtatttgttaatttagttcactctagcctgtatcaagatgggtaggcgtgacttagcacagcgagccattgaagtcgcagaaaagagactctcagaggacaagtggccagaatattatgacacaaggacaggaaggtttattgggaagcagtcaaggctatatcaaacttggacgattgcaggataccttagctctaaaatgcttttagactgtccagaattggcatccatattgatttgtgaggaagatctcgagctgctggaagggtgtgcatgcagtgtgaacaagagtgcccgaaccaaatgctcccgtcgtgcggcaaggtcgcaggttcttgtgtagtaccacaattggtgcttgactaccaagatgggcactgcacattctacttcgttgtattttttacgttgctctagttagcatagttacttcaccagggtggccacctatgccggttattttggcaatcttgtggttaatccatcgataacgcttgtgtgtacattctaccaaatcatgattgcatactacactaaaagccgatcaaaagttgattggccggttgtaaactgacaggatgtaaatattgccactttgtaatcaatatatgggagaatgtttctgacagtgttcttgctcttgcctctgataagaatagctggtgattcttatttcagctgactgagtccccagaagtgatgagggccagacatgccgtccagctgttgcatccagcattgtttaggagcaagcagtcatgggttaaactgtcaggtccgtatattcataccaattaaggtcttcttcccagccagctaatgtgtgtgtcctgtcctgttcaaacatttagtagtaaagactcgactgcagtcaagatctgaaattgctcctttttttttcactgatgctccctctttaacatccctgattgctccatgcatcctctgccacttaaaagaacaggtaaaaattcatatctggagtacttactgtaattgctgctgcaatctaatggctttccgggaaaaaatcgcattaagttaaatgctttggacatactcggtcttaatttttctctgcagtgcgtatagagcatttaacttctgcacaaactgacttgacaaatggtgaccactggtctgcctggccacttttaaatgcacttacattgcacggctttcacttaatatgtaggtgttttgttactgtttgttgatcagaagttcataacacaatcatggctttgcatactactagctatagggggtaaaccctttcaaaatgcactgggagggcacagttgctaccctgctgatctactctgtcatttatgtctgttcacatcacccgtaggagccaggcggttcctggaactgcgaggtctcccttgcagaaacaaataagatccaagcaagatctttagctttgcaattggtttgttttgaatgaatggtagcgactctaggaactgcaatatttatggtgcaattttatgatcatacgttacccattttatggtcatttcatgatgcatcactgggctgctctgcaggatcagctgaatacagtggtgggggagcagaagagcattcaacaaaatctggaggacgttaagaagaagaaactaaagtatggtaagtctttgaaagctagtgccatgaaaaataaagataagacattgatgcaagacttatactgtatttaatggcatgtttagatccccttgcaaaaattttcaccctgtcacatcgaatgtttagacacatgcatggagtattaaatataaatgaaaaaaataactaattacatagattgcgtgtaaaattgcgagacgaatcttttaagcgtaattgcttcataatttgacaatgtggtgctacagcaaacatctgctaatgatggattaattaggcttaataaatttgtctcgcggtttacaagcggaatatgtaatttgttttgttattgtctacgtttaatatttcaaatgtgtgtccgtatatccaatgtggcacggtaaaacttttcacccctggatcttaacccctagatctaaacacagcctactttaaaccatagatcatggagtgtcataaattagtctaaatcgatgtcatttgaggagggtttgttttgggggctggtgaagtttgtaaattagtctaaatcgatcatgaactgaacctaccttattgatgtctgctgccaagagagtgtgaggctatcttttgagaacatgttgcaagagttcacttttcaaagaagatgcaaaagatatggaccattaaatctcgagccgtttgcatgcatgcattagattttgactagtcgggttgctgcggcagtaataccctccagagtcttgcatgctttcaatgcctgttctgagtctccctgttgggcaaagtttaaaatgcagtagcatttctttttcttcgctactaaactcgtcactgctcctgttcttg

SEQ ID NO: 60752 - DNA, 990 bp, Oryza sativa
accaggtcaacactgccacgtgtgagtcatgtcagcgaaaccgccctccaaaaccaccaaaggagtcaaattgcaccggttttgcaagttcgggggtcaagattactgatattgcggttgagggatacgatttagattcggtggtcagttgagggagttaaagtgatcttgttccagtgagagggaaatcacatgggctgctcaccgtgtgatgatctcatcaggataaggcccaggataagttactcggaatgctcgtcttgaatgcaatatattgggaggccatggaagtgaatttttgtcccttgaagggacatcttctcgttttatacatgtcgttaaaaaagttatcaaaaaaataaaaaaaattattaagatagatcaatatatgatatatcttgccgcaaacatgcgagttaaaattcgacttatacaattcgaaacaaaaataacaaatttgaccgtgaattacgcgttcaattcatagtcaaatttgttatttttttgtatttgtataagttgaatttgaattttcatgtttatgaagtgacatatcatatattgatatatcgtactaatttttttaaaactttttatgactttttaagtgacacgaggggatatcccgatttgagttttccaggaggccatgcagaatcgcagatacacatataaaaagaaggaaacaatgaaaacgcacagacatggttaaaaatgcataataaatgaatcaaacaacaacaataacaataataaataataaataaataacacaatttttcatactaggaaatctggtatacggatgaattggactgtactatatatatatatatatatatatatatatatatatatatatatatatatatatatatatatatatatatatatatatatatatatatatatatgtatgtatacgatacacgctgtctccctcccgcccgcgcgcgagatagacacatacatacacacacgtgcgcgcgc

SEQ ID NO: 60753 - DNA, 15369 bp, Oryza sativa
tgtcacagactaggaattcctatagggttcaaaacacaagcagtttatacgcttggatggttcataacaaataaaatatagaaactttggaggaaattgttttgtggaagagagatactagatagatagatagatagatagatagatagatagatagatagatagagagagagagagagagagagtgagagaggggctgtgtttagttcctgaaaaaagctggaagtttgaggaaagttggaagtttggaaaaaaagttagaggttcatgtgtgtagaaaagttttagatgtgatgtgatgtgatggaaagttggaagtttggagtagttaggggtgaactaaacacggccagagagagagagggaggtagggaggtagggagagagcatgggacttctcaaaggaaaataaaaagaggtatacgagctcatgcttagatttctatggaattgagacataggaagcaaattcgtagaactttatattccgttgttccaaaggagctcgtaggaaaaattttccaaggattattgaaatcctccaggttttctttgaaattatttcagtccaaaggaaccctaaagtttttcctttcttatttcccctatttcttttaggtatttaggaatacctgttcccttcattcttcttttattattttttgattgaatacctggacaactcttggtggtttccacacaggaaagtgaagtctaaggcaatgatactttcatagcctttgagctctgtgctattttagtctcttacactacaatcttacccatgtgaagagcaccacaattcaaccaattcaatcagtccatgcagtaacggcatgcatcaataaagcatgtgttagtgttgtagcattctgcatcctcccattttatgtaacacccattattcatggtagcaagaatggaaggtatgcatgcatcttgtgctgtgaaagaacggtaggttgcttcattcatgcctttcaatggctcatttactgtacagacttgagtgagagtgccctgccaaattagacgtacctgtctgatctgccactatgataccaggcttcaatggagtagtacactaggggcagactccaaattactgatacattttttgtagtagtagagtagagtagcagactagtagttctgagaactgaatgcagatactgttgcaaattttactaagtgcatgaaagtatttatactcattggtgtcactgataatgacttaattaataatgggctaatttgagtattgccaacagtacagatgtaagagctgctttttggcattttgctctacgcgttcccgttttctgaagaattcgtggtgtcaatgattaatgaattgactgaaaagtgttgtggagcaaccttccccacttctttcctaaagtgacgtgagtgtgtacatattgcttggtttcttgtttaagttgtccgtatcttgtctctcttctgtttaagtcagaacagctacttgacactttctgtatcactattacttgcatgcatggtattatttcagacctccctgttttgctgcaacaattaattaaaccttcaaaatccctattgattcaaaattttagagtaatcaacgcttctctaaaagactaaaacttggagtagctcatcccccatttttaacttaaaaaatagatatccaccattttccctatcatgcaattgaacgcattataccgttcctatgagtaaatagggtattcatttctaatattatagtgacacaatactttttaactatcttaatctcttctgcacgatttaattaaaactcccatcttatggggtatcatttccatggtgtaataactgaggataagttagtaactttaaccaaattttttttatgtttatgcacggctctaaaacatagatcctttggaaccaatttggaattggaataattgggagtagaatttgtgtagcagacacggtagatcaaatgccaaataattaagtggtggcatttaagatttgtaaggataaatacatgactagatggcaatgttttgattcatcaactgtaatcctgctataataacgggaggttatagattggactgctcgatataccgtgactactctaaatttccgatacatcttactgctatatcaattgaccccctgtaatgatttgcatgctagaggtacgtataacatgaatggctatatattcttttttccttagactcttagctgaatcggctgtgtttagttcacactaaaagtttatgtgtaagaaagttttgatgtgatgaaaaaattgaaggtttgaagaaaaattttgtaactaaacacggcccaatataattctgctaggtcaggattgtgctgctatctcgaaggtacggtagtatcagtatttgatcaattctttattttatcgcgagtacacttgttccctaggtcgatctatatattcatataaacttcgtctcagtaggcctagatgtttagtaaatggctaattaagccgcgaactaaagcgatgatccatgtaattgcaaaataaaaaaaaactcgaagtatatgggcgagaaaggacaatatcgagtagtacacagtcgagtgctgtgacaaaagtttgagacagaactgaaccttctgtagcggcgcataacaaaaacgaaatgacagcacataaaccgtgtattgcatatgcagtgttataacgagtacgagtacttgttcccaacagtgagcaaggcggcaaagatccaaatcgttatcgagtggcacacagcgaacttattccgttcatgatgtgatacatgtcaagctaccttacaggtagatttccagcttcacatgtggtaacaggaaacatccttaggtctatcagctgcactctgactgcagaaatacattatatcacgcaagcaataataatattacaaattatatcacgcaagcaataatattacaatttacaggtatactagaatttcacaatctcttcgtatattgctaaacaaaattaattttcttttaaacatcgagaaaataacatagaaagtgatcaatacagctcaggagggatagaccgagagagaaggcaagaactaggagaaagatgggaggtagaaagaagaggtggatgaaattgaaaaataagaaacaagaaaaacaacacaacgatgttgggtcttacaaggtcaagaaaaggtcttgcaaggtcaagaagaccaattccttttaattcccacacaaagtgatgttgaggttttgaagaaggatgtggacggtggctagaagaaaagctcagttaggataacaccgtgctattgctaaacatgaaccatttttatggatgcttctcggtgaagggagtcttgatagaacaacaagtgtctacatggcttgagttttcctgaactcatcatctccacctgatagacagataaaaagaagatcaacacaagagatcacaataatagctagcgctagcttgagtgcgcaagctcaaacataaagagatatagcagataactcgctgttcttaccgcaacggtgcatagctcctgatccgtatcttccatttggctttcagtcacgaacctgcaggaaaacggcatcaagcaagcttagcaaaacgcagacacaaattgactacaaccaagtagtctcttcttagaagaaagaacctatgttgcaccagtacacgaacttaaccaaaccacacgcaccaaagtagcagcttgcagcgacgcaggagaagctagctcagcttctgtcaaggcgtgtgcatggggtttgcacggtgaagtggtggatatagaaagtgtagctcttggctcaggcaagagagaaaggtgagcgaggaggggtcatggaggctggagaggggggagggagtgcgcgtgtatatatggggagaaggtagctgcggagcggatggagatttggagtcaggaaatctttggggagttaagctgggatttgatctcaggcttttccaagagatcgatgggctatagctgggcgctcgcgctggcctagtggtctctagcgtgtgagcttcccgagcacttggtatgaatagtccgagagcaacgcaagtgcagtaaaaaagggccgagcaaggcagctgcttcggttgaagatccggggtgatccggtcatatggttggcgttggattgggcacggttaggttaaatttgccgcctcacggctcacgctctcaatcataaaatataacaacgtttaactataaatctggatacacagttacgttaatattttagaatgaagggagtactattaagattgctccacctaggtcatgtttaaaaaaatacagaaaccttaacacaccgacgtggtcacatctggcccaaaccagcaccgcaactaaaaccggggtaattaaaacaatacagtcaccgacgaaaaaccatcgcatacggcttgaccggtggtaggcagtaaggctgcgtttagattcaaagtttggatccaaacttcagtccttttcaatcacatcaacctgtcatacacacacaacttttcaatcacatcatctctaatttcaatcaaaatccaaactttacgctgaactaaacacagcctaaactaccctcccccgctgtagaaacgtcccttctcgctgtgtgacgcagtgaaaccaaagccgcgccggcgccgccccggccgttccatccatccatccatccgtccgtcccgtgccgccgttcggcaacggaaataaaggggccccggcccccgtccgctccgcgcggcgtaaatgggcggatccgagcgccattcccgcgaaaatattttgttggaatcccaacgccgaaccgcatagggcttcacgtgcaccaccaacaccaccacttgctcgtgcaccacccgattataaaaaaaactcatcctccctagcgacgactactccgcccgcgccaccaccatcgtgcaacgcatcgctcgcgcggggcctaatcaccgaggacaccgagcgcgagccggccgggcggccgggcgcgcggccgcctgccttcgcttggtttgacctgcagatgcacacgcacacgcacgcacggtcgcacgctccaaccaaggcaatcgccatgcgttaaccgatggagctgcctgccagtgccagtagcagtacagtacactagtagtactagtgccattaattttagtggttagtcaccgtctactaattaagaaaaagattgttttctggtttagcggtttgatgctgtctggttgcggccaagaacgaacaattgggcagagtgatcaatcggggctcgagtgggactcgatctctgagactgtgcgaggcatatgggccttggaatgaacgagcagcatgcatgtcctacatggctagtacacggccataacatatgtgtacatgtcacgtgatgtggtggtagcgacgacaatggattgatcatgcgaccttgcgacccggaacgcattccacggtcgatgtgctctctgtagcctgttctgtcacagtgacactgcgggccgagtagtactgggtggtaagactgtacgtgtacggtgtaccgtagaggtcgcattcgcatcgcacggcctccgaaagttcggtcaaaactgggccggagaacatgggcttctttgggttggggaactgatcacgcttctagtggtggcctgtctcctttgtttgtactttgtactaaacgagatagaggacaccggcctgaaatgttggaaacactgatggtctgcagtttgtgattctgacaaccgcagcctctctcaaaataaaaaacttcttcaaacagtgtagtttttagtttaaattataaaaagttgtagttatggaatccagaaaataaacttaaaagcaagaaactggtttttctagcttctccagctacttttcaaaatttaaaactcctcaaaacaggtcctaatgtgcccgtacaactctattgatctacagtaggaatacaacatatcctggttttctgttcgggccagagctgacgatttttgtagcattacgagggtttaataatgtggtctttgatgcacgagtctgaaatcaccaaggatgcatcagacagttcgatcttacatatacatgtatttggactgcacacatcgaaagattttcagacactctgatgcatcctttggcgataattaaatggaatgggatcaatgtcatcaagatttttagacagatatccacggacgttcaggcaagttgatcctatctagtagccagattatagacagactggtgctccttcggtggtaaaggggatcaatgtcatcaagatttttagacagatattcaaggactcttctcgctaagatttcagtctcagacaaatattcagacaaactttttaacagttcgatcatccccaatagccagatttttcagacttgctaggtagtagtaatcgctaatacttggccaattaggggcttttcctacttggctacttgctaccttcgaaaacttataatttgaacatctaacttgacgatccatatggattattcccctaaatccaaatactatttcaagtgaggtgacaataggcaagtatcattccgtttccctgtttgtgtattgtatctgcgaacactgtaaagattgcacctgaacatacatcggaacaagttcactagcacatgaacagccatcgaaaactggtgcattttaactcatgcatgccaatgaggtaaaaattttctggatagctcactgcaagaacaccacattggtgatgtccgggaacttctccttgatggccgccttgatcccgctcccgatggactcggggccttcgtacctcaccaggcagtcctcgccgtcgacggcgaccacctccacgctcccgccgtagttggcgatcgccggccgcagtatgtccaggtggccgttcaccgcctgcaacatccagccaatgagcattggtagctccaaatttacagagtcttggggatccttggcaaaattatgacctggggcgttggctccgccggctgctgatcgtcgtcgaacacctggcggatatcttttacggcgtcgccgaacttctccttgagcacgcgctcgatgcccatcttcatcgtcgtcgtcgagctggggcagctgccgcacgctcctggatagatgccgtagcaaaaccacaaattagtaagtggtaagcatagcaagatttggtctcgcagccatgattctggccaagaattggtgacgcgcgcaaggggattaagaaaaatctaggggttcaccttcgagcttgagggagatgacgccgtcctcgacggacgcgacggtgacgtcgccgccgtcggcgatgaggtaggggcgcacgtcgtccaggacgcggtcgacgttctccgccgtcagctcgtaggtctccgccgagtacaggccgcctcccgccgccggtggcgtggacgcgggggccgccgcaaggtgggcccgggcgccggaggtctggatcttggagggtccggattggagccgccgagggggcatcagaggggtcgcttgggtgattcgaaggcggatttgcggccgcagagacaaggcggccgcgccggcgccggcgacggtgagtgacgcctccatggcttgtgtggagtgtggtcgcgtcgatgtggtgggtggacgccgatggcttcgtgccgtccacgaagttacggttgacgaaggaagaaatatcaattaaatttctggctcaggtcggtaatttttccctgaaaaaagaaaaacgttcctatgaattgcgaaaacagttatgctgtgcaacaataagcagatctgcagatagcagtgttttcttttgattcctcagctgattatttttttctttaaaaaaatacatgtagcatgtaccttgtgtcaacaccaaaagaataagtcctatgattcttcttcaaagtaatttggtattttcaaccgattttattggggttaagtccgatttatctcctcaataattgcaaaactgtaatttactctctaaacaaggatatttgacacccctaacctattgaatccaaatgaattaacaacccttcaatcccctcctccctccaacccacatacacactcaaaacatagcggtttaaatagaaaaattttatttgaacaaattaatttaaaactggtctgtacatgataggcttgaaatatcttaaatgaaaaaaaattacggatccaaccatttaatcaaataaaaaaaatatggtagcaccaaaatttattattaccaaatggaagctcagtttttttatttgatatctatttttaaattacagaaatatttttttcctgcaaatttttacaatatattccttctgctatgtagaaggatttatttatatatatatatatatatatatatatatatatatatatatatatatagaaactactcatacggctttcaataattatgtttataggactgcggtcttggttgacataggcatggcgcaggagacgatagcctcaacctcctcatcaatgtggtattcgaacgaatcgagtgagtagatggggaggttgttgccgcagctggctgtggacgagctgcggtcgctgacattgcccatcttgactcggaagctcctagagtgctccttggctctagtggtgaggatgacggagatcgacagatgtggaagcaagacaatggcctgacatagcgagcatgatgagggtggtgcggagccacctgtcaacgcaggcggcatagaacacatggcggcacgacaggagtagccacaactctgtatccaacatgaattgcgatgggcaggacgacatagtctggtgacggtgagctctgcaagaacgccgccagcaaagactccatcgtgaacagttcacgcagtgacttgatcattctatgcttcttgtactgtccttccttctcgtgtgttttttgccagatgtgagggagggcggaagaagaagacagagaggatgtcatgtgggggataattcgtccggattcaataattcagggatatcaaataccaatatccggtatcatagttaaaggggtaattctcaatttgaccctagttgagaggggtaaatcaaacttaatcctttccattgtggtttcttgtgagtttttctttctttcaagcagtggttattatttaggaaatttgtataagttcttgtttttaaggttttatatatgcataaccatcgtttaccttttggcttatttcttgaaatttaaattttgagggttattatattatacttattttttcagtattgccttttatttatactagggacatgaatatatacaagttttacctacatattatttttctaattgctaaataaattgttttacagtttatcagctattggccaaacgatcaagctgtctgggaattaatgttttacacacagtcaggtttgttctaacaacaaaattcgtagtattacactcgtgtgattattttttcgatttatgcaaaagtcttactgacaagaaaaaagtacatctcaagcaaataaacaaatattacatcgcaaacagttcatacacacgttgtacatccaagcaaatgctgaaaacgtcttcagataataaatatcgtacgttaaacaaacaacaacgcttctaaacaagaaacgtagtaatgcaatggcgagagaattaacagtgccttttggggatgcaaatctggccggtcatgtgccaactctcgcctccgtccggatgcgcgtacgggcacgacgggacgtgctcgtcctccacgacgaggaggttccactgcgcgtgcgggtcgtgcgtggagaacacggtccacgccggcgtggagttctcgtaccggctgtgcgtgacgcggacgaacccctccacgtcctcgttcctcgccatgtcgtccgggtcgatgtccacggtgaagatgtcgccgtagggcctgacggagtgcaggaagagcggcagcgacatcgggtcggcggtcaccgcggcgaggtcggacgtcaccgcgatgctccgcccgtccgggctgaacaccgggtggttcacgtgcccggcgacgtcgtacccgctcctgatcaccctcaccaccgaccgggacgccacgtccatcaggtagacggcgaagtagcccgggtcgaggccgtggtcgcgctccggcgcgtccgccggcctgtcccggttcgacgagaacacgatccacttcccgttcggagaccactggcagtgcgtgtccgtccactcgccggcggtcatccgcgtcaccgtcgactggctgccatcctcgccttctccggcgtcggcgtcctccattatgtacaggttcttgctgtactttgcccctccatctcttgtcgaccggaaaacaaatttcgttcctaattaagaagtccaaaacacagtcaaaattaactatgaaaagttcattttacgggatgattgaatattggtgatggtttttgttaccgtctggattggtggaagggaaggcgttgttgaatcctccgaacgtgagctgccgcgacttccggtcaccagtggatacattgtgtatggaatggatctccaacgtttcactggctttgaaagaaggtcccatgcacacatagagtatatccttcttggaattccacagcggtgagaagacgctgtctgggccatcagtctaagcaaacaggttaagtaatgatcagtagcagtttagcacttcataattgaaaaaaaatattgactactcgtacagcatttctggaggattaacatattagtatatagcaactactagcaggaggcaggaggtataccttgaagacgacacgcatcccttggctatcggccagccacacggatttgaactcgttgtcaacgaaggcaagctgagaaccatctttggaaaatgttgggaacacaccggacaccctgaacacaccgacatcttcgtgtggggattgcagcttgtgaaattttctcgggagatcatcgccgtgctgcacgagaaacaatataatatcatctgcggctttgaatataaatcaaccaactactcagtcattatctaaataaaattagttatccatcagtgcaatgatatactatatacgggcatacggctggaccgccatttcactggacaagaaaacgtgatcaatggacatagccatggctatgtacctggaggagctcgcttttgcaacggtggtaaccaatgaacttgccaccgtccatcacgaaggggttgaaatggtcggcctttggcctggtgttccgggtgatctgcatcggctgctccggcgatctcatgtcgaacacctcgatgtgcctgtactgtgcctcgacgcggacatcactgaactcggacttctggcggatggccgccaccgccaccctggtctcgtcgatggccgccggagtcaccgagtcgaacgccgccggcgtcacccggacggtctcgccggtgctcagggtgtgccggaacacgccccagcagctgttctccccgtcgccgtccttcctgtggaagaagatcacgtcctcgctgccccacgacggccagccgccgttctcgatcacccgctcgcgatcctgagacgggttctccaagctcatcacgtagatgttggtgttgaggttcttgatctcaccgtcccatttcttcccttggtacgaagccaccgctactttcttcccggatggtgacacagatgggcttatatcaaatgttcctgtccaaattcaattgcacggaccaaatcaaaaattttctttattcagtgattacactacatatgcacacgcacacgcacacatacaactacatacgcaatactacattcatatcctacgaatgtgccctcctaacatacttcatccgtcttataaaaaaatcaacctagttccggatgtttacatattttactactataaatactataatatatcaatagagaaagtatattttaagatatcgaaaccagcggtacatcctaatctcactaaaatcaagaatttccaagcgcgagtaatatctgttggctatcaagtggcaaaaggctaagctttggcaagatataattcagtaactgatcaaattataacctggtggtgtgaggcgttcagtctcgccggttctaagattggtcttgtaagcgacgttccacgggctgcgacgttctcgcactggctccttggtggacacatacacgaggtaatggtcaaccgtgcggccatccacctcgtagccgccggcaatgcagccgctgtcctccatgcgggcgccgctgaacaggccgtcgccgccataggcgtcggccagggagaagacctggacctcgccgtcgtcgttgaagcgcagggcgatgtggagcgtctcgaggttgtgctccctctcggagacgaagacgaggccggtgatgcggccggaatcgatgtcgccctcgacggcgtcgccgcgggacacgccgaggcgctccacgaccgtcttgagcgccgccggtgggatgggctggcagttgtagttgtaggagtcgccgtccgtcaggtgcagctcgtccttcgggctagacggtggagctgggcagcagaatatgtccagagccaccggtggcctgtagctcgcgaagaaggcaatgctgcctctgctctcacccattattcttcttgcgatcgaaatggatgcttcctggtacagcctgttaatggtgagattgcaagcgagaggaaatggcgctttggaatggcagaacagcagggtgttttatagggttcagggcaaggcagtggatactgtatgtgactataaattactacctccgtcccaaaatgtaataacttttggttataaatttgaacacacagttatccagattcatagctaaaaatacttatattttgggatggagctgtgcatattgtctaaatgagcctcactacggtgctctctactggtagtagaaatcaacctgaaccgttatttttattaatcgaagggttcaaatctatttatacaaccaccacggttagcggtagtagaaacgtgaagggacattactatcaaaaaaaagtaggtggtgatcgagggtataatcatcatttagcaatgactactttttttctcattttttggctttttcgatgaagcatgagcaacgccaacacaatggatgatcatatattgatttagccaaaaaaatataaatgataaaataaattctaatcattataattgtaaattactaatttacctctgacgatactggtagtaaccagtaaagagtaccagagcatcactcttgtctaatacttttttcgtcccaaaatataataatatgctttcagattatatacattctaaagctatgaatttgaccgggatttacgctgtgtttagatctaagggtgtaaagttttagcgtgtcacatcggatatacggacacacatttgaagtattaaacgtaatctaataacaaaacaaattacggaatctgcctataaactgctataaaccgctagacaaatttattaagcctaattaatctatcattagcaaatatttaatgtagcaccacattgtcaaatcatggcgcaattaggattaaaagattcgtctcgcgatttatacgcaatatgtgtaattagttattttttcatctatatttaatactctatacatgtgtccaaacatttgatgtgacatggtgtaaaaatttgtcagtggatccaaacagggtcttatagtgctaaatatgtctaatcgaaatagtgtaatgaaaaaaaaaagtgattcaaatcgattttgattggagtgaatgtgtctaatccgatatagattgatatatacgcactccgtcctataaaaacccaacctagtatcagatgtgacatatcctagtactatgaatctagacatacatatgtccagattcattgtactagcacatgtcacatccgatcctagattcatttttataggacggagggagcactattctactccctccgttccaaaaaaaggtaaaccctgagtttccgtgtcaatgtttgactgtccgttttatatgaaatttttttataattagtattttcattgttgttagatgataaaacatgattaatactttatgctttatgcgtgacttatctttttaattttttttcataattttttcaaataagacggacgattaaacattatacacgcaaaccagggtttgtctttttttggacggagggagtacgtattttagggtggagcaagtgaccactgaccagttagccagttgcagttgcagagatggttgtccagctagaccttgcacgtggataattctttaacaaaatatatggagtgagttgcccacaacttgtggatcggcaatgatggttgggttgaccacgcaacagtctgatgcaattgggctttcattgcattatcacaaattcatggcggcaaaatcattgttagttttttggggttggatcttatcttcgaaatgctgtttctcttgcataaatgatttgtcatttccatgcatttgttgatgttactcaactacacttgtattctctttttccctttagcaatgattgttgttctgtcaattagacttgtattgttttctccttgcatttgttatgttagtcagttagacttgtattattttttccctcaagggagataatggtacggtagtgccaaagttgttctgcatttgctctttgcttcatttaaaaatataaaaaaaaggaaaatgatttttccattttttttagtactaatatgcaaggaactgacagaaaaactcttccggcagtatctgcataacttggtcatataatgaaatcccctaagtccaataattaatttagcaggccctctatcactttgtcaaggtggatctcatctcacatttcacacggtttaatattagcacttgcagcaagcatgtgagattgttacaaagtcaatacaagtggattatcttcatgcaaaatttatttggaatcatgcagagtaaattgctctagaaaattactgctgccattacttagtttcaccaatgtgcaacacgtacagtaaatttggaacgtttttcaccttaaatataagcctcttcagactgaatttggtactgaatcagatcactaaaccagaaatgtgtcaatcattaaccggctagccagctacttgtacggtgagatttgtgcatcataattaacacaggcagggacagggttaatcaacttgtgcaacttgtgttttccaagaaataatgatgaagaaagtattagcaaaaatcacagtattgtttagaagcttagaaagtgggcacgcgctaataagtcatccgggctgcaggaat

SEQ ID NO: 60754 - DNA, 6799 bp, Oryza sativa
aaggaggagatggagtgttcgttctggtggtatagggtgagaaaggacatcgtattccgcacgcacgcttcccaaactactaaacggtgtgtttttttgttaaaaatttctataggaaagttgctttaaaaaattatattaatccatttttaaaattttaaatagttaatacgtaattaatcatacgctaatagctcacctcgttttacatatcttcccaatattctcaatccctttctcctcaaactcaccctaattgtcgaacgctgtacaagaataaattttcagaagacggaaggtaatccttgattgcacatgtcgaactcagaggacgggagatcttgattgcacatgtcgaacgcagtatgagaattaatctgcttagagcaagtttaatagtatagccaactactatctccaattcatctataactaatctaatagctcatttatacaatagttacatactacattattaatatctggccccaccaatcatacacacattgcgtctaggagtctgtgctacagctggctataaatctttagcccgctgttcttctttctccttatttatcttcttaaacgcaaaatctaaatcgagagcgctctcgatttagtcataacgagcgacgctagccattgtccagatacgatcaaccattgtccagatatgtgtcttgaagaatcttactttactatagtacttgatcaagcaagtagaaaaaatattcctaccatctatgcttcaaatacaattttctcttaagctactcatccgatctacgatccgattacaccgttgtgttcataacaattaaatctttacaacaagatctcatataattatattttgataaaaaaaatcacaaattacttttataatatatctaaattacttttagatttcactaagttacttcttaaatatataaaagtaaattcaataaagttttaaagtaattaacatatattatagaagtaactttctttttttataagttaattctatagtatatgtaaattacttttaggctttgttgaattacttttatatgtttaagaagtaacttagtgaactctaaaagtaatttagatatattataaaagtaatttatattttttcatcaaaatataatcatgtgatatcttgttataaagatttaattgttacgaacacaacggtgtaatcggatcgtatatcggatgagcagttttagagaaaattgtatttgaagtatagttggatagtgtctatcatatatggagtggagacagaccagctaccactagctgtgtagtcatgtctcttcttaaaatgtgtttgtaatgtgtttgtagctggcttatagcctattattgtacctgctcttacgagtacggacgattaatcctggttcgtatatgaaagatcaaggccgttggacaaagaatcttccattgacatatgtcattcattgttacgtcatccatgggtacgtcatccattggtgggtgcgcttgagttctcacgactctgtcatgtacaaagagcgagtacaaaccttaagagcagatacaatagcaggctataagacaactataaacatatttcgaggagataaaaaaaagatagaagagtagcgggctacatatttatagccagctacagcacggacaccaatatacatgcatgtatgataggtgtgatcatatattaattgtgtagtatatgtttataggtaactattatatgaattagctataaaattgactatagataatttagagccggtagttggctgtactattaaacttgctctaagatcttattggaagatgctatttcctctatcttattttaagagtagttatggtttctgtgtccaacgtgtttgactatctgtgagtctgtcttcaaatatcttatgattagtatttttattgttattagatgataaaacataaatggtactttgtacatgacttatttttttaatctttttatgaaattttcaaataagcggacaatcaaactttagatacagaaacccacaactacacttaaaataggacggagagagtacataagagcaggtacaatagcagactattagccggctataaacatattttaatgagataaaagatgagagagaatagcagcgggctacagatctgtagccagctgcagcgcggactccaagacgcaatgtgtgtatgacatgtgggaccatatattaatagtatagtaagcaactattttatgaattggctattagtttggctataagtgaattggagctagtagtgggctatactattaaacttgctctaagatcatataatgagatgaaagagaggaggagccaatatctacacaaactcctagatgagagaaataagctaatggattaagtgaaaataaataaagtggtgtattgggataagtgcattggcgatgtgttgtattgtcccaatagtatagccaactgctagatctaaaaattaacacatcatgtgtaacaaatctaatagcctactcatacaatagtttcatataaacatatagaacaacattaatatctggcccatctctaatatacacacaatctcttagagcatgtaccgtaattggctataaatttgtagcccacttttattctctctcctcttatctctcatccacatatgtttatagctaacttatagctcattattatacttgctctaatcaacgagtagataatatgaataaaattaaaggaccatatcgatgggtgatacccgcagaccggatgaataaggtattggggtacgttggtacgaggatctacacgatacgacatcggcgaacaagaaggcaaagatatcatgtgatagccctaatccaatttatatgatattgatatggaaaaccacatagtacaatgagaatagatgaatccggcgttatcggtgagatccttgtcgagatgattcgacgagatctctcggtgagtaggcttcgcgtcctccagcttgtagactatggtgggtgtgttggtagtaagattcgatgatctaaacccctcaggggtacgccttttataccgtgaatctccttagtctccaagtagaactcgaagactacggaccccgcatgatatagtaaaagcccaatcctctccaaataggactttgacatccgcctatcgtgaggacgttttccatagtatcttgtagatttccttatcgtatacggaaacacattgtatacatgaaggtataccgtattcgtatattccgtaagtcataggattggagatatgccttatccgtaaccatggcaatcacctctactataaaacttgctctaagtagggtatttgactctccacgaggactatctattggttggtagtacatcatgaattaggagtatttgcaagtggtgcttacaaactccgtgatctaaaacggcaattttttcagcccccttatcatcttttattgtgcttcctctaatgttccaatgtatgtgtagctcatcttcctcgagttcaggcaaattatctttttatttttttttgggggatggcacggaggccttcatactttgcttgtgttagcgtgcttcctttagttattggtttatgttgtagttagttatgtatttagtttgggaatatacaaaatgggtagctctgttttatttgtatattatatgaagttaattgatattttaagtctatttttattctaaaaagctatttaggaatttctaatttaggtcattagcagattgacatgatttcagatccttgttttaacaaaacaaaagtattttttaatgacaaaaatactaatgtaatatttaatattatccacgcatattggttagttataattccgagatctgaaggctcgccttctaaaatcatgtacatttaagaaaatggataactttggaattcatatacaaatagaatttatcttttttattctaaatttagtcattgtctttggggtgcattttcgctcatttttaaaattattttaaatatggttaaccaatatattttttagaatttgcatggaaaccaaattctagtcttatttttgtttttaatccaaattttagttattccttacttgtacttgatatttaatcttagtttaataccattaatcaggcaacgataagatcggtagtctactttatctacattgctgcaaaataaaactagaattaataaataaactatttagtgtgtaactgtagctgataatctaccatcattctaaaccattaatttggggattcttctagatatcatagttcaagacaagaattatttcctagaacagttctatttatattccatttcatgccacacatgaccttcaaaagttttagctagctacaaatgaagtatgcgtactttatttaggaggagaatcgtaatacaatcatttccatttttcaacatcgtttcattcaccgctgaagttaactattgtcaggaaagaacaggaaaaatgtgaacaaacagaacattatgcaaagttgcaaagctggcagctgggatagtacttcatacctcaaagctctttttagcccatctattgacatcacttttactggttttaatggatttcttggattggaccattctagggcaggattgaccatgtgaacgatgcttggatttcactaatgcacttgcatgcccttagctctacactctgccagtagattacttctgaggatttctgccaataggaaataagcgaaatgcatcatgcgacatgtttatccattttgatttgcaaaatgatggaaactacaatgtccttacagatgaatgaaaatattcaatacagaggtccataactacatctatgaaaaccaagcacgtggcaggcgcatacaattttgggttcagatatcacgcacaagaaatgttttttttttgggtaggtgtaaggacttagctatctaatatatgattaaaaaaggggccaagttgtcatgtattcaggagtaaaagaaaacaatggaataatggaaatgaaaacatatgcatataagcttgcgcttgatatggggaacaatccctgcaaatatgggctgcatatcaaaaggtgaaagaaagctgattggtgaaaggacagtgaggggggactataagactatcataaacctcaaggtctataaggcccacgaacccacagttgcaaagataaaatgattatagtttcacattcaataggatatggatttctaaataatttaattttaataatctgcagatttcactatccttcttaagataacagatggaaaagataagaccaaaagagggaccaaaaggtagcttttatctataatagaatagttgaaatacttgagctgcatttgacaggtaaatatatggtggaaaccgcaacttaggtgaaaactcatgtgaaccctgaccaaacagttgtctaaattcaccccaaaaaaatcatacatgtagatgagattattttacacaaccatgtaaaagatcttttccaaactcagggtttacactagttttcacctaaattgggtttgcacccgcatatttacccgcatttgacatagtgaaaatgctccatacagcgtagcattgctcttagaatatctgtaaacatgctgcagtttttgcaggacaatgcgttacataggggatgtctgctcatttttgtttctgggtatgagtcatttactgacctaaacccactagactttctcatttgagaaagttggaactatagaaaattggcaacccattctaggaagcaataacagattggtcaatttaattgtcccatttccagaactgtataatttggcaggctaacctttcagctttcatcaaagccttctcaacaatgattttttttcctttttgaaattattttggcatttgagttgataaatccccaactgctccaacggaaatagactaatatgcaatgaggttttcagaagagtaaatttcacaaaactacatgtattttgaccaaattatcacaaaactacagatttaaggtgttgcatcacaaaaccacagatttaacaccaaatttatcataaaactgcagatttaaggttaaatatcacaaaaatgtgtatttaatattgaagttatcacaaaactacaacttttggagtttaaatccctagcaacattgttatggtgaagctataaacattattgctttgtgactaaattgtttctaaacctgtagttttgtgataatttagttactaaacacgtagtttcgtgacacttcatcttaaatgtttagttttgtgataaatttggtgttaaatgtgtagttttgtgatacaccgagttatatctgtagttttgtgataatttggtcataatatctgtagttttgtgaaatttactctttacaaaataaacaaactcgaactgtgtatagatgtgacgtacattcaaaagaagtatcctggaggattgagaagatattttgccaatcagagaatccgacagcgtataacacccgaagcaaaaatcatctgctccatattcgcttgatgacatggctttgtagttttgcatgaagagtttcacctttcatttattttgatgtgcaatgagttgcagacaacttgtggatcagcaaagatgatccggttgatcatgcaacattttgatgcaatcgagctttcattgcattatcacaaattcacaacagcaacaaaaccattattagtcttttgggggatggattcatctttgaaatgttgtttctcttgcacaaatgattatcattt

SEQ ID NO: 60755 - DNA, 922 bp, Oryza sativa
tcagaaggtcattcggacggcaaccatacaagtctccgtctgtttatgaaaagataggataagtccccacaaaaagagagagatggtgcatgtggtatccccttgaggtataaaaggaggaccttgcccacttagaaaggggattttttcggatccagaaggactagagagggagagagtaagagctctctggttctccagctcttttgtagcttcttcatacatagatccacaaaaacacaggagtagggtattacgcttctcagcggcccgaacctgtatacatcgcccgtgtcttgtgtgtttccactctcgcgaaccttccacactcagaccaggagcttagaatctcacccagggcccccggccgaaccggcaaaggggggcctgcgcggtctcccggtgaggagccccacgctccgtcagctatgttagtcaattagacttgtattctttttttccctttagctatgattatcgttctgtcaattaaacctgtattatttctccatgcatttgttatgttagtcaaaagtcaataagactttgaattcttttttcccctcaagggagataatggtatggtggtgccaaagttgttctgcatttgatctctacttcattttaaaatataaaatagggaggagtgttccatatttttctagtcatatgcaaggaactgacagaaaaactcttccagtagtatttgcccgtgcagttttaagataggccagtcactttcactttgtcatataatgaaatcccctcagtccaataattaatttagcaggtcatctatcactttgtcaaggtggatctcatctcacatttcacaccgtaaattcttctttgttagaaagtcaatacaaaatgattatcttcttgcaaaatttgtttggaattacttagtttcgtcaatatg

SEQ ID NO: 60756 - DNA, 12508 bp, Oryza sativa
atctacagatcttctctttattgttttccagtgcaataagtgtgataacatgttgtcccaacttcaaaacttccaacgacaaagctaaacataccaataaaggttgcaagcttattgcaccccttaagatcccaccctaaatagatgatgggtgatggatgacacagagttcatgacaattattcgagggcataattaaatattggaagttgatttaaacaagttatctaagaaatgttgatgaagaaagttttttgcaaaaatcgtaccatttaggagcttgggtagtctgcctgcgttaatctgtcatctgctaactataaataacaggccatccttgcttccttattcttccctcctcccttcaccaagctccctgatatattcatataaacagacagttactctccttaatttggtgaagtagaccaccctcactctcatgtgctccatgccttcaataatgcagaagtattagtccccatcatagattgaattcaccatagattacaaattaataaataaataatacataagcaccattatgcatggctaaatgcaaaaaaggagtcatgaccatgtagtgggtggctacttattcatggtgccagatggatggatgttacctttgcagaaatgaggagggagcgactgaggttatatctgacttcaggtgaatgatcaaaagatgaatgttgtgaaaattaatggcagacaaaaacttttagcttatgtgaaaaatatacattatctaaaaacatgtgaaaaaatagacagaagaaagattatttgaatgacaagctaccaaagcaactcataagatagctagaacactagttctgctgataaggaattaaggatcggctcagtaccttatgaaacttgagtcaaaccactctaagcactgtattctgatttcaagtaccatcatatgatatattctcacaaaggtagtgatgattcaaccacactagaaccaggaatttttgggacatgccattgtttcatggagccccttaggtcctttacatgttgccacattccttctgaagcatatatgttagatagcatagtgtggaacccgtcatggtgaggatctagattgacaagcttcctccccaccctttctccaacctcattatcaccatgtttccagcaggaaccaagcaaagcaccccatgctggaacatctggtgacatgggcatgctctcaatcagattctctgcctctttgacatatccagcacgtccaagaagatccaccatgcatccataatgtctgatgtttgggataatgtgatacttgtgctgcatcaacttgaagaaatgttggccctcctcaactaggccagcatgtctgcaagcactcaaaactccagtgaaagttatctcatttggagtggcagtgctagatgattccatctccgaaaacatgtcaagggacttcatcaccagaccattcatggccagccccacaatgacagcattccagcaaggtgttcctctttcttccattgtatcgaagacttctaatgcagattctaagcacccacacttcatgtacatgtcaatgaggctagtcccaagtatgactgtgatggtatattggtgttcccttatgtactcatgcattgacttgccttgctcgagagaagacatattagtacatgcagagatgacgcttacaagcgtaacctcatctggcttgattccttgggcttgcatgttgttgaaaatagtgagtgcctctgaggactggtcattttgcacacaaccagatatcattgtagtccaagaaacattatctttgtcaggcattacagtgaacaattcctttgcatccttgacagagccattcttaagatagccagctatcatcgagttccaagagaactggtccaaacactggccactgtcaaacaatcttcgtgccgcaacaacattcagaaaacttgagtacatgtggatcaatgcgttctggacgttcaacctcgagccaaggccagctctgaaagccagcccatgacacatctccccattccgagttacctccaaccgtgcacaggcagcgacaacacagaccatgactgcctcatccacaggccacccctccccacgcatatctgagaacaaagccaacgcctctgcaaacttgccattccgctgaaagcaagaaatcatcgcagtccacgtgaaaacatccttgcgctccaccacatcaaacaccttcctcgcctcgtccaccattcctctcctcccaaacagcgacaccatcgaactcaccgccgcagcaccccgttcaggcatccgtgcaaacaccccaaccgcctggtccacatcctcagcctgcacgtacgcggccaggatcgtgttccaagaaacggcgtcccaaacaggacccgcgtcgaacaccttgcgcgcgtcgccgaggcacccacacgcggagtacatactcatcagcgcgttcgcgaggtacaggttgcgcccgaacccgtgcctgacggcgtggcagtgcacctggcggccttcttcgatggccctcctggtggcgcaggcggcggcgaggatggtatgggtgtagcagtcgggggccgcggacatggacgcgtagagcgggaggcacaggtgcggcagcccatgctcgcgggccgccttgaggaccatgttgcaggagaaggcgttggggcggtggacgacgtggaggaggcggagcgagtggtggaacgggagcgggaggaggcgggtggaggtggtgaagaggatgaggcggctggcggcgaaggcgtcggcgaggagaccggacgcgacgaactgggcgtggatctggaggaggtggcgcgccgagctgcaccgcgcgaggtgcgcgtccaggagggtcaccgtgagcatggagccccgccgccgccgccgcgggaagccggtgagcggttgggacgagagcccgcggggcgcagacgaaggcaattttctcgggctttcgtacggttttgggttcgtttaacccgaacaatgggccttgttgggctactggctgctgaacgcaagaagagctttccatcgtggaataagttcttttttttatggtggaataagttcatattaggtcccttatcttgacgccgagttcaagttacattcttgtaccgcgataccaattgtagcacgtctcttaacttgcaaaacagtgtatccgaggtttataatacccgattttgactgacgtgtccaataggccccacatgtcaacaaccacctcttcttcctcctctatcctccctcttccctctcttcccatctctcacattctcaccaagccttcgaccggcagccgacggaaaacaccaagccgtctgatagatagagatgtagcaaactagggggcaaagctactacgttttctaggaccctatgcaaactcgaaacaatagtcccttagactagatatttccttttagttataagacacattataatccattaatcccctaacgtgacattgcaatatggtcttaatatcgataaatagcgttgatgcttcattgaaaaaaattgaaaaaaagagaaaacggcaaataaccactaaactccaacaactttattgacgatgcttcaaaaagagaaaacggcaaatatccaatatgtgattaaaaaagaacttctggaatttctttagagtaaattgcacattggtctagttatatttaccaaagttctagtttggaccatcctatagacaatgttttcactttaggctaggtcttacagcaaaaaatttcagtttggaccggtggctcacttgtcagcgagattaggagataaatgggcaagctgggagcctcctctctccttccaactctggagcacagcttctccaccgtttgctatgccctgcccctaattcaactggatatgtcaatcacacgcgaaacgagcttcatgtcaatcccatgctagagctggagaagaagaacaagcacttgtcccctaatgttgtttcattgaccttgattctgccactgtcagcttcatggccatggccgttgtccccaactctaacgcttttccttccaataaccactccgccactcacttcgccggcgcgcttaatctctatcctctagccaatctcgtcagccccttgaactactggacagcaagggaaaacaacaacagagcagtgcctgctgcatcgcccttctccttggctaacccccatcgtgtccccttgcactcaactcccgaccagcgacagaagtggcggcggcgaggttgcgcatgcccttgtgggagggagaagatgtctgctcatccagatgggctcaaatcctggagcctagcccaaagtgcaactcttggcaaatatatatggtgttagtgaaaattttgacctaaccctagcccaatgtaaaacattggtaagaaaaggcagaccattgtgaaatttactcatttctttattcaaaatcattaagaacaatattgtgctcaatattgtccaaaatattcttttcactacaacacatcacaattatcatcatcatctaacggattaaaatcttacaactgcaattagaaaggaaaatagaaggcaagaacactaaaaatcttgacctaaaagcccgataggatgtatcatcttaaccagatactccctctggttctataataattgacgttttggacaagattgaggtcaaacttttataactttaaccataaataagtttaaaaatatttagtttaaagaaactagaataacgtatatagatttctctttcaaaggactataataaaagtaagcatatatttatttattatatatatattataatagaaaaataaggtcaaacatataaactatagactgtgtcattctccaaaacgtcaattaaaatgaaaccagagggagtaggatatatcatcttctatgattatttataaattgagaaataaaatctactgctagtatgtaaatgtacctatgcacatagtcttcaatcaaggctgccgctactttgcttcctgcgctctttggcctggccggctgggtgccacactgctgcctgctacgagcgtacggtccaggcaagagtagaagagagaactgagatgaattgttgatcaaaggaagagacacatttactgttgtctgtcgaaaaggagtcgtcggcgatgacggcgagttgctcccgctcgacgcctttggcctcgggatgagacgactggaatgggataggtcatcaagaagtccatacatcagttgattgaaggcacactgctcagctatttactcttgacctacattacattaggataggccccattcactctgggtcctagtcggttgcacaacttgtctagacctagagctggccctgtgaggaggcgacaagtggtgggaagaagaccagtcaccgacttggagaggggtggcgatcgatgggatgaggccacggtagattagaaagggcaacgaccattgcaaactgaaagggtcgtaagtggtattattcctcatcttcctatctttcctatctgtcactaagcctccgagcaataacgagagggtaatgagaggtggggaaaagggtggccgccaacgggctacttgtttcgcatggcgtgacggagatgtaacttgtggatggcattgcggaggggatggttggggacgagctcgtggcgaggtagctttgggttggttattggcggcatgttgcgcctaccgcacatcaactccctaatcacctccgtctcataggaagaacttgtcactggtgatccctacccctatgagcatcttcgaagactgggcgtcgcctaccactgaaagcacaaaagccgttaaatcctgaaaaaatcactctcatggagagtcgaacccaggacctaaggtactactgagactcttttaaccacttggctataggccctttattctcttttacgtggattcacacttttctaactaattttcatgaaaatcattttaaatttctgtactttaaaaggtttgttttgtgtgggtatgacttttgaggtttttcttttttttttcttttggagaagagtggcatacacatgctcatgccaagtatattattgctaagaagcactaattaagtttcattatcaacaattgatcaattatataaattgtatccacgaatacaagttcaaaggaatattcacacaagtcattttctctcttttttactatcaccatcaggttaccatcatgctacctctatccaaaaataaatctagttgtgtagtttaaatttgaattatacagctacttattttgacatggagggaaaatacttgtttggcactgcatcaccacaaatagacgaaggtcccgttctaaagctccaaatctaaactacaacttactcgttttttctgttagcatgtttatcaaattgcgtatttttgtgaaagtttttttatatagaagttatttttaaaaaaatacttctaagtttgactccctccgtcccacaatataagggattttgagtttttacttgtaacgtttgaccattcgtcttattcaaacttttttttgcaaatataaaaaacaaaaagttatgcataataaagtaagtcacaaataaaataaataataattttaacaacaactgcatacgaccagtggtcaaacgttgcaagtaaaaactcaaattcccttatattatgggacggagggagtaacaattaatactcgattaattatatgctaatcacacatctaatttcacgtgacagcaaaactaacatctaaaagcgacgatcgaacgcagccgaagtcctgtactaagctagctccattgcatctgtatgacatgcatcctagttggtgggttagggcgcataccaactaccgacgagactagtgactctcgcactgaacataaaaatcctatttcctgttcccctgggcaaacatgttcccacttcccaggtgaaaaaaagccgattaatggcgttttgtatactccacgtagacgcatattacaagccaactatgagaaaaaaagaggccattgttatcagcttatcgctttgattcagatcgcataaaccgctcaacacacgtcaattacaactatgggcttttgatcgagaaaatcaccatctgttgccgtagttgacttccagttgggcatctgcgctgctaaccatctcaaattccgaatttgattcttaattaaggcgagctattcactacagacaggatgctctgacgaattgatgtgcatcgaaatccaagaaacggagcagtactaccgattaaagttagtgcctttctttgcggggagattaagttagtgataatcatcgaaaaacgcaaacacaagtactaaacgcgaaggaattaagaagactagcagagtgagtgaggggtgcaagtgcaacaagatctcgccgaccgacaggggcaatcctgtaatctacaaagctgcaattttcgtgtaaagagagaaataataaaaacggaaatatttctttcttcttcttctcacctaaatcgaccaaactaagcatccgtttagttacaccgtcactcgcaaatccgatggcgtgtggggcccacaagctctgaaatgcctcactgcccccactgtcagtgaccgtggaatctcttgctcggtcccacatggcagcgtcggcaagctcgcgctccctcgtacgacgcgcacatccacccgccgctttaaaccgcgcttctcttttttttttcttcgcacctaattttcttcgtcctctccctctcttcttctcttctcttctctgctcggctcctgtacgcggctggatccgagcggcgcaggaaggaggcggggcggatgctgtagagagaatggcggaggcgatcgcgtccgcgggtgggatcgccatggccgcctcgacctccctcacgccgggccaggtgagccctaaatcgcaccgtcgatccggggaggggggggctgctgctctgttgttggtgcgggtgcggggaccgcgcggcatttgctgccccctaggcgatttcgtcgggggaatccgcggttggcgaggtggctcaaggatttcgtcggggggaatgggaaggcatcgcccgtgtgccgggcgccgggcgcggccgcggccgcggaagtgcggcttgggttttgggtttaggtggctgggactgggaggaagcgcgctggagatgatggcatgcgcgtggaatctctggcgggagcttgtgttgctttaacgctgctgttggctaaattggcgggattgggtgatgatcggtgagatggttgtggatatcggttggttgtctggtttgcttttttgttgatacgacaagtattagtgctaggttttaggattcggtggtattcggataggaggctaactattttggctgatgcgggatttgaatttgtggctggtttcagggatgtggatcaaagggtgtaaatcatcaggtcatagctgtgcttttgtatggtaggctagtagcaccaaatatatggtggaggtttcattcatccgagctgttggaaaattggcgatataatagcttatatgtagggtttaaggttggaaattcgtaagtggctgcggtttcagatctggaggtattggatgttagagtaagaccgtcattaagatctggcagcatgggctattctgttatattttctaagagatggtagcagtatcgatgtgctgaccaacctgttagaattggtgtcaatctgcttgattttctagcgcacggttgttccttactttggtagttgttaggaagttcaggttggtaaaaatactaaaactagatagtaatttagttgcagaaatacatattggtgtggattgcaagaatccggactatgatgagctacttttaccccacaagttcaaataacacaattacagtgtttgattgcaacttgaaagccgtagaactattgtctactatacagatgactgagtgatattcttctaatagtaggattttgttttgggggtcctcaatcactggatctgagatagctggcaactttctgacaggtctctgctcttctgggatttctttgggttttcaccgcctgggcatatgcggaggttctctattataggaagaatgctgcttctattaaagcgtaagtaattgtgacagctatatttacagttctggtatccatgcattttaattttcgtatatgctaagtgatatactctcatgttgccactgagattgaaatatctacttatgttacaagaagcataactcaagagtcgtacttcgtctggactgaatgtgtgctgcaccattattttgcttgaaatgtaccacttattggaatttctgtttctttatctttgttagtagacactcggatgtaaatttagcagtaatggattctagctcaaacaaaggagaggatcaagtgatgttattggaggagggtgtccaagcaccagtgcaaaagccagtttatgcttctctcacatcacaaatgttcaggttgtttgtgatgtatgatttctccttcatgttgtatataaacgttgagatatcaacattactaaggcactgacaaagataatctgttgcacagacttttcttgttggaccaggcacttattctagagaatcgattgacgttgagagcaatgtaagctacagctgcatcttgcattcacgtgttcttctatgttgcattatttggctgagcagttattattttttcagatctgagtttggaggtcatctgctttacttttacatatgtgatcgcacaaatctactgggagagtctgcgaaggtgctattacattgatgtttattacaagcctgatttcacgtttgaaaagtagttgcaaaaatattgtatctagttgagatatcttttacgaatacattctaagccttactaatatttcatggaaagtgcctatataatgtgctgttctttcaatgggacattttttgttctgaccttttctgttatcctgtatctgcagaattacagccgagatatgttccttttcctttactttcttcttattatcgtagcagctatgacttctttcaaggtccaccaagacaagtcgtcattcacggggaaatctatactgtatctgaataggcaccaaactgaggaatggaagggttggatgcaggtatcttttttggggaaaaaaaactccgtcttccttttcatatatttatggggtatcttatactagttggcttctgtttgtgcataacactaatttatcataagtcagaactatgcaaagagggtataaatgcattcagtattaaacatcttttgtcatattgttggtttccgtttgtgcataatactaatttatcagaactcagaactcagaactatgcaaagaggatataaatgtgttcattattaaacatcttttgtcatattgttctacatgtatgcttacctagtcttcattaatgaacctctcttagttttagtaagttaattagtcaatgctcaatgcctcaatagcatacatgtgtggttagtaagtttttcatctatgttcaagtgcatgcatatcacttgttttcagcattgatttccctcattcaggtgctgtttttgatgtaccactacttcaatgctaaagagatatacaatgcaattcgtgtgttcattgctgcatatgtctggatgactggatttggtaacttctcctattattatgtgcggaaggatttcagccttgcacgatttgctcaggttcattcttagacccttcattccccttcattctttcttccataagtaggaccttcctgacatgttttcaccttgacagatgatgtggcgcctcaattttttcgtggcattctgttgtattgtgctaaataatgactacaccctctattatatttgccctatgcacacactttttacccttatggtttatggtgctcttggaatactaaataagtataacgagattggatcagtgatggctataaagtttgttgcctgctttttggtggttatcctgatatgggaaatcccaggagtcttcgagattgtctggagcccattcacgtttcttctcggtaagttttctctgtaaacttttagtgagtttgatagtttatatatatatttttagtaaggatgatcaatgtaatttaccttgtgtgcaggctatactgatccatctaaacctgatctccctcgattgcatgagtggcatttccgatctggactggatcgctacatatggattgtggggatgatttatgcttattaccatccaactgtatgtttcctgccaactgtgctatacttttacatagtgttcagttatagatgttctatttctttagttttatcaaatttcataaatcgcataaaagttgtttgtatgagtgcatgtctctgcgcgcctgcgcatatgcatgtgtgagagaaatgtgctgatataaattttctggttctttcagttttgagggtgttgagtcatttgtaaaattgtgggcatacgagagaatagtattttacatcaataaatcatttgtttgtgttgcaggttgagaagtggatggagaagcttgaagaagctgaaacgaaaactaaactctatattaaggccttgatagtttcaattgctttaacggtaattatcaaataactgaataagccacttattgttgcatatccatcttttggtaagaccaccttgctttactgtgatcacaggctggttgtttgtggtacgagtacatttataagctagacaagattacctacaacaaataccatccctatacatcctggatccccataacgtatgtattttttccatatcgattttttttataaaaaaaaatccttggtgtactgcaataactgattgctcaatgcttattgtactcaaaagtgtgtacatctgcttacgcaacttcactcaagaattccggtgctgctctctcacactatttgcgtaagttttgtgtttgtgaagcatgttccacttttatgttggactttatcttactgtaatgcgatattgtgaatatgcaattaatgtactcttcatctgtgctagctggctcggaaagattaccttagaaacgtacatatcacagttccatatttggctcaggtaaccagctgctgtctctacaatattacctccgtggttcgtgccactagaagttcctcttgttcttgtcaatgactgaaaattgtctttactcctgcagatcaaaagtgcccaatgggcaacctaaatggctattgacaataatcccaaattacccaatgctgaatttcatgctcacaactgctatatatgttgcagtaagtagatcttccctgtgactttgaagagtttagaccttacaggcaacctgcttatgttataacttattcctacaggtctcccataggctatttgagttgactaacaccttgaagatcgcatttgtgcctagtcgtgacaacaagcgcctctcgtacaattt

SEQ ID NO: 60757 - DNA, 9881 bp, Oryza sativa
ttttgagttgttattttgtattgaatcatgtacacatgataaccaaatatttcgtctcgtaccaaacgtccaaactatacttctattgggaaatttaagacagaggggagcctgaaaactattcaatccttcctccttcctcatgaatattcgcatgctgacaagctattatttctacgatttctactattaacattttttttattaacatgattttacttctgaaaaaacattttcatcttgcgcggttccgcttctctaatgtggtaataaagctcatgaatattcgcatgctgacaagctattatttctacgatttctactattaacatttttgtttttttattaacatgattttacttctgaaaacacattttcatcttgcgctgttccgcttctctaatgtggtaataaagcaacaagcagcatatcttgattctctttagagcaaattgaatggtacagtcaactatcaactccaaatcatctataactaatatatctcctacatcattaatacatgatctcatctatcatacactcagcgttttgaaatatgtatctatcatacactcagcgttttgaaatctgtgttccgggttgtagttggctgcaaagtgtaacaaagataaaattacctggtccaaagtgaaaacccaatcaagtaaaaatattagtttaaaggtgattcaaaatgaaacatcggtaataaaatgcgacctaaagtaaaatttcctttgatttgacactatcgaaagaaagtcgggctaaggtagcaatgatgcacatttcacttttaagactaaccaaacacgaaacaaatatgccgaaataaaagggtgccagaaccatcaaaatatgggagaccggtacataatatcctgcgtcacaggctacaacttctaaaagaaacaaaaatatgatcctggccattgctggtagattgtacggctagagagcagcatttggcatgtcatacgtagtgacgagcatccatcaagccaaatcatacgataggatgaggaagcatccattgttggcgccggcacgacaagctgatatacccgaatcttctcgagtggaaggctagcgcaaggggaaaacgccatcaacttcagttcctattagcagctctttccctctcccgcttgttgtacagcctctcaaggacgcgctttgcctcgcacgaggggaaattactaagatcataatagtgtggagccacatcaatcagcctgcacatgaaggacaaacatgtcagaaattctttcaaatcttcaatactcataaaaggactagctgtctgccagataatgactaaccaatcaccacggatatccatgaccgtgcggatgaaatttctggtggtcaaaacatactcattgtagatgacccactccggcttatggtctagacagttcgaggggtgaagatggacaacctgagcacaacaaagagtaagaaatctgcaatttcatcatcctgtacacaaagagactgggcatcagaaaattaataccaacctggttatctttgacggtcaggtaatgtcctgttcgctccaggtgagcaacctgcatgaagtaccctgcaagcatggctttcctgatattgacgtagtactcccgactattgaagtctgtgctgcacatcttgaggttaaatctggtcatgatgcgaacaagctgttgtctgacattatcagctgactttagagctctggcattgatgaagttctcataacaccactggggatcttcatctgcattgtcgaaaagacaactgttaggcaatgaaatggatatcagtgtagattgaacgaaaatggtcatgaacttactgttctgcttgtatgcatggtatacattcagaagtgtcaggtggtccccgtcaatgtggccaaatcgagccttcgcttcatcagcagccttctgtgcctccctaggccggagaaagcaattgggtactagagaaagaatacggcaataacagacgaagtccatggtggtcagcagatgcaaagaggcgagacgataccatttgctttgtcagaataactcaacaaacagcaactatctgcatcagcctaaactgtatgatcattttgatcaatagctcaagaagctaggtgcacgacagttgctgattacagctctgaaagaattaataaagcatattggaagagcaaatgcactaaagtggatgcaaactctcatgataagaagcttgtaagctttctacaatgtgcaattgatgcaagcaaaattgtgcgggtgttattattacgcactatataatttagctgacaaaccatatggcgacatgaagttttgtttgacatacctgacagcatggcagatattgaaaggatctcatttgaacagttgtattttggactgatgacaagcatctttgacatctggggatctagaggaaattcactcattgtttcacctaaaggcgtgaggtttccatcatcatcaagtgcccctaagtagttcaaaacttccaaggccctcatcaaagtttctggtgcaggaggatccataaagtcaaaatgcactaaatcatcaattccaagcttcttcaaggtaagaaccgtattcgccagatttgacctaagaatttctgggtatgtctgtggctgtaaatcatcgttaaaactcttctctgtatataacctgaaacacttcccaggttgcgttcttccagcacgaccagctctctgatgtgcacttgcctttgaaattggcgacaccagaagggactccacccttatccttggattgtaaaccttctgtttggaaaaccctgggtctatcacatacactataccatctatggttagggatgtctcagcaatatttgtggacacaacaattttccttccagctgggcctccctctcttgatggggctggagcaggttcaaaaatcttctgctgcattgctggaggcagcgtagaatacaaaggcacaactttaactgggccaacctgatcccccatgttattaatttccttatttatcttccgacaggcatcctcaatctcctcctctccagtaaggaaaacaaggatatctccagcaggttcacacatatgtatctgaacaactgtcctgatagcagcttccaggtagtccctttctggttcttgtgtatagaagatctcaaccggatgaagtctcccaggcaccttcatcaacggtgcaccactgaaataggtctgaaatttctcagcctcaagggtagcactcataacaacaagcttcaaatcaggtctgttctttagaacctccttcagaagcccaaacagaacatctgttgctaatgtccgctcatgggcctcatcaagaacaatcaccttgtacctctctaaaagtgggtctgccatagcttctctcagaagcataccatctgtcaaatatctgataggaagcaatagtgttcaacacaacatgattagatcagaatacctaaaaaagaaagaaacatccgcaccatatcaatctgccaaaggatgtgcaactaatcatgttcttccattaaacataaacaaactaaggcttacttgagaactgttttgtgactgctgcaatcctcaaaacggatgctgtaaccaacttcctccccgatagtaacatccatctcctccgcaacacgccgggaaactgacatagctgccaccctccgcggctgggtgcaagcaaccattgagcggttgctcaagccttcagcctcgagcacgaattggggaatctgatcaacagaaaacgaattaatccccaagaacaaatcatcaataaggcacccatatagcaaccaaaaaccttgacacagcgtcacacatcaatacataaacaaaatctaaccaatttaccatagctccatgccactagtatctaggggaaaaatatcccctaatcatataacacaatatcatcacatctcaatacacaaacaaaacctaaccaataacgatcccctaataaacaaccaataacgacaaacctaaaatacttttacagttcaatgttgagatgtacaggcacagggacagattcaatacctgagtggtcttgccgcttccggtttctccgacgaggatgagggtctggttgtcgcggaggacggcgaggaaatcgtccttctgctgccacacgggtagcgtgcggcgcttctcgaggatctcgaggtacctcgccgagtagggcctccccgtccaccgattgatggacgggttggccgcggcggcggcggccgagccgttggtggtggcggcgcggccgagcttggcggagacggaggtctcgtcgaccacgtcgaagaggctcaccttgcgcttccgctccgtccccatcgcggctgcggctgcggcggcggcggcgaagtgggggtcgggtcggttcgcgcggtgcggaggaggaggaggcggggcgggggaggcgaaaccctagctcggctctgttggggtcgccagatttatatttgggaattgcgcgattggaagtcggtttggaaggggcgaaccgcgaacgggcttcttttccgttaaccggttcagaaggcgtatttccttttactcagtatacgtgttgtagtcatattctacatttctacctggctctttacgtggagtccggtataaactcgtatatagttggggttaaggcaagcacaatgttagctgccgacttcggcaatactgtgggctaagaggtcagacggtattaaaccatcgcacccttcacattgtttatgcgcgttggagaggaataagatgggcccagctaaaaaaaaatcaccgatagtaaaattcccgtgactgctgcatgactccttcccacgagttctgtcagaaacactgtacaaataatattgtttatctcttgttcatcggtagtagctgtatgaccaggttttaactctttgccactctcacaatgcttcctaccgggtaggaagagagcatgtattgcttattaccggctaaaaagcaacaatgtggatgcccttataaaaagttagctcgattttttaatatttttttagcaaatccatctatttcactcatataagattgaaaaagatagtaaagtttagtttagctctatcttcaattctaactctaaggaacaagaatcaagagttaaactgttgctaaatagacattaaggcaataatatatatctaggtttttttatttatttttttctattgaatttttaagatttttaaaatgatatttttctttacaattacggttcgattgtaacttgtaagaaataataataataataataataataataataataataataataataatagagtaaagtccgtcacctgtccctaaacttatactgctgtgtcatctcggtacctaaactcgcaaatcgatcgtttagattctcaaacttgttcgattgtatcatctcgatccctaaacttgcagattactcgtttaggtcctccaacttgttcagttgtgtcaccccggtccctaaacttgaatttgaatatcatctgggtcaaataggacgatctaaatactttatatttaaaaataattcataactttttcatgtgaactctaataaagacaaactttatatcaaacttgtagccctcgacgcgatctacaactttgttgttgaatttttttttattttaagtaattttttgtcccaaaatgtaattttaaaattaaaatttcaaaatctataaacatgcaacaatattttgggaccctaaacagttttaattcaaaaacttttcaactacaaagttgtaggtcgcatcgagggctacaattttgatatcaagtttgtcttcattagagttcacataaaaaagttatgaattattttttgatataaagtttttagaccatcctgtttagggaccggggtgacacaactgaacaagttggaggacctaaacgagtgatctgcaagtttagggattgggatgacacagtcaaacaagtttgaggacctgaacggtcgatttgcgagtttagggaccgggatgacccaacgctacaagtttagggaccggtgatagattttactcataacaacaacagcagcagctctatgtagggaaataaaaaagggagacaagagttctcctaactaaatagccacggtttgattcctctgaaggcttcaattcctttttacttcacattctctataatgtatacatgaaaatataattgcaaaattaaatggtttcgaaggtgaaatgggatggaaaaaggcaccaatttaggagtttcgcaagatggcttggtctctttctttgctgttacatttatatggttttgtttagcaaatgggattgggacccacactccaaagggcaatattgcatcctagccattcattcttcacacatcatttaatcctagccactcatccatttccctttcccaatcccatctcctatattctatttgccaaacacaccctatatgtactttacactcttggcagaatgaaaaactttaagggcaccatcggaatgcaaatatttgacactagaagatctacaaacacacagaagtcctacaaaatacattcatgtcccactggaaaatttcaattgtattacatgtcatgtgaaaaggaaaacttcttgaccagtatatctatgatattcatatcaacattttgtacgtttccaaactttagatttttggagaatataaataatcaaaattgcgtttgtagtccaacggttaggataattgccttccaagcaatagacccgggttcgactcccggcaaacgcatgtttctctaatttttgctaaaattttggctgatttatcataatcaattacatacacatgtcgctgttttaatccctccagtttgagtatggggttatgtggttccatactttagataaacgtcactacatctatacaatttatcttcaaagctatctgacatgccacgaaaacatgcttctgtgctcatggccatgcgagtctcgtttcaaagtggtcaagttggtgttggttccttttctctttgttttttccttgcttggaaagtattggtgcgattaacagtgcaaattgcacaagagaaaattatattgcatagcctcgtcaaattataaattgtctcatgtgttcaattcctagttgaattgtatagttttagctacttcagttatacgcatgttgtctcgtgtcgtcaacactttttctttttgttactggtgttttttttatttcatatgctttttttgatcgggtgcgagtcactgataggtagtcgggtgaaaacgggcggatacggtcggattggcattcctatatcctaacctatatttttctttaaattcggaggcaggtatggctagtgccgaataagatatcgctcatcctgtgtcctatcccatattatttcattcgaatcagattcggaaatggtatatattgtatctctaattcatatatattaaatataataagataattaaagtattaaaagagatatatcaagaaaaaaattatacaatattacatgtgagctcgtaaaatagtgattaaccaatcttttatcatgtttgtaggtggatttataatagatttttcatacatattttataatatgggacatgcgggcggatacatgtcttcccgtatcctaacccatatttctaacgaattcggattcgaactcggatagtatcgggtatcccatttttttctcccatattactcctacgagccttgggtcgggcgggcaatcgggaaatacccgccccattttcacccctagtcgagagtcataatatatgggatcaaatacaaatcagaacatattcattaacatttgtatatgatatggatatgagtacaagtcgaaatgtatgttaaagtaagtttaataaggttttaagcactggtcctaaggcatcacatgattaaatgataaagtagagaatagaatggagagatgaagatgaaccactccttatcaaaggcaccttctacacaaactccaaatgaaggtggtctttggggatattgcgatctcatatcgactaaggacttgcatccgtccttcacctaaaatgagttattgctctccatgtgcgtatcttatgagatcttaatacttgctccttctacatcaacggcggtttgaagttttaacatgtgaattttaaaatctttacgggaaggttccaatataagtattgttttggaaaatgggagtttcacaagaaaacattttaactcaacgtgaaatgagaaagttccccacatatgctaaacaaggctttaacaatttaggggtgttttgatgggttgtgaagggtgggatgagaaatagagatgaatgaagggttaggacgaaattagctgagaaatatggatagttcatattaaaacttgctatagtgggtggttatttattcgaagaacccattaaccaaacatgccatcatttatgtgaaaatcggaaaaacaaaattgtaagatcgttaaaatgggccaaactatagtatagaggcaagggtaaccgcaatgcgaaaagggctatagcacaaaagggctatagcacaaacatttgcttgactaggccccacacgaacacacacgcttttaatatttggcaccacatgatttctatttctaataagtttgtatacctaaaagtttatactcccaaattttatagggactaaaaaaatgcccgtgcgttgcaacgggtaaaatgcccgtcatccgtggcgggtgccataactaatctcgtttgactcatatgctgggccaaacctatctatgatgggccttatgcttagtccgattgagataattatcattcgtgacggtcaaatacccgattaagataacttctcacatcagtgacttttgcttagcgatggtagcccttcctgacactgattgagacctatcccgtgctagtgaatccaacggctcacagaaggtcgcagcacaatcggacctctgcatcgtgactccgtggccgtgggatgagcaacagccagtcacctccccattgcagaaggttgctattgatccgatccgatttatcaaaaaatcggagagaaagatttttttttttctgaaacaagatggcatccagtaatgaacttcaggggaaaagttgatatttcacatgaactgtaccataaaaacagttttgcaaccaaaaaagactaaaatttgctcaacaattaacccaccgtacaacaaaatcgcaatcagttccttcaagcaaggttgtcccgattcgtatcctagtatcttacgatactacgatcctatcaagccgaaacgataccgatcccacctagtatccaaattttcgtagtatctcgatcctactattcattactacacgatccaacaaaattttaggtggtatcccgattctacaatccctacgatactacaaaatattatttaaaataacatggtttgaaaataatgtaactaaatatgctcaaatttatataaaaatcagttaaatatatcaaaaccaacgtggtttctcttgataaatgtctctatttgcatgatatatatcatcactatatttttctatatagaatggctatatataattaatataaatattaattaaacttaaaaaaaataaaatctcatagtatcccgatactacgatacgatcctacgatacgatattactttgagcaaaacgatactacctagtatcccgatcgtgacaaccttgccttcaagtaaacaagctcacagccattgcgtacaaggatggagcagcatgctcaccggaggtcatggactcctaccaaggccggtgcagctacctggcctcatccgaggatagattctaatatctcgg

SEQ ID NO: 60758 - DNA, 26946 bp, Oryza sativa
agtgatatattacatattaacctatcttgtattttttttaaagttttcataactatttagatgacatgcaagaaaagggtaaacgtccacccgagtgtttaaaacagttcccggcctcgtcctccttggccaaacatgaaaagagaccgtgcgattaatgaaacaaccctgatttgggcgttgttacgtggaggcagtgagacgctagagatcagttcgaattgagaaagaggagacgacgagatcgagtcggaaaagcatgggacgggacagacaggaaaggacgaggcgaagctgacggatcaacgtgcacgcctgaaaggaccttgatgtcgcctagaggggggggtgaatagtcggttttaaaaataaatgcggaagctaaaacaaaatagggtcggattgtctgatatcaggtcggatagtcctatgtgatcagatagtctgaactgagatcagactatctgacctgcacaacaacaatacaaacaagagaacaacctaagagatctagattcaatccacaagcaaagaggagagctcgaccaacaacaatattagcatagcacaaagcaatggaacaagaaggtaaagagagtgaggatatcaccgaggtttatccgccgatgtatttcccggagttcaaatccttgaggggattctagtctccgttgaggggctcgcaaagagccggatctttttcaaccctatcctcgtgaggttgcacaaatgcactcctccttccactaagggtatctctttccttgcggaggcaagatccggccttcacaaacttctcttggccaaccacacgtagatcggtggcccaagaacgacacctagccgtctaggagtcctcaacctccaagagtaataaacaccacacaactcttggacaaatcctagtgctcaagattaagagaaacacacactaggctcccaaactccaaattcacacacaaagatccaagtcataaagaacaagggggatttgagatagagagggagagagctcaaaaatccaaagcacttagcacaaagctcaacccaaagcaagataggaatgtaatcagtttgggcagccctagaaaagggttggtggggggtttatatagatccccaaaatgtgaccgttggaggggaatctttcagcccacgtcggatagtccgatacgagatcggatagtccgatattttaaacctccaaggcaacgagaaatagagaatgaagttccatgaaatttcggactttccgagacatcggactatctgatgttaaatcggagtatgtgatattttagaagcaaaaacttcgtcctcaaacagagactcaagttctatgaaatttcggagtctctgtatcatcggactatctgatccaacatcggatactccgacacttagaaaaactcactcgaaaggatttttcaaacaaagacagagagtgaagttctgtgaaaaatcggatagtctgatgttgctcaagtaaaaatgcaataactttttactccgaactccgatttcgaagatcttggactctatggaaagctagtttcatgggctatcaaacccaacataaaacatggtccaaaacctttaagagattatgaaaaacttgcaaagaaacccggtgtaagtgttgtgataagtgaaacaactcggaattgaaattttggcttagtttttcaactcacacaaagatgaagcattttgagcactagtgttcaaccaattatatgcatgtggtatccctcttaatagtacggcatcctaaactcaaatttaaaaagcaaagttaaaccaataggagtaccttcacaccatattgtttcttcacttggagggttaccaacgtcaaggtcaattgattatcgggaagatctcatcttcttgatctttgacatttcatctttcatttctcaaatgattgatgcggataatccatggcttcaaatggcctcgcacggttcatcacgacacagtcttcactcacccttcaccaccggtttcggttcgtcggccccaagccccttgcttgcccttcaccaccgcatggtccatcgcagctgagcgtcacttgcgcttcaccgtcttgccataggtagtcacttcatacccgcatcttcaatattttctctttaattctcatccatctataagtccatttcctagcttcttcatcggactaatcatttgcttatacactcaataagcgcattagtcccttaatcgcttgtcatcaattaaccaaaacccactaagggcatagatgctctttcaatctccccctttttggtgattaatgacaacacgattaaagcttacaaaagattgataataaatgattttgaatccaaaggttagtttgagctcccctaaatgtgtgcatacaagtttatgaagtgaacacacatgcacatatttttgaaaatgtgagagctccccctaactctttgcatccgtggggtgtattgtgtgtgaaggagataccaaaattaaaacaacacacacaactcaaattcttggcaccaattcaaaatgtatcaaatgaaattattgatgccaattgcaaaaacttgattctatgccaattgattccggtaccgattgagaaagcatgagtaatcaagttttgtagacaatttcaagtatcaaaagataatcttaattgcatgtggcatggtgatcaaataataagcattcacaccaattgataaacactttcaaatattctctccccctttctcatttactctttggcatctttaaagcattcattttgataatttctcacaaatatctcaccctttgatcaatattttctttatcccctttagtatacttctccccctttgacatctaacaccaaaaagggcataagtagggaaagaaaagcaaagggatccttgatgagggatcatcgagtacttacctctcaattttatatttcatcacttgtgattaggaaatgaagcaatttcacataaagatcacaagaaaatcaataagcattgagatacaaattttgcgcatagaaagctcacatgcaaagggtttaaagcatagatgaaaaagaatctcacctaagattttcacaaaacatttcacaaatgagtttcgcatgtatgaatctcatagtttgtgctaagaccaaaaattcacataaacattgattcacttagaacaactttgtgattaatactcgcttaatgactaaacaagcatgtcgtcacaacattttgcaaattaggctaattagcaagaaatgaaacttggcctagatgcccagacaaggcaagtgatccaatcataccaatttaaataacaagctatggatcatcaagttaccttccttgtcgatttttgagatgcccattcaataaaattgatatcttgaacccaatttgaatttggcaccttgatgggcttgatgaaatctcttccttgatttgcttgattccaatcccgagaaagaacttaagcttttccatcatgaacatgtttaactccttgatcacagtctacgtcctgatagtgcttgtgctcttcttgtaaggccatgacccgatccggtttagcatttgcaccatcttccttctaatagtccaaatacaacaagagagagtaacattcacaaatttgcagattgagaatgaatagctactccctttttgtatatcatcgaggatattgtggagatgatctcgttgaatgatgtggtgaattcttggatggtacaccgatgggacttgagcttgtatggtgtaactttgctcttgagttgcccttggtatcaatcccatccatttgtgccggaaacatgtcttcatgttcttcatagacaattgcggtaggttgacttgagttgattgaggttgatcaagtagtccaccttggtcatcatggacttattgtggtctcaccttccaaactatcttcgaagatgtttttgatctcctatgagactaatcacaaaaatacacttgataacaagttagtctcaaaaacacaaaacataggatatactccccctaaatgtgtgcttcaaagtatttgaattacttgtagaaatgcatgtgtttaatgaaaaacaaatggggagtgtagcctatattttggagaaaggcacatcttcccggagtctccggggtatgtacccagagcctccgggctcgaatgcatggtgatagatgagcttgattgcaaaccgagcggtcttaccgaagcctttggttccactataaaatctgcaataaatcttgtagataggtcatagaacattgcatatttttcattttgggagttttacccaattctcaaacaattagaagccacaaaaaaacacaaaaatttagaaaactgaaagtttcaggattttcagaatttggaactcaaaaagagcttggaaagggcatcataaaaatattcaaatgactatagaaaaatccaagtaaatttagatgtgaagtccaaccatagaggaacaaaagtcattatataaactcattccagtttgcaacctattttgagatgtaaaaatcacaaatcagtcaaaaaccatgaattttctgaaaatttcagcaacttgagcaaggtgagaaaaagtcaaattctttccaatttaaatcgaaaccttgcagaaatgatcttttcacttaatagaaaattttccaaaaagaatttctcaaaaaagatttttctttcaagagaaatgtcaaagagagttttgtaggccattcaagtcaataaatctcaaccaaagtgtcaaatcacatccaaataagatttttatgaagtttgacatttggaaagccttagatgggttagagatactaattcatgccattattcacaaagaattttggctcaaattgttcaacccaccatatgcaagttttggccaaatatggtcaaatcaagatttttgatgaactttgtaaggctgcaacattagaatggttggtcttttacaaaagctttgaactaaagatatgtttgaaatgaccaaccctaaaagttttaaataggcaactttttcaaaaactcaatagatttagatttgaggtaaaatctcacttttagcaaaaacaagattgcaagtaggcggttttaaaaataaatgcggaagctaaaacaaaacagggtcggattgtctgatatcaggtcggatagtcctatgtgatcagatagtctaaactgagatcagactatctgacctgcacaacaacaatacaaacaagagaacaacctaagagatctagattcaatccacaagcaaagaggagagctcgaccaacaacaatattagcatagcacaaagcaatggaacaagaaggtaaagaaagtgaggatatcaccgaggtttatgctccgatgtatttcccggagttcaaatccttgaggggattctagtctccgttgaggggctcgcaaagagccgggtctttttcaaccctatcctcgtgaggttgcacaaatgcactcctccttccactaagggtatctctttccttgcggaggtgagatccggccttcacaaacttctcttggccaaccacacgtagatcggtggcccaagaacgacacctagccgtctaggagttctcaacctccaagagtaataaacaccacacaactcttggacaaatcctagtgctcaagattaagagaaacacatactaggctcccaaactccaaattcacacacaaagatccaagtcacaaagaacaagggagatttgagatagagagggagagagctcaaaaatccaaagcacttagcacaaagctcaacgctcttaatagtacggcttcctaaactcaaatttaaaaagcaaagttaaaccaataggagtaccttcacatcatattgtttcttcacttggagggttaccaacgtcaaggccatttgatcatcgggaagatctcatcttcttgatctttgacatttcatcttctatttctcaaatgattgatgcggataatccatggcttcaaatggcctcgcacggttcatcacgacacagtcttcactcgcccttcaccaccggtttcggttcatcggccccaagccccttgcttgcccttcaccaccgcatggtccatcgcagctgagcgtcacttgcgcttcaccgtcttgccataggtagtcacttcatacccgcatcttcaatatcttctctttaattctcatccatctataagtacatttcctagcttcttcatcggactaatcatttgcttatacactcaataagcgcattagtcccttaatcgcttgtcatcaatttaccaaaacccactaagggcatagatgctctttcaatgcctatcgaccggccgaacctacgaaacaccaaactcctgaatcctgatccaatctggacacacaatgactgacgaaaaactacggcaaaaacatcttaaacttttataatagtagagataagtccattttacaccctctaagtctttagtttgtctaaaacacacctcacaactttaaaaccggacatctgacccctacaacttttaataccgtgcaaaaaaccacctggtgtggttttctacactgtttttgtgcactaggatgccacctgtatagattagctagccccacatgtcagtccggttctccttctttctcctccccactctctccccccttcggcatgcgcgcatggattatccctctgcctagcgaggaccgccgcacacccatcgacaagctcgctgcgacggtcctatctcatcccttgcggagctgcaaattcgccgcctgcaaacaccgtcctccaatgcccattccaccaccgtggaggataacagccgcaaccaaatcgagctccaacacacaatgacttaatcctgatccaatctgaacacacaatgactgatgaaaaactacggcaaaaacatcttaaacttttataatagtagagataagtctattttacaccctctaagtctttagtttgtctaaaacacacctcacaattttaaaaccggacatctgaccccctacaacttttaataccgtgcaaaagaccacctggtgtggttttctacactgtttttgtgcactaggatgccacctgtatagattagctagccccacatgtcagtccggttctccttctccctcctccccatactctctctccccttcggcatgcgcgcatggcttatccctctgcctagcgaggaccgccacacacccatcgacaaactcgctgcgacggtacagagctgcagattcgccgcctgcaaacaccgtcctctaatgcccattccaccgccacagaggatgacagccgcaaccaaatcgagctccagcacctacggcggtggtggtggaggcggcaatgggggcggcgttctccagcgaaggcagaggcgcagggacgaagtagctccgagtggagaggtggagctcgccgaagatacatgcgcggggatgagctcgagcgccatgaccaccgcgagtttggcgcacccatccgctgagcttggcggaagcaagctcaagctttactcaatgagcagcgggctcgcctccatcagactgtggtcggtgcgaccggcgtctacgagctagctctgtcatcgttggccgcctagctcctcctctgcgagctccgttctgttgccgcagaccggtccgttctctggctcagtcgagtactacccctgctcctgctcgtgcttgtgctaatccgtcgtctcctgctcagaggcgtggaggccgaagagctttagccttgggattgacatgctaatgactgcaaagatgggcagctagcagcacaaagtactagcttgccgagattagtaaggcagcgtttgtttggagtacattgagggagaaagcaccccgttttcggcacgcacgcttcctaaactactaaacggtgcgtttttaaaaaaaatttctataggaaagttgctttaaaaaatcatattaatccatttttaaaatttaaaatatttaatactcaattaatcatgagctaatgactcacctcgttttgcgtatcttcccaatctcctcaatccccctctccttaaacacaccctaatagtagtatgagtagttgtgatagacaggagaggaaataatttaaaaatatacgtttttttccgtggaatttgcatgaaaatgctgaatataagacgatttacaaaagagtactgttacacgtactaaaattttcttacaaaacttttactaataaatttctcaaccgtttgatttaactagatgaaagttgtaagaaatctagatttactcatagcttgacaaatcagagtttgtaaacattttgtaagaaaaatttagtacgtatagacttttcctttataaaaatataccactgtcgcggtttggtttagcgagaacgcggcgtcgcacgggggatgtgcgagaacgagagcggtatcgctgtttagataagcgaggacgaagtgccggcggtctcgcggcttggagtaacgagagcgtcagcactctcgcagtatgcgttagcgagtgcgatggggccagcgttgctaccagtttcgcggcgccgaaacgtgagagcggcggcggtctcgcgcctgggaagtgcgagagcgagcgggtgccgcgggcctatgaaagcaacgacgggacgcgcgttctcgcacgaaggtaatgcgaaagcgccgcgcagtctcgcgcggtgggaatgcgatagcgccacgcggcggtctcgcggaatgggaatgcgatagtgcacagcacaggctcgcccctgcgccgaacacgagcgatgtgacagcgctgtcgcttgtctgatttgcgagaccgcgcttcgctttccaaattagccagacggaatcagtaatgtactgattattaagttaattacaattttatatttgcatgaattaacaacatgtgataataacatttgttttaaggctcgttagtaaatatatatgagaaaccttctgtatatgtactagaaatataactaccattatttaaacttttcatttgttagacacaacattggccatctatataaaataaaaaatcacatgagctacaaattaattgtaacttacaattagtacaaattaattgtaactttaatttaattttttttaccatataaattaattatgtctatctaatttttaaacccgaaccgactctaacccatataacagaaactacctctgttattattatcctacttaataataatatactatacattattaatattttatatttattaatttcatattttatatttgttgtttgccctaaggaccatgtagctttgcttcacggaagaggccgttgtcttgttcaaaatataaaatttaccggtctcgcaattctaacaagcgatcgagatcgctggctccacgcgcgttgttgcattgctaatgtgcgaaaccgtgccggactaagcaccaaccagaaaatcaccatgggacccactccacagtggctctcgtgctacgaaagcgcggtgccgaggccgctctcgcgcttcaggcatgcgagaccatgggtctcacgcacatctctcgcgcgccagtaatgccacaccacgggccccacaacgctactcctctcgcgcattgaaaaagcgataccgatcccggtctcgcgagggcaatcagcgagaccgttgggtccattcctgctctctctcccaaatcgcaagaccggattaggtcatctctacgtggtgctctcgctcaagggaaaagcgatactgcatcggtatcgcttacccaataagcgataccggagctgacgtcacgctttcgcttattgatattgtgataccgtgtcggtatctctcaatcctcttgcgaacctcggtatcgcgctttcctcccgcgatttcaatagtatatttgtgtaagtcgaccaacatctggtatatttatgaaaaaaatatttatgaacagtatattttcaaatttttttcagacaggagaagcatacacacaggtcacaagagacaggtcgaggtctatatcgtgcttgtgtcggagcagcttcttccctgctccctgcttagccatatatgcgggtcgtgcgcggcttccgccgatgaccgcgcgcagcggcttggatatgctactttcctgcgacaccttctccgccgacgaccgcagctgcttgtcggagatacgcggcactgaccgctcaaccctgccttcgcagtgcctctaccgccgccgctcctgaaaattaaggtcaaaacaaccaagcaatatgggcttgccccatataatcatatgcgctgacgtggcgaagggttgatgtggcatccaacgtatcatccacgtgtgcaaaaaccatcataaacagcccaagggggtcaaatatcaaatattgacagttcagagggtgtattatacccggtttcgtagttcaggggtatattttagacaagttaaaagttcgagggtgtaaaatggactttccccaattttatatactaaaactttatatctggttctaattcgaatcaagtgattttacatataatagtttcataaagtttctacttgtaggtttatatgtataaagtttcggcttgtaaagtttacagtatatacattgagtttgggttcataaacttaaaaatgaaaaagaaaccacgcaaatgcaaaaatggaaaacgagtgcttcgtaggggttaggcgcacgaacatccacgcgttaaacctacccgttattagctacacaaacgacattcatcaacggatccacggaaacgtatcttttgaagggcttgtgcgtgtacgcccgcgtggacaccctcctacttcaattttcatgtgcatgatgtctgatttatagataaagctttatacataaaaattagggcatttacaaatctgccactatttttttttaattttacaaggatgctacttaaatgaaagttatagtgatatttttgcaatttcgtagtggtcgtattatgataacgatttaaattagtggcaaatttacaattgccccccaaaaatacatgtataaagtttctacatataaagttgttgaaagcatgtcacgagggccttcgaccgaggctgccgaaaccagatgggcttgggtgaaacgccagctgagaagactaaggttttcgcctcgaacgtcttcgccactgaaccaaagaaagttataggcttaaaatggcctttcgccacttgagggcccatagtgaagcccattaaggggcccaaggcaaaatagatattagacactagttaccctcataaatgttcatgtacacattaactctaggactaggatgcatgagcttctactaagactataaataaccccctaggggcatgaaatggaggatcccaataattttcatcattaatacatattgttgtcgaaacgacaaccgcatacgtcgaaagacgtggttactcaacagtggttggaaaacagtaaagtgtattaaattaagaatttttctcgggatccccctattacatggccctagggggctatttatagccccattacagattcccactactagggtttaggttatacaggggaatttacatggttacccttatgatagggacattatgaagggcacattgtgtcctttacacacacacgggcccctactgggcctaaacagctcggcctatctatcttgcgaaatcccccgagggcatagcggcccgccaagtctcccgttaacgggttttggtgctatggcgaaacctgtgcccgtgtgccgaggctttcgccacatcatcttcgctcgttccgccttctgtcgagaactccacttgacgaaggtggtgttacccacaatcacggctttcgcccatatggcttcgctcttgtcctttggtgtgagcctgatacttgaacttttcggtttcggcaggttcggccgaaggccttccatggcaagcctccaacacatatgctttacttttccactgtgtgaaccacgtccttcgacatgagcagttgtaattcgacaacaaagttcatatgaataattgagatgtgtataaacttgataaaaaaaatcatgtggatgcaaataaggaaaacgagtgttcaacagaccaaacgcgtgaacattcacgtgttagacccagggtttacgattccgagatggctttccgttttaggctctagtggaatgacggttttcgcgaaatctggtggagagccgataaattccgaacaaatttcataaaccaaaatttaaatataaattccctgattttaccgataagctcacaaaaaccggtcggctttgacaaaattctgagcgaaatcatcaaaatttcaatcggtaactagaaaaagaggtaaactgaaattgttttccttttttaattcattattcttttctttcctattgtaaatttcagtaaatacacgaaatacattaatttttttcaaaaatttatatcccaataggttctatgaatatcatactatttattagtttttttatttttttttcttttttatcaattcaaatttgaatttggatgaaacttatcgaaatctcaaacggcttttattttcgagccttgtcgaaacctttaaatttcgcagaattcgactggttttcgtcagagttgtgaaccctacttagacatacctgttagtaggggtgaaaacggtacagaaacggacggaaaccatctttatcgttttcgttttcatattttattcggaatcggaatcggaaaccccggatacgaaaatggaatcgaatattatcgaaactgaaaacggagcgaaaacaaaccggcgcgaatacggtaacgaaaatttatcggaataaaaactccctcaaactgataaatccaattgaataaattatgtatgtttaaaagagtaatgttgttgataaatccccatgtaggacaaaaaaatattcttatgtaattttagtttgcataacaaatatttttttaaaaaaaatagccaaacaccatggtattcactattcagtgcttaaaaaaagaatccagggtatttctttcacaaaatttctggtaattccgagaaaatttccgaccgattccgagttccgacagaaactgcccttatcatttccgattccgtttccgagaaaatatttccgaatttatttccgtttccgaaaaaattccgaccgacatattccgttttcgaaaaataggttcgaatccggaaagtttccgtaccgttttcacccctacctgttagatgttgcataatcgaaagctacggatggatccataggctaagccagaatcatttcaagtatctcacactctcacgcgcgtgcatgatctagacgcgcgaacgcccgtccgttaaacccactcaccgccatgtgcggcatatgcctgagtgcgaagcatagtcgcatgacgacctacagggctacaactcccagtcccagcactttgccgagaaaaaaaagaaaagacccaaaccgcccatgaccccgcgtctccgccacatcgtgacaccggacaccggtgctatgcaccacgagagcacgagaagagacgcgcgggtacaactacattccacacgcgactactagctaatagcaaagcagcagtaagtaacacgttacaccggcatccccccaggccccaacccgtcaaagcataagcccacacagcgggagaaacactcggcggcgaccggccgtcgcggcctcgccgggaagagcaggttaattagcggccgctcgatcgacgatatggggggcagcctggtgtccatgctgcggtggccgccggacctcggcgtgccgagcctggcggcgctgctgccgtcgtcggcggccggccactacgcgggcgcgccggccctccgcgggtggcactggcagcactggtggccggagcggctcggctcggcggtgcggcggtggccggagctcgtgcaggacttttcccccgtcgtggacgccgtgctctggggcctcgtcaccgccatcgagtccgtcgcgctcttctccatggtgtgctgcttcttcctcttctgcggctgcacgctatgatcggtgccactcccccaccatatagggcgcgcgtacgtacgtacgtatgcataattgtatatgatcgcttcctagctctgctctgaatctcccaactgtttttgattgattttttttttcagatgattctccattttgttgtcggttattcactgtgttcatgcttcatggcaaattaatttagatgccgctaattgtattgtactggtgcttagtgcgtagatttgttactggattttgcttgtctgatgtatgtgcagagcagtgaggcagaagaacagcaagcaccattgatagttttgggtgatgaaatgtttggggagagggattgagtgagattcggttggactagttggtgcgggtgcgcggtcggaacgggggtgagtccaaccctcgaaatatcttatgattttcttaatcgtggcgagtccatgaaactactatttcctacctgattatactcgtcataaaaatataacaaaataacttcgaccactatattttttattataatatataaaaatattaataactgtattaaaatatcaataactgtattatgattttatggaagtaatttttaatcatcatattttataaatattttagatgttatttatagtcaaagtttttaaagtttaacaatagtctgatatgacaaatattattaactgaggaatatataaaattctttttttactcccttgtctcatataagtgcacttactcactccgtcacttaagaaaactaacctaccggaagtaacacatatttttagattaatagtatcataacatgtcacatccaattatatatttgttatttaagattgaaggaatattataggatatgattgaattgttcagatttatagtacacacgtagtactagggtattggaagtttggaactgaaggtgtagttaataccagtaggcagtagctgttgtagacagtgcactgatgagtcgctgattgcatgtcacgtttcggtgttgtcgttctgtcctaggacctcgtgaagcgccactgttgcagtcaggaccatttacaggttaaaaccatgatccgatgactgaccaaaatccggcttcattcctactaacacggcccttttgttcagagagctgtgatgctttcggacgtcgcataacacggcctggcttcaacaggcaatttggcggcatcaacgtgtgtataactgtatatgctcataaaagattatctacgctttgaaatttatttcgactgttaccgtagagtgttcgaatgaaatggtgtctttctgaagctaatgagcgaaccgccacaatttaagatgacaaattttactataggaaatcgtcggttttagctaaactcgtcggacgaagcgtcgccttcctctgctgcccacgcgctgcttcccatcgacggcgatgacccccatggcaccaacggacgggatagagagagaaaagagatgaaagaactgacatgtggatccagggggtaattttaagagtaattttaatatttcaagtgatttttcgctcctctccaaccagaaattattattttaataggtgcgatgtccactgtcaaattaccacgtttatagagtatttactcctaaaagtcactttgtgttgtgttttacaattaaaatcgtgaagtaacgatatactgtagaaaaatttaccatttgagatagcttcgacacttgatgtgtcgagtatccccgcaagattacataattctcttttattactagtattttataaacagactcctaatatcttctctggataacgaaatcctttttattaagtaggtattttaaacagcctcctaatatcttctgtggatatctgctgctcgcaatggcaacgtttattaatgagattgagggcatgtttactttgatgaaaaaaaccttattaaattttagtaattttggcataattgcctgccaaaattttggcaatttgacagcaaactaaatatatccacttttttaataaatttatcaaaatttgataatgttgaaaatgacattaaaatgaaaaggcctgagtaagcgagagctcaacaactgaacagcagacagacgttagcccccattgccccacgtgtagcagcaccaaagcgcgccagtagagagtcgccccggctctcgtccacacaatgatacaaacaaaactaaaaacgacccgtccgctcgacacctcgtgctgcgcggacgaaaaacaacggagcccgtcggtcccggtcagccatcttattttgagcggctgacgcgtgggtcctacagtttgtgatctttatatacgaataacccacgttagagggcagtagtacatgagaacagataaactcatatcccctttaattcaaagaaaatttataggaattcagaggattttattcttatagaaaattttccaacatagccctttgaatcgaagtaatgaaccctatgaaatcgtatggaattcctatggaatgccacttctatacgagttttgaaggaaatttaacgtgaggtaggacctcatgaaaataatcccttgagtttttatctcttctcaaattcttatggtttttcctacatccaaatcaaacggtcattcctatatttttgtgttacaataatttgttttacacttgcatttatgttagaatcctatttttttatttctctttttttattcctgtgatttaaagggttgagaatattatgttagaatcctatttttttttatttttttttcctgtgattcgaagggttcttattattctcaggtgggagagtgtgacgtggtcgctcttgtctctcacgtgccaggattgtaagctgcagcgccggagccggagcttaacgccatttggttggttggtccggtcgcgagaagaatttaccgcgcgcggtgttccgtccgtgccgtgcaccacgaatccgttctcagcgagggtcggataaggacgagcatcccgggcttccttctttctttgagcgtctacggttaaaactcctctactcgaagggtcactgtcgcctgttattgccttgcaaacgtaaccacgtttttcggacgaatcaaaactcagcagaatatgatatgcggtctcaatttcgtagcctgctcgatgcaaaggcgaatgctgcattaatgaagactgtagcaaggccacttgcgattgaaaaagacaggcgagcaagatttatcctgcttctgattttattccgaaacacgcatggcacaaattccacggatgcattttgcgtgcatccaaaagcctttcaatcagcacagctgaattagcgtaaccggaagttgttaaaggtcaggacacaattcggtgttcaccctcagctttgaagattttcgcccgttattcttcctgtcctggtaaaaaatttggggggattaccgagttccggaacgggtgctcactcgatcttaaatccagattttagatcaaccacctcttcgatatttctagccaaaaattctgcctctccgatataagaatgtggtgttagcttcagaagcgacgatcgtgccgcctctggcaagtctagatcttcaatgaattgccgtatgctgtccttggtgacagcctgccctctggtcatttccttcagcttctcataaggttcagggattccataccttcgcatcacctacaaagatgatataataatgtatgatatgcatctgagcttgaaagacgacagacaaatgatgatgaatacagttgatgtatctggtgaaaatgccaataggtgaaattacccccaatatcaaacttataagttctgagaaattttcaaaatattgtacgatgtaggagaatatgtcgttttcgaaccaaacaaaagcaattaaactaaccattctcagtatcaaaattcaccatgaatacacctggctaaaaacgtaaaaatcctacctaacaaagcattaagggcaatgcaaaatcacaaaacaagcatccaaaagacactttcgacaatttgaaagcatctgaagaggcgcacaaatttctaggacaaaccaatacaactcctccatggaagcataccattgtgaaaacaaccagaaaccatatagaggacaaaaagaatggtcttactgtctgtattggctctgcaaggacctcccatgtttgatccaagtcttcagataaccgggattcattcacctaacaacaggcaaaattcagcataaatacaacgaagtgtcatagttacattttggctagtaaacttaacaaagttaaggtcaattacaaaacagactaaatgtctaaaattccaatagtccgaaaatgaaattatgtgtagtgcacaaaggaatatcttgtttctagtacgacagataccctgactgaggtccttcctgtgcatattgagtagatacaaataatagttggggtaagacctagccacatccatcactttatagttcacttagtccaaaaacataaagtgtgggtgggtggatgtgcatgcttgggcatcaaccattcagcatcacagcatgcatagaaagacttcaaatacaaaatatgctagttcaatacttggacaatgataaaattatctatacaagaataattcaagaaacaaccaaatcaaacaagaggaggattgtggccacctacctgaaccttattgattcctcgcaatgtagctttgtaagccaagagtgaatgccctaatccaacacccaaatttctcaaaacagtcgagtctgtgagatcacgctgacagagagacatggttgctcattagttcaatcttaagtaaatagttaggcatgtctgactgcttgctgtattttacatcagtggcaagctacaatttttgcatgcacattggttgaccaaaattgcggttgcattgaaaaatgaggtaagaaagcattaaattgtgcagaggtaagaaagtgtagcgtgtgccacgagttcgacagaaatccatggactatagcctaataaagccaaacttaagaacaccatttgtggcaagttaggcgtctgttcttgcatgtgcatcaacaatggatgatgtactacccctttttcacaactggagatagtaaaagtggaaattgaagagtacagacagtattatacctgcatccgagaaattggtagcttcatgcttaaagaagacaatgtaccattggctatagtcaaattgccgtcactattttcgaaatcaatgggattgactttgtgaggcattgtggaagatccaacttcaccagcctttactatctggaacaacatttggaaggatgcagtaagttcaaacagaatctaaaactgtagaccactaagtttttcccactatgtactaaacgaattcaaccaaaccttaaagaacagtccttgcatgttagtattacctgcttgaagtagcctagtgatatataggtccacatgtctctatcgaaatcagtcaagacattgttaaactgaacaaatagattgaagagcttcgagatatagtcatgtggctcaatctgtaaaaaaaagttaaaactgcgtcagaccaaagagtatcatatgactttagaatttacagcgcagttagataaatggaaagtgtattaataggaaattctccacaccaccatagttcaagaataataactccaataaagcactgaactgggaatacaaatgaaacaactggatatcaaaataatgaatataaaccacctgggtaacataaggattgaactccaagcccaacgatttgacaaaatcttctgcaaccttaggccagtcaacttctggatatgcaacaacatcagcgttgtaatttccgacagctccagcgaatttccctagtatcttgacctcagaaaaactatttcctatgcttgacaatctggccgcaaaattcgccatctcttttcccagagttgttggcgatgctggctacaagcaggaaagtggaaatctaagctagcgttataacttctaagcatatagcatcgattacagtgactctgtgtacatatgtacgacagtacaagcatatattactgagtatacttcagaggtggttctcgtacctgtccatgagttcgcgacagcatagggatggttgaattttgtgttgccaaggagcacattgctttgcatatgtccatcataacagggaacataactgtatttaccccctcttttagagctaatgcatgtgacaagttgttgatatcttcagaagtacatccaaaatggaagaactccaacacctggggacaaagatacactcaacagctagcaacgaagtaatagtatgttcaggtattggttcacacagaaggctgacatacctttgcaatctctggatttgagctgcatttttgcttgagaaagtactcaacagccttcacatcatggttggttgttttctcaatctttttcacttcttttgcatcagcaacactgaaatcctggataatcgcatccaggaataactgggcctccttgctgaatggaggcacctcattgatctcagggatttgggagagtttcagtagccactttacctacagagccagaagtcacttcagataagcaacattgattataacactagcatcatgccccagtttctgtatttaacacatgaatcaagcatcctagtttatgtgaggaaatgatgaaatacactacaaatgatacgagtgcaaaggaatccaaataaatgatacctcaacgatgacccggtatctgatgaggccgaactcactgaagaagggtttcaggtccctggtaaagcgctcgtaccgcccatccagcggcgaaagccccatcaggcagaaagagtcgaagtcctctgcccgctgcatctcctccagcgacctcgtcgcccaatccatcggagcacgcacctaaccaaacagacccccccccccccccccgtaaggaacgacaactactcaagcgggagttcagagtttgcacgggaagagtctctgctcacctcgacggcggcggcgcctgatgcagagcagcgcaagcgtcgcggcgggacgcgggacgcaccggacggggcggcggcggcggccgtagcgcggtgggccgcggccgccgcgacgagggaggcggcggcggcggccggagccttcagcaacggcggcgccgacatgcttggggggttgtcgtgtgggaaaaccctagagcgagaaggacgcgcgcggcggctttgctgggtggctgcaggtgggccgtgcggcgcgcggccggagaagaaaggagggcggaggagatggataggaaatgattcgtagggtttaaggggagggggaaatttttccgggggagatggacggcgaagtggcgaaccgatagattccaacacccccaacaagtgggcgatgccaccgcgccaccatgaccgttcttttcttccaaggcacatttcccttctgtcccggactttctcagcccagcccaatcaccttgcctgagcccaatcaccagcccaatcattcttttagggaataagttcaccagggggtccctcaacttaacagcgagattttttgtgatcccttaaccacaaaaccagaaatgtgtacccctaaactccctcaaaccgttcaccggaggtccctcggcagtatttttgcccggttttgctgacgtggcatcctagtcagcaaaaaaaaattaaaaagtacatgggacccacatgtatgtcagctgcacattttcttttctcgttttcttcagtgaggcggccgggcagatgagggcgtggcgacaggcggcggtgcgggcacagcggcgcgcggggaagaagcgagagaggggagaggaagtgggcgcggcggcgggcggcgtggagcgagtgcgccagcggtggcgggagagggggagagaggcggctgggacggcgggagcggcgggcagggcagcgggtgagagtggcagcggagcggcggcgctcgtcatgctccagctcttcaccgccggtgtcgtcgtcgtgttggttgacctccacgagcgcggtagacgcggcagcggtgggcggagggcagcgggcgattacgacggagcggggggcctggtcggcgagcgacgcggagcgggggcaagtgtggctgcggagcggcggcaggcggtcggcggcgacctcttcgccgatgcggagcgccaccccctctcccgctggcctcatctccgcccttgaagacgaggttgatgggctcctcatcgtcgtcgccgtccccgggtgggagcggcggcgcagggggctcgtaatcgtcgtcgtcgggcagggcggccttggcgctcttctcgccagagaggagagagagccggccgagcttcactcgcgagcttgtcggcggcaatggcgtccctccgcgcacgagagaagaaaggccaaaagcccgtgaacgcatgcatgatagctatgggttctcaagtgagggatacatgcatgcaatagagagaaaaagaccaaagcaaaagcagcttgtgattgatttgcaggctgcacgggttgaaagtgtatatgtatatattcatgaatgaatgcatatatgcatgtaactctaggcctcgcccacggcgacgacgacggtggagagacgacgacgagggcggccacggcgcgcggctgctccgctccgccgccgcgctccgctgcctctgcttcgccgccggacggccgcgccgcgtagcctcgctcacggcgacaacgacggtggagagccgacgacgacggcggccacggcgcgcggctgctcctcctccgcccacagcctgaaggagaagaggagagaagaagaaaagagaagaaaaaaatgtggagccccacgtgtttttttaatttttttttgctgactaggatgccacgtcagcaaaatcaggcgaaaatactgccgagggacctccggtgaatggtttgagtgagtttaggggtagacatttctggttttgtggttaagggacctcgaaaaatcttgctgttgagttgagggacctccggtgaacttattccttcttttagggcattcacgatttcaaaagtacaaatgacctcctatagtatttaatccggacacatggcgcccccttcctgttctcaagcggttttggcactgaagtagcaatccagtcaaacaacatttttaaaaaatggtgggactaaattgtaagtgcctttccctttctcagctccaacgcctagctcaccgggcactccatgaccagcgatccacgttagttgtttttgcccttgttgagccagccagccacaaccatgcatctcctcttggtatccatgtgctaggcagccagcgatatctaagctcgagatgaggtgagggagggagataagataaagggggaagaagtcgatgtcacttcatcctccacctcactagaccctgcctagagctccacattcgcccacactgccactagctctaattgatccgcaccctaccgctccagtcaaaaagggagaaagagaagaggtgatgagatgctgcggtgctaaagctcctagaaacacacatggtggagatggatctctgcagaggaggcggatgcggtgttggagctcgagctcgcctttgctactgctcgtgggcagtggagaggaggcaaattcgccggtggttggcagatgggagagaagtgacgaagagaggaagagtgcatcaagatgaggcgaccattgacacgtgggttcaaccatttttttaatttgtttttttgatggggttgcctcttgtatgtcaagtaggacaaaaatattgttcctcgctaggttaaggcggtattttgtctagtttgaaaaattgagaatataaaatgtatggtattggagttaagagggataatttgtgcttttataatagttgagggggtgggaggtaaattggatttaaccttacttgaaaaagttcatctctcacaatacaagtggcttcaagtgtccacctcagaagttttttttttaattttagcccttgtatatttcaatctacatgtaaattaaaaaatacactaaaatcaaataaaacaaaaaaataatataaaaaacgtagcgtaacctaatccaacatttattccccaccacccacaccggcaaaacaaatgaagacgggtggcaaggacactgccggagtctaagaaaaataagtagagaaggtggtgagggcgctagttgtaatggtcgaggaggaggtagattacagtgactgctgctgcatcatgcatgaacagctctagttgcacgaaggttgtcgttagccgaatctccttcctcccctaccaccatcaccatgcctcccttcctattgttcgttcccgtcctccttgccaccactgcaaatccaacgtcccgttcctgtcctcctccttgctaccgcttcaaatatgatggtttggatggtgcatgtggttaaagtgcaacctcggtggcactgcttagaacaaacggtctcaacgaaaattttgtatgtagtgatggtttgcgtggcccatggtggtgaagaccctaacaacgacaacagagcagcttgacgtgctaatgagggaccgttgcagtatgtagcgaggtgacaagatcaaccaatgcggctccccttgagtggctctacatagcaggagccttttctaggtgaggcactcattccttgcaaaggggcacaagcttcatgtggaagccactcgcctccactcctctctccttaggctgtgtttggtactctattttcctaactctcctctctcattttttgcgcgcacgtttttcaaactactaaatggtgagtttttttcaaaaagtttatatacgaaagttgcttagaaaaatcatattgatccgtttttgaaaaaaatagttaatactcaattaatcacgtgctaatgaaccgctccgttttccgtgcataggagatgggttcccaacccccacctccgaacacatcattaactacttaagtgcactgtgaatgttttcagtagttcatttctttgggatgagcccacaagcctagataatgttcaagttaggtagtttatcattgtcctacatttacttcttttttgctgttctttatcccaagattaaatctttattattctttataaggatctaaatcacttctttaaatgtcacggatcaatgtactggttttttatggacgacatagtggaaattattgtaacatttttgtgagctgtggttcaatatgtcatattaatttgtgtacctcattgtgtatatcaagattagaaatgtaccttttcatggtcagattaatttgtatcttcgtatacccaatggataaacactaaagcatctggaagtaaacaactacatttataaagtgagaaatggttctctatatatatcccatataactcttgtatctcatttcgtatatcaaagatttatgtgtatattttcataaatggtttagttattcatatcttcatctacattgagtaacatctatctctacgtaaacgactacatttatcaagtgcccttttgtataactttgactctagatagcagtcattgataaacataagcatatctgaacataaatgactacattaaatgactacacttattaagtgacaaatcgttctctctctccaaattaatccgcgtatcatttgtacataaaaacttatgcatatcttttttcataaatgaattaattatgcatatcttcgtcttcatcatgagtaactgcaatctatatggacataaatggctacatttatcaagcgcccttttttaaactatagccacagattacagatagcagtcattcaatatcataaaagaatgcaactcattattctcatgaaggaataattacacaatgacaatattttctttctcaccattttaccttggctttaatcctactttcagtcgatcaatccttctccaggttatagaatagcgtgtaccaaaagcacgaatctaatcacggattataatggtgcatttacaataaaacaatataatcgttgtttccattcaagtttcggcacgaaaaatacttataatgttttacatgaggagttatgatatttgtggcacgaaaagcaggactatactatgatactattaacttctctcgctacaatcaatttttttatagtagcactatctagcacatacataagaatatggtgagctaaaatcgacccatactactatcttagaagtttaaaaaactacaaccatcctagagtagcaattttgttgagataggacctattcggtgacaccaacagtgccgtatgcaggagtatactttcttcgtacttataaagagagtcgtttatgacagcgacacggtctccaaaacataactttgacttcttgtttatataaaaatatttattaaaaagtgatatatgtatacttttatgaaagcatttttcaagacaaatctattcatataatttttatattttcaaactcaacatcttgagagttattcatgatttatattttcaaggtttgacttaaacattgtcctaaacaattttctttatgagtacggagggagtagtctgcagccggcttgcagaatagttccataaacatcattttttttttgtcagcagctgttgccgtttgtacccatgccgggtcacgcgtaccctacgccccctaccggtgctccaccacgtcagcggctcgcgctcgccccccctccacccatcgcacacggcaaacacagcgcaaaacccccgtgtccgttggcaccaccaacccccgctatataaacccccccgtctccgtcgttgccacaccgtcttctctcttctcctccgccctgcctcgactcttttctcccccattttccccttcccaactccccccaatacacaac

SEQ ID NO: 60759 - DNA, 12325 bp, Oryza sativa
ccaatacacaacctctcaactcaaaaccccctcgaggcctcgagcctttttttttctgcctcgaaacaactgaaaacgcggggggttctctcgacgtccccccggccgcggccaacaccaccgcgcgcggcgacgcggaccggcgtggcctcgccggccccgggcaatgtcccgcagcagccgcggcggcaggcagtcggcctcgtcggccacccggatggcgtccagggcccgaccgggtttccccgtggcgccaccaccacccatgggcccgccgccgcccccgccgatgcccccggtcccggtgatgtatctccggggggtcccgccgcccccgccgtggctcccgcagcacctgatcatctgcgggctcgatcccgcggccgccgagcggactgacgctttccggagcaaatccctcctcaacgtgagcaccgggggcgtttaagcttcgtacgcttcatcgtatggtcctatggtgtttgatctcgtggctaattttggggggatcttcttgtttttttttacgaggtttagttcatttctcgtacgggggttttgccctcgccggaggaggagttgaagaggcaagtggtggtgcgggagctcgataaggtaatgatcgttcgggtttcggagcttaaaggttaaagtttgcgatgctgactggtctgagagccttgatccgatggtggtttttgcagatagtgatgggttgggcgaagagggtggcgtacgaccagagggaacaatattggaacacaacagctacggtgttgacctttgggtcgtatgctttgggggtaaacaagaaatgttcgatttgtgcacaatttctgggattttttttttgtgttgatgcaatgtccgattgattttatagtgtatactgttggagtgatataattattttgcaatgcatttagttatctgtcatatgttgtgctcattttgaacctaaaagtgttaccattaattcgtcaattgcccagtcattttcagccactgctcttggttatgagcattttagagctgctacaggagaagccacgagctagacatagctcgttgttttaatatttggaattacatgtatgccatgttaattttagcagagcatgtttatttgtgagctcaaacaatctttcaatcatttttttgagtggaaacaatttactgctctagtttttgtgtgctaaagaagatgaccagaacctgagagagagagagagaaaaaaaaggagaaacttggttctttggcttgctcattgttctttttctaagcctcttggtgacttaatgatttattctggattgatgagccagaatatgccatagtgactagtgagtgtaagcgaataaagtttctgaatggatagatcatatgttcttagttgtgcttgtgcatagtcaacttaatgtggtgtttgttgatttgacataagattatatggttaaggaatacatagaaagattaaatcttgacatctgttcccatggacaatattctacatgtaaataacatgtaagatgtttaaatccatgcttgaaagactgatggtaggcaaatcagggaattagagaactcactaaatatccatttgtattgttgacattgtgcagagttttaaggatggaaatatacttatgcatacaatcttggctcggttaatcttttattacatgttgataaaatagactgggttaatagtagtattttaactttgttttgcttgtctataacattgcctcgtaactaggaattcccctttgagatttttaatatatcttattgtgacaagcgttgcctaaaatgttctgctttgaaggcatatggacctgaatctgatatagacgcagtctgtgttggcccttgtattgcatcgttacaggtgaatatctctttcagttttccctttgtccactagcttggagctttcgaaattaactcagtgtgtatgtgtgttattgtatagcaccattttttcattgtcttgcgacaaatgcttgaagagaggccagaagtatcagacctgcattctattgaaaatgctaaggttccattgatgcgctttaaatttaacgggatgttagttgatttcccatatgtccaattgccagttatcaatgctgcagaggcaagtaccttatgtcttatgattgttttgattacatgactatagttacatgctatcataattagtgttctgtactaccttatatatgtgttataattgtcccatgattaattgttgattcagtcaagttttcttaaaacaacacctttcactgaagatatagaacctgctggtgatgtcctggagctaatttgcaggctttattttttaacttccttcaatattttaccatgatatggtttcattttttgcagaattgcattcaatcatgcataatatttttcgaaagcattgcatgctaccttgttaagtacctattaatggattagatccccccagaaaaaaatgaaatgaattcgaggtcatgtgttattgtggggctccagtatcactggctttgattcaacggcgatactggagtcccaccactgctgttgcaggcttagtttgaatgtaatagtcaatgttcaccataacaccatgacttcatttcaataactgagttgtacatttacttgtgctctgtttgatgagtttaaatggcagagcatttataaggaatgacgccttcactgtctttatgtgtatatatagatgtatatatttaattggtttatggaatgtattttttgaaaataatgtattttatatgcctattaatggattaggtttcccccaccattttttcaggcagtagctttagtttgccatttgactgtctacatttgttttagaatgctcttggcctctgcaattaaaatcagttaaaacacgatacataatcaactagtccattcttaggcctccctggtttgacatgtgttgttcattatcaattaaggctaactgtgaaccattttgtcacacacagattgttaaacacaatattgtggtggttaattcaagttctcacaagttgtttggtgatgcaggcaatacatgcatttgaccctcgcttgctagcggcggttaatgaaccaagctggagatgtctatctggagttcgtgttaatagacaaatcatgcaattgcttccaaatataaaggtcgaacactagcctcgcttgattaatttatatgccattctcatattttctcatggtagttgtattttatttcatattttcgcacctttgtttcactttcttattcctggttattttttgttaatgcaacaataatgcattacggttcccttattctatgttgaatcttttatctgctgagctctctaaatttttcttgctaatagtctttttcttttttttaactgcttcctttttctgacgtttaatgcagaagtttcaaattcttttgcggtgccttaaactatgggcgagaaaaagagggcttcattgccatgtatgtggcttacgttttctttatcaatgacagcttatggttttgtcttcttttttggtcttacagtgttatacttaattttatggtgttattttcagctacttggcttctttgctgggatccatttggcgattcttgcagcatttgtttgtatcatgcatccacatgctactctcagctctttgttcaactcattctttgatatattttctcactggcattggcctcttccagtgagtttacttgatcagccaactccttggagacctcattgctgctctttcatgcccatagtgatgccctgttctccaccagaattttgtgcctctagtataacaagaagtacctttaacaaaatcaaagaagaacttcagcgtggttttgctttgaccaaggtatgttgaattgcttattctttatcaactactatttagctaataacccattgtactctctcactttccgttcagaaaaagaaaatgagtaactagtcttagtgcaactagtatatggtcagtccttcctcttttgtttttgctgaactgttatatttgaataatttgttacttgaatcttcagttaactctattttaagcatttaatatccagtctccttttatgcagtagtcagagcacctaccgtttcttttttaaaaagcattgaatattcaaatgaaacaaattgacccacaaattttgttttctttgtttttattattgctatgccatttttatcttttttttaaaaaaacagaagtatttgaagacttaccaaaaaactttgaagctcgtaactgtagcactgctctacacctcactgaaaaataattaaggtccaatttatctgtatacttcatctgctttgggtagtgagatccctctattagtcaactgttgcaaattatgtaatttgctgaggaagacctatttttaacttatgtcaattatataggtggatctattcatgggtatgttttttaactaagcagacagctaggaagtggtgcttttgccttacatggtcttttgctaacgctagaatcctcgataatgttcttgtcagtcatctgcactttggtggactttagggtgacatttgctttcatcgttgaaatttctgctgctaacatctagcttggtgtttgcactgttgaacagggtgataggaatggtgatattaattggactgagctttttgcaccttttccgtatactgtgagatacaaacattttctccgtatagttctttctgctccagtggctgaagaattacgtgattgggttggatgggtgaaatcacgatttcgcaaccttcttctcaaggtttttttttcatcacctgcccattgtttcttcacatttatagctgcaagttctgattgtaacatatccaaactgatgttctgcagttagaaagcattggtgttgattgtgatccagatccctcagaacaagccgatcatagcatgattgagcctaatgtcgtatttttctggggtctcatgtatagaacgagtacaaacatctgcatcgactctgtgaaagaagacttcatgaagagtgtcaccaacgacatctatggaaaggagaagtgcacccattcagacataacgatgtccattgtctggccaacccatttgcccaaatgtgtgtatgctcactcagtttactcacagaatcgacagaatccgcggcaatttatgatgggcaaccaactgatgaatcaggactgcaatgcagtgcgttaggactccattattatctgaaatttgttcggcatctgcggatacctgtttgagaatagttagagatctgatactcaggctgttgagtacgctaacatcatcagatactccgaatctcttctgttttttggaccgaggcttgggatgcttctgtcacaaggactatggagggttttttttctttgttggagctggccggcgagagctgggtttttcgtgtcgagcttctagggcaaagtaagctcaatcgagctacttattgctgttctgagttttgtgcaggtacatgtatattcatgtacacagcatagggggattggtatacatgtaacagaggtatagcgcataaaaagttttataaactgtaggtccaatgtctgtcccagcagcaaaattgtgtaaatcgccacctgtggttagaactgttgttgggtccagattcagaggtcgatatgatagtgtttactgtttaggatggatgtcagtcattcttactgttgtaggctgcaaaactgttgcatgtactgccgaaaaattcttatgtggcaagtcatccagagaaagaaaaaaacattgccattgtgtactcaacattgtcatgcattctctcgggctctgttcaacatagttttgagttatatccctgcttctctgattacctgcactgattatttacctgtttgagactttaaagctggctagctggggcttataaattccaatttcttacatttcttgcttccttggagggaaatgggatgccagcttactgtttattgagtgtcatgtttccgcttcagtaacatttgtcattgtttctgtaaaagtattatggaaagtcttggttttgaacttcagactatttgaatactcatctaaccttttccttttctaactccattttcccttttgtgaggtgccgtaactttctagtgtctgttgaaggacaaatattccagatacaccaaaacacaattagtgcatgattaatcggattttaattattacaaactttttaaaaatagatttatttgatattttaaaacgatttctatataaaagttttcgcataaaacataccgtttgaaaagcatgcaaacggatatcaaggtaaaatatgtatcctaataaaaagaacgcttatatctcactcatcccaatgagacaaccaatatttttattcctctcgttaatatacgtgtggaatgtttaaacttattatattttgaaaagtagggagtagcaagttttagctattagtatagaggtaaaaaaagcttggttgtcttctaggggtaggtgactaggtggcaataagaaagctaagaggtaataggggttgtatatgtggtttaattagtagcaaaagtcacatttcataagtactatgttgttatatttgaacacaatttaaacattaaaagttattgtattttgggatggagggattagtcttttttaaggaccaatatatcgtactaaatatgaaagtaaatatggcaaaacataccatttatcatgcccacacacatcgcacatacccacacaagtgcgggatggacctagatggatgaagtgtcctgttgagggtatctctcgagagtgcgagggcgaccaagaagttacggtaatttcccacatcctgacccctgccccctccaatttcactggtggtttaccactgacgagggctggaagaggcttcctccctgtactaatatagagtagtttaggtcaaaatcctcatgtagtcaggtcatcctgtaactcgacttcatcctatttttgggtctcattggtgaagttgccatgtcaagaaagtgatgttggtagctgtagttgtaggtttgggtgtccctttgcctctaggaagagggttctcatcagtcatcaagctcatcctccccatcaatggtccccgcgatgagtgtggacggatctaggagggtcggcgtgatttgcgttgcgacgagaggtggaggggctagatccgacacaaccggatcttgcttgtcggtcagcctggtgaacggagctagagatggcggatctagggtggtcagcccattctccatggtgatgatggctggaggtggggcaaaatgggtgtgctcggctcctacttgttggtatttaaaaggtagagctggtatagttcgcttgatcctccagcctcaagtactcgtggttctggatgtcaagcgaggtggcctctcaataagttcatcaatttcttcaagtaagtctttggtgggcttattgcttgatgcctggtgtagtgtctggggttcatgggggtgtcacttctggaaacaccattgctcttcgtggtagtggtcatctagcgatctgtagtcgcaaggttagagtggaatgcatggtggggaggcttgatcgaatcatctcttccatcgttgctactgtgttccgctttcgcttaatcgttccaaggcttaagttcagttgctaccattcctaatcattttgtgtttaaggcaggctggggtttgggattgtcttccaattttccttgcaacagtatccaagatgagaactccgtttctggatgagtgcggactgtttgttcgacttttgttgataatattacagttagtgctcctcagatttggtagagaacttcttggcaaaccattgttgagtccgatcaagcctaagaaaaatctacggctcaacattaaaccttgaacaacgaagttctcgtggaggcaactgaaggggtcgccgatctatcgagcggtgtgcacatctttagtagtggcttgtggacgtagtggccttggcaatgccatagctccccatcgatctcatcaattactattgttttgtttagcttggaggacagtcttcttagttcaatcggctttgccttctgtttgaatggtgttgttatgtatattctatctttgttgccaatgtattggggatgttgtttcccttaaactctgtccttgatctatataaataaagttttgagttttaaaaacaaaaactctaacctaagacctatgttggcctatagtgttctgacatgagcccggtatagcacatgatgccacccatcatagtactatggatcgatctagcacgaaatgcatgctcagattcgtattattaaaatatatcacatctcgtactaaatttgtttattttaggatggataaagtacacgataatattttattgtaacacaggagcctgggtctgtccttgcacacacgagtgggtgtgtcttagcatcttttgattacataatattataataatattataatgtatgtttatcctcggttttgaacacaggaaaacaaaacatgagtatatgatcaaataaaaaaaataatatttagattttgagacaactatagcagtgttagaggaacgttctatatgatgttagcatggacgtcactgaatggaccatttctgcctacacgagttctatagctgttgataagatatgccatattgtggcctagttaacttgcaggtatgtcctatatattaaaaaagaaaatgaggaaatgagcgcatctctaaccacgtcactagatagggatacatatggtgtgatgttagcatgggtcgtgccgaatgggtcattcggactattcatatattatatatagagagaattacttatatgccactacaatttgaccagtttctttatatgccacttaaaattggcttctcccttatataccactagttcaagtttttctacccttttatgccactcccaccactataatgttagttgactgttagtcaaaggttagttttttttcgtaaatgaccaatatgccctctcaactaaaaaatgtgtaaacttctttttgagtgaacaaaattttgtcagaaccagtgaaaaatgctctttatattaaaaatattgttggaaaactgcatgtttcatgcttatattgaaaatttatttgtgatggtaatggctaaaattgcatgtgatgcagaaaaaaatcaatttttatatgttgtatccagtagctatattagtactaaaatacctattattggttgtatactaattctcaagggcaaatgcgtatttttacaatgaagttaacggttaactgacggtggactgacggcaatggcataaaagggaggagaaacttgaaccggtggcataaaagggagaagccaatttgaagtggcatataagagagccagttaatttagagtgacatataagggattctctcttatatataatatgtatactagtataatggctaaatgaaaacgctaatcaaaatttggtaaggctatttattataataattattcttaaaccaaacccatgtaatatcaaattatataactgccattgttgttggtaacagaccaaatacaatgctgtcctaccaaccaggctaaccgaaaggttaatttgtagcaacattgcttgattgccaaaattttatcattacaaacttaaattttagttttctataggaaaaggtacaacactaaattttccatgaaagtctaaagattatctctaagcttggaaatctgacacttttcatccctgaactttatttatgtaagtaaacgcggtatcggaaatttaaggatgatcagtttccggttaactaaagtttactgagtttcgttttcgtggctgtgtttagtttttgaaattggggagaagtttaggaaaaattggtagtttggaaaaaaaagttgggagtttatgtgtgtaggaaagttttagatgtgatgtgatgtgatggaaagttgagatttggagaaaagtttggtgtgaactaaatatagcctacgtaaaaatttagggatatgaaacgaccattttgctttcccatagtataaccgtgcagtgcaatacacagtgaatcgccgccgatctgcatatccagccgggaagaagagcaaactcgtgtcacgtgccaaacaactaatcgaaaagccctggacaacggcaggagaggaggaggggggcagtaatgaaaagggagaagaaaagaaaggcggccggcttgattgagtggccctttgaccgggagaagaagcccccgcttgctaccccggtcccggtggccgctgcacgcccccggctaccgccgtgcgtccgaagcgatatcgaggagtagcatagcacgtacgatctctcacctcaatcacgtcgtacgtcgcggctgcatgcagcgcatctcctcactgagcggcctccctgtcggcgtgcggccatcaatcgacgacgacggcggcgggccccgcgggggaggggacgggtcgacctcgactaacctgcgcggctgcgcctagcgccgactacgtgcacggcagcaggagagcccaggagaacccccgaaacccacggggtgtccgcagtgtatgtactccctccgtccaagcattttaagttttttttactgtttgatcactcatcttatttaaaaaatttgtacaaatataaaaaacgaaaagttatgcttaaagtatttttataataaagtaagtcaaaaaataaataataatttaaattttttttaataagacgagtggtcaaatagtgtaagcaaaaactcaaaatccggagtgcaattgtacagtaggggcttgcaatgatccgtatttttgggttcagacgtgtatgaaaaaaaggtaggtgtgaataattagataaatattgtggttaattgagaagaaaaaaaacagtataggagaatgatagtgtttaattgagctgtattttaaaaagaaagatcacgtaacttcctgatgtagatccattttgtttctatgtgattatttacttctactagagtttttagtgaaacaaaactgatctaccactatgcgaaatgtgaaaatcgcttgataatttgttgttgactctccaaagcccccgcctaagtttgaggattcctgtggaacgaaaaaaatataggaatttcttatctttgaaattaccccatttgaaaggaggcatgaacatatctcatggggtgggagctttgcaccatgtgtggtcatgtaacagtagtactgtcataagaattgctctcttggatggctaaaaagaaggtattgacatggtcactctcgagactagaaattttcatattaattgaaatgttatttttttattatgattgtatagaaggtatgattttatctagaaaaaaattaagggctactttggaatggaaaattggaaaaaaaagtaggaatataaaaaaaaaatgcaaaacacaatatgggggaaaacacaaaatctggtaaaagatatgtttagatgcatcatatggacatgctgccttcgactttttgaaggaaatgtaaaacacgacctttgataaattttggaatcctccaagtggatgaatggaagaaatcctattgaaattttggaataccttcctatatatacaattctttgagggctttataggaaatatttttataggatttcaattcttggatgaagttcctaagaaaaatacttggtttcaaaggagtcacaggaaatgtatatgaaatctaataatatttttaaagaaataattgcgtagaaaatacaattgcatcgatgaaaaatataagctaatattatatatcaagtccaatttaaatttaaaatatgttatataaatattagaaaaatatttattgaattaaaagctaagagtatatcacatttcgtatactagttttttgtttaaatctgatatgttctttagtatatcattttctatgaaatgcataaatggcaacaaagttattcacttactcgatcattttcttatcagtcatgcacataaaaccgaaacaacttgttgcagtgagctgtatgcagtgaattataaagtccatagctatgatatcattcatttaagatgagcaccggccccggccgcccgcattgcttttgtcccgataagacgacatactgttcatgacactactatgaagaaacaaagagtcaatcggatttagacgtggagagttttcaaaaaaaaaaaaaaagggtcgtggatcgcgcgagctggtctggtttcatacccactgcag

SEQ ID NO: 60760 - DNA, 20002 bp, Oryza sativa
actagggatcatcatgatcaggctctcagatcaattctcatgttgctcctcttgattcgttgttttctggcacttgttttgttaggatctatagcattgcatggtaaacgcaactacatattgtagtaaactatgtaaagataaaactaacatagtaaatatgtaacaatatcttctcaataagtaagactttagttcgtgcacagaaccgtcaactatgagatcatgccgtccaagccacgacaaccaacttggtattgtattcaatgctatctccgtttttgtttacatgagtttgaccaatttccagattaaaaaatactcgccacgacggttacgaatgtgactatctctcttttgcccttcgtgcgtccataagaaagcaaaagtaccacacacgctaggggcattctggtcatgttagacaaaacaactgcatttttcatcagattttttttctttgcacctgaaaaatttcaaataagggactttgacccccacacaaaaacatgtctttgcccttttccttaggttggaagacaagccgagctttctcctttttaaaaaattgcttctcccttctgtacatatccactatcaggcccttccaaagttccaattccattttcaaataatttagaaccggaaccaccggactgaaaggccagggccactctgtgtctgtctcactgttcgaactcgagaagagaagagaggagacactggccgtggcaggcatcgtagtacaagaggacgacgcagcgccctgacccacctaccccaccaccacacattccattcccatttccattagccccaccccaacccaggcccgcgccgaagcgaagcggagaccagatcaccaagagaagtgcgacacacacaccttctcgccatcgttttcaccccctcccttataaatactcctaccgcccgcctcgcctcgtctcgtctcctttcgtttttttttcctccactcctccgcctcttcttccgccgccgcgacgcgccgttgataggtctacgacgatgtcgccgccgacgaacggcgccatctcgctcgcgttcccgcccatggggccgctgccggcggacgcgctgatctacccgttcgacggcctctcctacgacgacttcgtcctccctgtcgccgccgcaccgcagcatccgctccccgtcgccgtcgccgaccccgcgcccctcctcctcctgccgccgccgtcctcctgcacctgcaacggcgccagcagcggcatgggcgccgttgcgccgcgcacgttggctctgggcgccaccaccgacggcagcgtgatgacccccaccagctggggcagcgacggcggcggcggcggctcctcctccgcgcgggccgtgcgctcgccgtcgccggtgctgccgctggtgcagggcaccggccagaggacctcctgctaccgcggcgtgaccaggtaatactactcctactaccactataccacgcgcgtagagatagactagagagagtgataataataagtgcatggttagggagtgtgattaacgactaatcgccacgtgatttttcacacgcgctaatcacgaggaccgcacgtgtggcgcaggcacaggtggacggggcgatacgaggcgcacctgtgggacaacacgtgccggcgagaaggccagaagcgcaagggccgccaaggtaatttactaattaaaattaccgctaatcaccattagtccattaccctttctgtaccgtcatttttctgtcaccgatcgaggaggcctcgccggcggggaggggtatcgacggcggcgaggggacggtgatgagttcgccgtgatgggatgggatgggatggggtgccggcgccgtttcggggggagatcgagagacgggtcgcgtcggccatcgtgtgcatcaagttgaggtgacattagcatctccgttagactcgcaacagttcccggattctctgcggtgccgggccccggtgggtcacccctctttgaccgtgcaaccgtaggtagggggtattgtagccgctgcctagtatacctctgtgttctgtctactactagtagtatctcttttttttttaatctttcttgtggccatttctctgatgcaatagatcggctagagcctaaagcgatttagcaaggcgatttatgttggttaatcttgtaggcgtggagattaactggtcccgtggttggtagagtgacgtcgtgtatctgtatgacagctttgccatggcaggactgctgctgtggtgcatgcagcttttgcttttttcctggttttagtagtagttcatgggtgatgtactgcatgtttagatggttttatttgggtcagtttctttcttccttctattgcaagtctttcttttctccttttttgttttcttctgcattacacacggcgagagtttttgtttctgaaaaatttattacgagtcgcaactttgcaacgctaccagggttgtgtaggggacagctaaggtgtgaccaaaagtggttttggaacgcacgtttgaattttattttatttttgctttgccagttacgactccagtagagttgtttctactgtccgtccttgttgattggcatttggcaacaaacttttgtactttactcgatacgcttgcagagttgcacaggtagacatgcgtgctactggtgtctacgacgtcatgggctcatggcctcgagccaaagcagttccagactactgctgaaatagcaaagcggtctaaagttgcgtcgatcgatagtggagatgtgattattggccatggcggcaattccgcaatagagagtgtccacgatcttgtatgatatggctgcatttcatatattaatgcctactatatgagacacccagaaatcagaattccacggatcaatttactgttggatatatagctacatgtaatggtatattttactgtcagatggtacatatatgctgggatatcagtaaaaaaaaatctatcggttgatccgatcatccgaggatagctactctaaaatcacgtgcatagtgcaaaatgcaatttcatcaagtgaacattgcatattctgctgtttggttttgaactgcattatgtaataagtaatacgtattacacaaataactccttacacatgctgatgcattcatatgtgcagattctatcgttagatttgagccacccttgcctcttttgcatcgtgcaagcaaaactccagttctgaggagaaaaatcattgcatgcaattaaagattccatacatataattgcatttgggaaataatatatattaacaggatgaatcacgtgaatagaaatgttgggggcattctttgttgtgtggagagatacattgctttcgagttatgtaagctagcatcctcttgttgctgtccttttattttggaagatatagttatcttaatttttgaaaaagaaaaaaagaatcatgccttataagttatatgttgataaaggaggagagtttgtgtgagatatgtacaatggggttttggggatcccgtaaacctggggggaaaatgttatcttaatttgcatttgatgtaaatgacatgctattttttttttctgaaccagtgcagtggttccttttttttttttaagaaaggactaccagtggttccatgatagtgatactatgacatgctgcttctttgcattcagtgagtataattttgttaggatatctcaatgtttgaatggaagggacatttgtatacagtgaatgttttctcactgaggaagtcaggaagttgtgtgctaaactgttatccctgtattttttaatatataatcttgtttatttgttggaactaacctggtttataatgtctactctgtatgtgctttttatcctgccaactgcatgggggccttcttcagtttacttgggtatgagcaactaagtcctgtcttatgtatcatttcgtatgccttttcctgggtaagtaaaggtaaataaacatgtggtaaattgcaggtggctatgacatagaagataaggctgctagggcatatgaccttgctgctctgaaatattggggtgctaatgctaccactaacttccctgtaagtgtcacgctttcctgatttcctaaacagccccccatagttactgcaaatatcctactgaggtcatataagcagtttttttgtgcctcctaaaatgtgtgcccttatcccgcacctcatattgtagtgatcttagtgtacttctaatgtcttatttacagttaatccatagccttaaaatttgagatctttgtcaaccttcaactgttcatttggattcatttatgctggttgtggactgagacatactcatgtattcttaatagaaagatacacatcattatcgtcgcaaaagaaaaaaggaaaaaaaaacacatcactatgtgctcacctttatgtggagctgtgtgcttagattggtctctttattttaggatgcattcagaactattatcatgtattgctatagttggtcatgatgcaactgaaatggaacttgttctcttcttagaaagaaagttacgtgaaagagattgaggagatgcaaaagatgagcaagcaggagcttgtagcctcactaaggaggtttgtatttaaaaccacgttcttttgctgtgctacaaccacaggaagttcaggcttatatacgtgtttacaactttctcaattctcatgcaaatctgcaggaagagcagtggcttttctagaggtgcatcgatctacagaggtgtaacaaggtaattttcaactacatgaaccaatcaaccaatggtcatcttctttgtcagttacaatctgctcaacttcctgctattttccccaggcaccaccaacatggccgctggcaggcaagaattggtcgtgttgcaggcaacaaggacttgtatctcggcacctttggtaggagcctgttgttctgatgccccttatatcgaaaaagtagtatgacagtatgctttttttcttaagaaagtatgctcatagtcatatatggacaagtgaccatattatagtcttaagtagttaagttatatggcagaatagtcatagataccttactgtttcttgaagtgctgttaatgctttgttgttccctttcaaataagttactgtcatcttgacacaattattatcatctgtgtaccatttcatttgttactggttttacagataatctacaagctatgcactattcaatctcgctctaattcccttactgtggcgacattcagaaaccactatattttgcactctgtgatgcatactaaaccagcatacttgcacattccttgcagcgaccgaagaagaagcagcggaggcgtatgacgttgcagcgctgaagttcaggggcgccaacgccgtcaccaacttcgagccaagccggtacaacctggaagcgatctctcagagcgacctcccgatcagcgtgtccgggaggcggcacaacagcagcagcaacagcaacaatccagcaccagaagcaggaggccaaatcactctgatgagcagcccgccgatctcccagcagtcgagcagcgcgccaccgtatctcatccacaacctcctgcagttccagccatgtggtcccccatacgcaccaccaccaccaccaccaccaccaccaccaccaccacaggctcttccgctgccaggatcgtacaactttgcagagccagtaggcttctactggccctacggcgatggggaggagcagaaggttcagctcaacagcaacatggttggaatggctagtggtggctttcttcatctggccaatgctgccaactgatcccagcgtctgcaattgctggtgttgtgtggttcttgtggagattccgagggagtgagattttgggtggatataggaagggggtcttttggcttttgctgctgccatggactaacaacctgaacatagataacagctggagtagtgaacttgactatgctcgttacaacaacagtgggtctaagctcaaaatgagcttgtggtatgccccagatatgcttagttgttaattaatggtttattttgaacaaaagtggttcatagctttctaccatgttgtatcctttttaagttcgcgagtaattctgcgacaccggatggcctcgacctgctcatctatgggttcgtggcgcggcaacctatcccgtggctgctgcttcgagcagacctgcttttgttctatcagccggagcctagaacatcaaagctttcatttgcactggctgtaacgagcagcaaatctgagcaacaacgcttcagagcttgccgggacagtactgcagattagaagcacaggaaagacagtgatgggtacaaaagaatcgcacgattttagagcacatcaagcagtccgtagataacagtaaaacgtttgcttttcgtcaccatagattaatacagagaaaaagaaaatgatgtccacagtatcaaatatcacacatttcactgtgtggaagcactcagtttaaacacattctttgtagtgctcggtagaactttattctgcttggaacaaccaagcaaatattgctggcaaagaacacatgaaactaatctatagtctactccacgcagcaaaatggtgcaaatggtagatcttggagagttcacgtctttatggtttcacttgaggaggagactcaccctgcagagcaggatcagatttgacagcatctagtgtcttgaagaactcctcagggagtgcaacaggccgatgctgcggaacatgtttcgggataagtgtgtcatcttcaataacctcgcattcatagtcatcaggaacaccccatgggtcccattctgccatccattaaaacattgtatattaaacaactgaggctgtaaggatttatatcaacaaacagaacaaacatgtccatatacttaaggtaaaagcctaaagcatccccataaaagaaaagttgtgctgtatgcaatatttgcagagttcagacacagacactgtcagagatcttaatcaaggcgttacagttttacttgcttgtcaagccatccttgtgatattttcagaacagacatttaagttgattaaggatgccaatctagtgttatagttttgataatttagcaagctattgataaaaaagacaaatgatagtagacttgcatttgaaaatcatgttttagccaaatggtgcttttctttaaaaaataaaaaccattctggcagttctacaggcaaacatatggatgacagattgaaatgcacaagacaatgtatgcaatgcacatcaaaattgccaaacaaactattcctcataaccaattttgcttctaatattctacacattattcagttgatcgacaaggtctatatgctacaattctctatgtccttcatacgggtgagcttggtcattggaaacaaactgaaccatacatataatgcaacagttcagaatatcacagagcaggctaaacagacttaagaaaaaaatgtttctgcaaagcgcttaactcatgcacccaatctgtatcagttgctaatggcagcaacaggactgatctagacagctatagttgtgcaccttatgtcgtaatcttattagatactcagtgtaaagggtagtggcatggttacgtgaattcttaatcactattaagttgctaatgccatgcaaattataatatacttcctccgtttcagattgtaagtcattctagcatttttcacattcatattgatgttaatgaatctagatagatatatatgtctagattcattaacatcaatatgaatgtgggaaatgctagaatgacttacattgtgaaacggagggagtagttacattcattcatagttctatacaaaaaacaatacactgtattgagatttgagagagcatcgatcagtgagagtgctctggattggtaagatgtgcatgggacatgggtgagtgattatttggttcagcctttttttccccagtcgttcggcatggtatttgtaaagtttatttcaattaggtgtgatgaatagactttagatagaagagaaatgctctacaattacgaagattgtggagcatatttcttcttactcacgcaagtaacatcaccatattcctaattccctctctatgccatatcatgtaaaatggaaacctatgtatttcatttgaattttcacaaaacaaatattacactgactcactgggattctagcaaagaagaaattttaaagcactgaagtaatacaccagtacattactacatgcaatgcatagcaccagcccaacgcctgaactagattccagaccagccagattttacatacatggcactccaccagacatacacaaagcaacagtatggtgaatatggcaatgaacacactctggttaagttacaagcaccagtcagttcacaaaaaatcttaggttagtgaccaaaaggtaaaatggaacatccatgatccttaaataagcgctgaaaaataattaaggcattttactaataggcagcacagcagacaacctaaaaagcattccatccccccccctccccaatcaacaaactggcaaacaccatactgtcaacgctgataatttgccctaccagtgctattaaagggagccaaaagaaaatcaaataccaatcgctacgatgttattgtccacggatcagttgtatatcggatcaaataactggttgaatcaaagaaatgggtagccagtggccacatctacacatcaactaccctgattcttgtcgacagatcagtaggaggaataaggaattaatacaagaagtaactaaataagcgacaggaatggagatggggcgtaggggagggggagaaatgcggaccgatcatcttggcgatgagcttgagctcgtcctgggcctcctcgatgagctcctcgacctggccgcagccgatgcggtcctcgatgcgcttccagtcgtcctcctcctggcagatctggaggcggtggcgggtgaaggactcgacggccttgcggtagccctcgtccttggggacggcctcgatctccttgagggtgcgggtgtagaggccgacgagcacctcccgcgcgttgggcaccacctccagccccacgatccccgtcgtctccttcacggcgcgcgccgcccgcagcgccgccacccctcccccgccgctcaggatccgccgcaggaacatcccgccaccaccgccgtcgtctctctctctacctggtgaggtgcgggaggggtcgcgaccgtgcgaggatgctggtgtggtacgtgcgactgatgagcagcggatggggaattgggggagagaggatggagtgggctgtgggctgtggagtgtgtgtgtggatcatgggctgcagaagcagtaggccgcaatgttgaaatcctgccgagcgaattgcgaattcgagggccgcgcaagagcacccgcaacggtaaagtaatgtgctctttataaaacatgtacatctcagcaatagactgattaatagtaaaccacctcaatagtatgtctacataggtatctatagctctctcatcaattgcctctttttatctatagactatctccaagttagtagatagttttactctctctcttttcatttaatctcttccaagtaggaaaatatgctgacatggatcttttatagaaagcttatagataaccattgcgggtgccctaagggagatttttcaccagaattagaagtttttttaaacagttcaacctatcgttccgattcttagaacctataaaatgaactagaaactcagaaggtagaaaattcagctttttcatattctcagaagctgactactgaccaactggttcttaaaatacctatttattagagttacaacttctaaatttagtttcaaaagttaaatctagagtgaagtagtggagcagcctaaatctagctccacctctttagttcattttgtgagagctttacccaggcacccagctcaactgagtgaagctagctagtctcctttataagagcatctccaagagaatgggtaagtgactctccaagccaaattttagccatagcagagaaaaaatagcctccaacagcatctccatcccactggctaagctatatggttagccaaacactccccccaactagctaaatctagccagccacaaccacatccccaaggctggccaaatgctctccccgctacctcttccgatgcaacggcgaggagtagcagcgttgccatccgttgcagcaccgccgtccctccgagtagcctcactctctctctctttagcactgccctccgccgcctcgaacaggtcgtgcccagcgcccgccgcggtggacgaagtcgacagcggcggcgtcggcggcgtccccataggcgtggacgacgctcgctgctgctgctgcatcggcacgccgtgcgagtggtggaactgctgggacggtgatgagaaggagaagtcttcattcggccgcctctgcaggtcgcaaccgcggcctccgctcggcgtggcccgccccgccgctcgccgcagccgtcggcatccgctcggcatagcgcgccgcctccgctcgtcgcaaccgcggcctccgctcgccgctgcctgtcgcctcgccgctgctcgctgaagcccgtcccgcacacccgtcgccgcagcatcagaggcaagtccagtaggaggaggaaggtttatgtatgagtggggaaaatggggtggaagaggaggaagaaggttatagagactgacatatgggtcccattggttatagacttgtaatggagagggtagatagggaggctgttgaagcgagcaacaactttaacttgctaaatcaaatgggtagctggctatatggatgtttggagagtctattttagagaagctgttggagatgctctaagagatggagctaaaactagagttgtgacaaacaaaccctcaagttggctagtctactatgtttaagtttgcatttgtaccatacgatgcacgatagttttcatgcagtagtaatacttcttcagtaactagcaaattacccatgtcatctaatggtataaaaacaaaccggtttgccgtgtttttaagtaggcagttagtttttactctctccgtttcacaatgtatttatattgatgttaatgaatctatatatatatatatatatatatatatatatattcattaacattattattattatgaatatagaaaatgttagaatgacttacattgtgaaacagagggagtagtttctaaaaaacattggctggtttttctagagaaactgttcgttttttttccctggaaggacagggcgaacgatcaattttctagtagcagttacgtgggtgggggaaccactcccttctatgcagagaagagaagataaaccatcgccgccctgcaggttttgtttattcttcttgtagaaaacaaactcgcagataattcttctgctactgcctactggtggagtggtggttctttcccaatctgctaaggtagattgagatccgctaagagcatctttaacagcctccttatcccactttccaagttatattatagcaattttggctcaaatttgcactccaacagcctggctggccaaagtcgctcgcgctggctaaatcgtgggccccacctctattctctctccctcctgtagcctctctcctcctcccaaatccagtgccgcccgtagcattctctccgccgacgccgcccatccgcgccacccctccgccggcgaagagagctccctccctgtgccggcgaagagagctccctccctgcctgccccaccatctgcccagtgccgacgtcgtcgtcctcccggctccgtcgtcgttgtcgccctcacagcgccgccgccgtcgtcctcccagtgtcagccgccctagcgccgccattgtggccttccctcgccgtcgcctcgagcctgccttgcgtgcgcacggatttgccgccaagagcggcaccgacgggtggagcctgagcagcggcggcggcggatggggacacagcccgagcggcggtggggatggggatggggcggcggcggcagatgagagagggaaggggggtttggagagaatgggagaaagatgagggagaaggaggtgtagagactgacatgtgagcccaattgtaataaactcaaaatatagaggacgaatagagtggctgttggagtaaaagacaatttgacttgctaaattaaatggagagttggccaaatagacatttggacagtcaaatttggatagactgttagagatgctctaacctacttatatttaacttatatcattgatatgtggaccctctacccaataaactcacgtatcagtgactcaaagtcagaaggaagaaagtcagagggtcctcttccggctaaggttatatggaactacaaccgaacagatttttagctttccttctctcgccaagaatttgcgatgaactttgggcattgcagctgtaggaaacagaagttcaatatcaagttttatagaatcgtggcatacattgccgacatgagcatacgagattgacccagagaagagtcgatttacagactagcaatcagccacccctactgatatgatattgacaatttcatttccgttttaatcacctggaaagaaacaccaggcatgactaggttctcctaaacaccgtcaagtaaacgctacgttcagtcacctgcaagacaaagtaagaacatcagatggaattaaagaatcttaaaactgaaaaccggctgttaaaacatctacatcttgtcaaaaaaagcaatgcacactcctaaaagaaattttcttgtgcataaccactataggattaatacttctcatcactcagaagctcaactcatatatgctcccatttcaacatgaggtgtctatttaatttctaggagagcttcgaatgcatagagttctctgctcaatctaaagacatgtttcatttccaatagcttgaccagtcaaagagagcggtaaataggctgagtcattcaaaccaaaggtagctagctagctccctgccttctcatcactaaataggctgtattatacactcatttttctttgttatatgcagcatgagttaatttctccttggtcttggtgacaaaagtaataggtctaacacatttggatcgagggagtacttacgttgtatgccaggctctcctatgtgtcatcactcatttgctcctatggcatgaaccgcacctggctcatcccacctgttgggtttaaaacatgtccgtgctgtcagctcctttacaattgacggtttatttaagcctctattatcttatcttattattatagtaccaatatatgaatactgtcacatgtacaatataatctgttttttcaagtgaaaatttcatattgctcagcatcctaccttttttccccctagagttacattgttttgaatgtgatccaggactaaagagatctgacaatgcaaatgatcctacaagatatctacaacgtttaatgctcatgaagttacttgccattttgcatagttttagtttctataattattgaagagatatgaaccttttgactgttgactgatttacattttaattacaggacacccttggaactgtaaatcctttcatctcaaataattttatgtaacgaacaagttggctttgagtgtttcatctacctatatgctttgaggtgatagttgagtgtctttcaagaagagattgttgggttaagcaaaatgctcaaggtagtggacacaaagaacaaaggtgtaatgttagaagataaagcgattgccggcagctactcgaggtctcacgaagacgtgactagagtgacgaatgtagcataatcatggttaattgtttgttattaggatagtattgtttatttcagaacaataaattgtaggcaaattttgctacaggacatcacgattttatggttttagctataggacaccgcacaaacttacttttagggaaaaacactctctaaatgtggttatttgccagtggacaccgcgtccattataataatgtattcgtgctgacgaggcaataggggacccaaaagtttacgcggagtgaccaaactgcccctgcgcgttcaggtgatgtttggcagcagcttcttcccttcctctctctacagctacccaagaacatcttctctcttcctgtctgtttctctctctaagctagctatattcaaatcaaatatcagatttgatccacgataattgatccacaggattgaaaaaaaatcagattcgatcaagtctttcatcctgcagaaaaaaatcacagaggaaaaagaaaaagaaaaagaaatgacgatggagctcgctgccatctccaacacctcatcgtcgctgtcgaatctgctttgcgacatatgcttgcctccgccgcgaggagctcgcctccgccacctttcacttgcttcgccgacgtcccgccggcactctgcgaccagctccactgtagccgttgctcgctccgtcaatcatcgagaacctgcttgctccatcgctactgctgctcccctcgccgacgccctcagtgccgctgctcgctttgctaccgtggcttgtgcgctgggtagggcttggagctgctgtatttggggctgatttgaagctgtgcataccagcggtgcctcctctaactctaggaggcgcgggtggtccggcggcgcccacggcatattcctgcggccgtggcactagatgtcgccgtgctccacctcctccgcctcctcgtcatggtcttgctggaaacggttgaggaggataaagggaggacttcccctcaactaattttactcgagagcaaaaggagcagccggatttggcggtcaagcggcgacgactccgactctgccccgaccagaggtagaagataagcctgacagatggggcccctatcgccaggggtagtttggtcactccgtgtaaaatttttgggccccaatcgccatgtcggcacaaatatattattttaatggccatggtgtccactggcaaataaacacacttagagagtgtttttccccaaaagtgagtacgtgcggtgttctacagctataatcacaaagttgcaatgtcctgtagcaaaatttgcctaaattgtaactacacttcgtaccacatatttgctttataaacctatttacaatattactagaaatcacacatttaaaaattaacaaagatggaggtgatagtcacgcaaaagcacgataaattattagttgtcctgataatactgttaattacaaatcaagataaatttgttaacgttgtagttacacttcctgacaagtatgttctataattgtatatttgcgttgttttgttattgcaaatttaagctaattgctgcaaacatgtaagcatattcaataaagagggaggttatagccacacaaaagaacgactctataggctagttattacatattaagtgcaagaaactatatgtagatgagtgcacaagcttttcatgaggcatggcaatcatccatgtgtatgcaatactattagttgctaaaagactataaattgcaggttcaaatgaataactagatagtaacagcgattaacattcaaagcaaaatgacattcaagtatctggaacagagaaacaccatactcagattaataaatttaatagagctctgcaagtgagtacattagggtaactcagattccagcggagcaatattttaataccttataagccaaaatgctccacttcttcatcttccccttcatcctcatcctcatcctcatcatcctcagaaatcctgaaatcttctaatgccgcctcctcttcctcctcatcagcatcatccatcatatccgtagcacgatttttgtccttcaaaccagtgctgagcacaacagtctgtcctttagagttttccatgtctctttgcaacctttccatgttctccttcctacgctcagcctctaacctctctttttcagcaatcctcttgtcaagatcagccctgaaaagtttttttataacaaccacttatataatttttgctatgcatatatcagtcagagatagcagcactacatcgcaagttaaaacacctgtaattctccatgtattctttggcacttgcttcaatagcttcaaaaaatgaattgactccagcgccagatacggcagatactccaacagaccgcagatttttgtaaaactcatccaggacaagagagaggcttcgggtaaatgtagaggagtatgatgagtcagaatccaaggcggtctgaaacgcctcaaagtcttccatccactgataaaataaacaacataatctctggttacagaagatgtagggaaaaaaacagataagacaattaactaacaggcccaatcaaatttgagcaaatatcaatcaagtgcaacagtttcaacttgattaaataccaaagagagtcgttgcataatgccgataccgcattactgaaatgcaacacttatggtgtccagaatcaacaacaaaggaattagatattcatagatggcaaacatacctcaagagcaaactcatgcttggcaacatcaaccttattaaatgtcagaatcatcggtaagcgggtcttgtacagaatactgcaggcataaagcatgttgctcatgaaagtaacagggctcgttgatctgggggtgtcaacaacatatgcgacaactgttggaaatgtcgatgcaaaagcttctgttatgatagctcctgaagccgaccaagtgaagatttcaatctgccctggcgtgtccaccaggacataatccagctggtcggctcgtctttcaataacagatataacctgtaaagacaattattaggtgttacatatgatcattagcagaattgcatcatgtgtcaaccaaatttatctgtacactgcagtaagcaaaaagcaagctcgctttctgaaccactttacatggaattgtggaaatattatcccatcaacatgataagcagactgcattcctttaacaaatttactagactagtcatcaacccgtgcatctgcacgggctaggggcatattttctacccttatgtttattttatatcattattgacatatttgttaaacattataattttatattatgttgaccatccaacagtatcaataagctagtttgttgagaaatgaccattatttagtgtttccctacacacattccatacagctattagaaccataattagacactgtgcaagcatctccaggtaagaattgaaaagttacctatgcagaaccaattagtagcatacatgcacgataatcttcctataaaccaaattaaattagcattcattacattgtatcttttaagggaacaggactcaatctaggcaagtttatttgggaatctctatgtgctgcatgacaataacacttctaattgaatattacgcgtgtatatgtgaaatcttgaactatttagaaactattaatgaaattgaactgtcgaaacttatcgctgaactcttcactgtccatttctgttgctccctaactaactatcgttgcatacaaactaccattgaagtgattaaattgcctaagtattgcctaacttggtattgaagtacttcctgatagtgtgcattcaagtaacccaatcctaacaaccacttgatctaaacacatacggagatgaaatatatgatgatcgaaaagcacacctcgtcaaacttggtggagaataggttgagagaggtgaggataccgccattggggccaagaccatactccttcatcacctccttgtaccgaacggtatcacggatatctatgttggccccaaacggcagcgtcatcaccgcagggtcaaggttgagcacataacccctcatgtttgaagcctgggtgtggcataccagtcggtgcataaaagttgtcttccccgtccctacatcacataaaccgagacccttgaggcctgagctcccaatcccaaaattactcaacaagagctcattgtatgacaggttggttgccactaaacatcaaaggatgaaccaatcagcatgcgaaatcgatgtaccggccatgccgatgacgatgatgatcaccggcttcttcttgaaattggtgcgctccgggccgatggagaggctcccgatggagtccgcgagctcctcgctcttccccttccccttcgcgtcagtctgcacagggtccatcatcaggggcaaaaaaaaaacagtcacaatcaaaaactgaaggtagaatccccgtggggaggagtcgggcggcggcggcggcggcatgcctggtcctcgaggtccatctgggtgggcttgcccgcggcggctgggtcggagtcgacgtccatcggcggtggcgcggggagaaggcggcggccacgcggcgagcgggtggaggacaaccgcccgctaaaaccctagagactactgcgctgcgactgcgaggagaggagagagagcttgagaaaggaggaagtggccgaacgtggatgggaagggagatggtcagtactcggcagtgtgaacatgctttaaggttttggacttaccgactttagttgacccatgctggcccatcaaattttgcgggctgacccacaaggtttcgtgccggcccatcatctgaagcgccggcccaagcacggtagtggcaaatgagccgtgccggcatgacccacaggctggcgtaccgtgccgtgccgtgcctgggcctaggcatgagggctgaggcaccccggggaattccggcggaaaaagtacaccgaaggtccctcaacttgtcatcggatacaaaaacatcctcaaaccgcaaaaccagatatgaggtgtcccttaactatacaaaaccagtcacccgagatcctttagtggttttgaccctgttttagcctacgtggcgcgtgggacccacatgtgggcttgccacgtcaattcccctttcccctcttcttctctcccttcctcccccctctctctcgcactcttctcttgcaggctggccgacgggtagggagcagacgaccggacggcgaggggggttgagcggcggacggcggaggcagcgtgtgagcgcgcggcggccggcgaagcggaggcgcggagctgcggtggccggcggatggggagcggcgccgggacgtcgtcgacaggcgaggatcggcggggagaaggggtgccaggacgggaggcagctgatggggaggacaaccgacgagcagcggccgacggggagacgggacggcgtgcatgcctatccgggctgccaaatattcgaagcaatggtacctgcggaagatgagataggcaatcaaccattcaattcaccgcaccgaacactgttgtttccaccgacaaaactcgcatggcccggagatcgctgatgcacagaactgtggcttccctagcatgaatttccatgtaacttgggacaggatgattgttgttagcttgcttgacaccggagttggctgacggatgcctggtttcggtctggccacagctgttgcgctatcgaaatctcctactccatgcagtagctggtgtggcacatgtgagtgacttcaggaaaggaggacatggacggaggcgatcttggtggcggcgcaaacggggcaagcgtcaacggcggcctcgcaggcgccgcacaggcacaggcggcagcacggacgcctccgtgacacggcaggccttgcacgacgtcgccccggacaccgcgtcggtggcagtggcggcggcgccgccgcctggggtctcgaagcagcacgactgcgcatcctcggcgtcgccctcccccgcggtggcggcgacggcatagggggactggaggagctagtcgagcatcgcgcggaggccggcggcgacagcctcgtggctcttggcaacgcccatccacgcctgcccttccgcgctcatctgg

SEQ ID NO: 60761 - DNA, 2010 bp, Oryza sativa
cgcgtcctccctgttgtggcgcgcgccgcggccgccaccagcgcccggacgtgccgtcgctgcgcttcctccaaccccgcgtgcatccgctcggcttgcacggcatccaccaaacaccgacaccgattaaacaccactcaccaaacacaaacagaggaggccggcggcgtgagcgggtgcgtggcctcgtcgtaggtgaagaagagcgaggcgttggttgtcgggatgggaggcctgttcccacgtcgccgccgccaccgcgtcgcctgtcgccagcctagagagaggtaaagtgagacagagagtaaggacgaagggaaagagagagatagtgatgacgtggcacgctgacatatggggcccacgtgggtctcacgcgctacgtaggccaaacccggggacaaaaccactgaagcaactcgggtgaccggttttgtatagttaagggatctcgcatatttgtttttgtggtttgaggacgtttgttaatcccgatgataagttgagggaccttcggtgtactttttccaattccggcaccccggttctgttcccgtatggggccgacgaactgagcggatctgccgggaagaatcgttgggcttgatcagacgaagaaggcccaaaatggaatggccgggcccgtcaggaggaaataaaagagacatggaaaagttcgagtaggccccgcatatgctcgccgaaataggaataagttcacttcatgaccctcaaatgtgatcgaaccctaaaccacaaaaccggatatctcgacccccaaactcctaaaaccggtgtaatttaaccacctcgacggttttgttaacgtggcgtctacgtggcgatattggtcttcgttccatgtggcgttgacatggcacttatgtgacagtagaattaaaaaatatatatggaaccattagtcattcaaaaaaaataaatgtgggcccactgacatttgcttcgttcttcctcctccctctctcccttctctttctttctctccccttcttccccttcggccggcgggcgggagggcaacgagagcgagcggcggcgggcggcgacgaacgcgcacggcatcattatctgactgctccccaccacgcgcacgtcgccggcggcctcgcatgtgtcggagcggcggctcgtctcgtagcacaccggcttggccccatcgccgccgcccggtgggcttcgccggagcggcgacctcctccgctgcagcatcacgaggagaatcagtttaattagatctggtcgcggaatctcgcagccgaatccacgccattctttagcgcaaaactccagaaagcccaagaaataaattatgaaccaggatagcaactcgccgggagaaaaaaattcaagaaataaattatggatgcttcgattccttttcctttttttcttctcctctagtccttgtttgaactaaagccaaatcgaaagaacggatatgaaatcgccaagaacgaatcagccaagccagctcaagcaatgcgctgcactgcgccgctcacgcgcgagcagatccaagaaacacatctcgtaattaccagctgccgacgacaacgacgaggactagtcgccggattcggtgttgacgacgacgtgattggtggtgacgacgagcttggattcgtcggccacgagcttgagggcctcgcctccatcactagctgcgaaggagaacctccaaatcagctctcgcctctcgccatagcagcatccaacaaaacaattaacagcggcggcggcggcggcgagaggaagaagaggaggatgggggagaacctggcgcggatgatggagagcgcgatgagggaggagagcatgagtgccaggacagccgcattcctcagcctcctcctcggctcccctcctcacctcgccgagctcctcggcttcttcttcttgcctccctttctccctctcctcagttgccgagctgggaagctgagctgagctgagcaggtgggtatggggattagtagcagcaccggcgag

SEQ ID NO: 60762 - DNA, 2307 bp, Oryza sativa
ccgccgctcgttctcactgccctcccgcccgccggccgaaggggaagaaggggagagaaagagagagaagggagagagggaggaggaagaaggaaagcactgccacgtgggccccacatatcagtgggcccatatttctttttgtgtgaatgactaatgggtcccactcatattttttaattctactgccacgtaagtgccacgaggaacaaagactcggtcaatattgccatgtaggcgccacgtcagcgaaaccgccctccaaaaccgccgagggagtcaaattgcaccggttttaagagtttgggggggggggtcaagatatccggttttctgatttagggccatggattagatttcgatcacttttgagggtcacaaagtgaacttattccgccgaaataatactgttgttccggggtaccacgcgctgtctccagaatcgctaattctctcacgcgcgtatcaggcccagaaggcccagtgccggcccgctagcgcacgcctcccacgtcttttttttaccgatatttttcttttttacccacttttttctgaatatttttttaatcttttagcatgttttgagtttgaaagtttttaaattttgagctgaaagtttttaaatctcgacttgaaagttttcaaatctcaagttgacagttttcaaaattttcaaatctggacttaaaagttttcgaatatcgagttgaaagttttcaaatttcgagttgaaaatttttaaatctcaaattgaaagttttcaatttttcaaatctggacttgaaagtttttgaatctcaattctcgagttgaaagttttcaaaatttgactttagaatttaaaacttaaatcgaaagttttcaaatctaacttaaaaaattttcaatatgttagtaaaaaaatctccaaaaaaaaatctccagaatctttcctaattactatcattagtgttaagtatattactaatagaggtagttaagacttaagaggggagtgctcgctagcgacacgcacgcgctagctaggagccccccgctgtctcgccatttcatggcttagtaacatctaagaaatatcggagtgatcgtgatcggcgtcgaaccaacatctcatgaatttttgcaaatcatgaaactttaagcatgcctttaagcattcccatcgacgtaagatcagattaaggagttaattactactagcaaatagtattaggaatgacctaatattaaataattaaaaggggtgagactttaaacccaggtcgtctttaaacccaggtcgtctagcccatcaccttatgaagctagccagaagactaatggacgtttttcggagttaattagtgctagagtgcttaaagttctaaaagtttaatatgatcttacatcaaaattttatgaccaaagggttcgttgtggttggaggaagtttgtaggacggattaagggtgtctttggcacccctttttctcaacccatctctctcgttttccacgcgcacgcttttcaaactattaaacggtgtactttttgcaaaaaagtttctatacaaatgttgcttaaaaatcatattaattcattttttaaaaaaatagcaaatacttaattaattacgtgctaatggactgctctgtttttcgtgttactattccgggttgggaaccaacatatgcgaacacaccctaagagttcaaagggatgggactattaatgattctgtttggttaggagacttgagagttttggtaggataagatagagaattgagggagtagggatggtaattggaagcaaaatccttaaatctcaaccattcattttttatttaaaatttaatcttcaataaacttcttatcgagtcccgccacctctattaaagaagaggttgagactaaaaattaaattttcatgttaatctcactggtcactatcaatttttggaatgattactggctgctaaacaagcctctctgctaacaatttcaagccctgcattttcactctatgcacaaacttgtctctgttgtagtgacaattcaaatggggctgagcgaatcctcggtgccacgcctttcttcggctgtagagcagcaattgacacgccgcccaaaccctgacagatcaacaagatctcaaaaaatagctgtccccgatagatttactggagctctcaccaccaagcaagcctatgagctcctgctaccttcatctcaaatggacaagaactgccccccccccccccacccccgaagatacatttttttgttggcttctatcaaaagagcgcctaccaacaaaacaaaa

SEQ ID NO: 60763 - DNA, 7352 bp, Oryza sativa
tctttagaaatgagcaaccttccctacgactactccttcaacgctgttttgatgaagctaacttgtgggctgagcgtatccggcgccctgatcagattgtagtttcagcctggaaagaaattttctcccgtcctatgcaactccaacatatgtaatggcaacggcactgtcgttctgcccgtcccatataaccctctttgtaatgaaacctcttatcaaaaaaaaattcaagtggggaatctctcctatccggtgattatccaaaaaagataagtgatcactatcaattttcttccctcatgttaccaaacaaatccggaatttctctttctacacaactgtttgcgtcaacatatagatttacggtcaataattctaggcagcaagcaaccagccaccaccagcagcatcagcagctagcaagttcgcgatattcgcaagcctgccagataatcgtgcccacgctgccggcgaatggacatgcatcccttgtggcaaattcggcgtgcagtggatatggatttgcccacaatctctgaatgcaaccacctgaacagtcaaataaggtctgcaagcaagaacaaagattctttgcggccggcgaacgactttcgacggcccggcgagaaataaaagaacaaggattttgatactacgctcctgttttggctagctgtttcccctgcaagcacatctctccttccccatccactcatctttataagctccaaccagcgaaccgaagacacaacacgcatctaacatctgtacagctactcgtactagctaataacttgtctgtgtaattggcgctatggcgttaagcaggagaacgcgccattgcctggtattactacttgtctccttggcattgctcccactgggcatggctacggatcccattggcggctactgctcggagtcggggacgagcgatgctgaaattaacggcaagacgaggcggcgcagcatcaactccgtcgtctccgacctcgtcgccaaggcggcctccaacggtggctttgccacgtcctccgccggcaagggcaacaacgtcttctacggcctcgcgcagtgccgcggcgacgtctccgccagcgactgcaaggcatgcctcgtcgaagccgccaattacaccctctccttctgccactatgcatcggactccaggatgtggtatgcagctacgctagctacggtccagtgcgtcaatattcgacagattttattccacttaagatacaaattttacatcagttttcatcaacatgttttttaaacggttgaatgatatattttatgaaaatcttttctatataaaaagttgcttgaaatattaaataaattaaccatgtgtcaattggtttcgttatttttcatgccctaacattgggccggttcattttgatgacattttcaaccttatcaaattttggtaatgttgtcaaaaagtggctacatttagggcttgtttggttctttaccctaccaattcattggtagtaccaaagtctaggcaaattttggcactaccaaaatattggtagggccaattatttagctaacatttggattgctatcaatttaaagccaaattcttatagcatagtgaagaaacttctagactatgaccaaatattttaggggcactatcaaatatttggtctcaatccaaactaacacacaaactattcaatttgccaataaattggtagggtatgtttttggcatcaaaccaaaacggcccctagtttgctgccaaattttgataactatataaaaaatcctgccaaaattttgacaagttaccaaaattttggcattatcaaaatttggtaaggttttttttttcatcaaagtgaacatacccgtcatcttcatcttcattaaaaacaaatggtgcctggctgcgttcttggttatacattttacgttcaattggctgttgggtaggcttttcgattccacgtcaaataaaataaaaacattagcacatacttaatcgagtattcatgattgctaactgaaaaatgttatttaatttacaagtagccgttccaagttaccgtttaaaactcagccttttgccgtaggctttaatatggtactgtatctttgtcccgtgaataatttacttcctccgtttcacgatgtaaaactttctagcattgactatatttatttagatgttaataaatctagacatatgcatatgtttagattcattaacatctatatgtatatggacaatgctagaaagtcttgcactgtgaaacggagggagtatatatatactgattcaagtttgctcttttactccctccgtactaaaatataagagatttacgtgatgagaaaactatatgtatgttccttttagtgacttggtttgatcaaattgcactaaaaattttgcttcttttaatctataccttctatatatatatttggtacccactagcaaatattacaagctaacacttaatatagaggtattccacagcatcgcctattaaccagtactgacggagcgtggggcttctcaccgggagaccgcgcaggcccccctttgccggttcggccgggggcgctaagtgaggttcttcgccctcgatctgaggaacgtcagcgagagagaaagtgcacaagacacgggcgacgtagacaggttcgggccgctgagaagcgtaacaccctactcctgtgttctggtggatctgtgcgtgaaggaataccgagagccccccgcgagagggagagttcaggctctcgaaccccctccttttaggcctgggcctcctttttatctgtcaggggtcaccacaggggcctctagctgcctaagaagggaaacatgctttttacaatgagggctagtctacagccggaagtgacctctgacaagcagagcacgcgcctcctgccccgctcgcctgcttttccggtggacgcccatttcaaccttcatttaatggccagcgacttccttgtcatacttgcgctgaagcctggaatggatctgaccgggactgacataccaactccaggagttagcacgccggctccggctagggacaagagccagaaagctcttatcattccgacgggacggggcgaggcgtgtgacaggccgcctgttgccacctaacccgcgatctgaccgatctgtgaccggtcacacaccgtgactggtcacggaccggataagcgtgcgctgcgccgcattgaatgcagcgtggtgcgctcgtccaacctgctataaatgcggttaggtgagccccgctgtgctcacctaacccacacatgtggcgccaaaaccgcagggggtcggggcgccccagccctcggggccgaaacgggggcgccccagccctcggggccgaaacgggagcggtccgacccctcggggagacagagggaggggtggccacgtcatcctcgggcccgacccccccgagggggtcaggccacgtgggtgaccgcggctatccaagcctctagtcacgatacccccagccccatgtcaccgacaagtactattctagagtataatattgtagtgtttaacatgtaaatatgtcaaatcatctttctcacatcattttcacaatatttcaatattcattatttatataatatttaacatatattcatctatgcgtttcgcagcaaagcacttggtatcacctagtttaaatataagaaggcctataagattttcttttaaaaactacgattatgcacgactgttttttttatgacgaacttatatcatgtgttgtgtgtgacgtacatacatatgtaatttcaggtatgactactgcttcatgcggtacaagaacgccaacttcattggacaggtggacacgagggtggacgccagcgtaagaattaggaaagaagaaaacatggacaaccctaagacgttccaaaaggtggtggcgaagacgatggacaaataccccaggcggtggcgaccgcggggagtgccgcattgggaagggtgaaggaaaaatacatgacgtttgtgaacatctacgggctgtcgcagtgcacgcgggatctagcaccgctggcatgtgcccaatgcctgtcgacggcagtgtccgacttcggcgacatctgcaacgccgcggagggatgtcagatcgaatacagcacctgttgggtgcgctacgagatttaccccttctattttccgctcaagactgacgggcgagccaccactgacatgacgaagtacaccaaggtcgttgtgcactgataattaagtttacaactagttatgtaaaggattatgttgtaacgcgtagcaatatacatataattaatttgtgggtgagatcttatatgacctctttgccacgatttgaaatggttctagagttaagtaaaaaaaagttctagaggacgaggtctcttataattctttgatttttcttgcacattgtctacctcccgtgtttgagtgtctcctctcctaagaccccaaccactactacacatcgatgtcttgctaacttcatgggtttttgttcaacaaaaaacaaaaacctcatgggttttaactgtgactctgaggccgtggatattcgacctgcccgttagtaaaaccgtgctctgggcccaaacatacaggcttcacacctgtgagccagcttgtcatcccgaatcgccgtgagacggtgagagtgagagggggaataagatcactttgactcccttaactgaccatcgaatctaaatcgtatccctcaactgcaatatcagaaatcttgacccccgaacttgcaaaaccggtgcaatttgactctcctggtagtttagggcggtttcactgccgtggcgcacacgtggtagtgttgacctggtttttgttccacgtggcattgacatgacgcttatatggcattaaaataaaaaaatatatgcgggacccatttgtcattcacacaaaaataaaattgtgggacccacagacatgtgggaccgacatgtcatcttctctctcactacccttcttcctcatctctcccttatctctctctctctctccccttgacatgagtcggcgacggcggcgagcgggtgccggagtggtggcagcggtggccggtggacctcgggcgacgagcgtgggagcagctcctccctgaaatgggcggtggacctcaggcgacgtgcgacggaatgcgtcgggggagatgggagaacgctcctcgtcccagctctgtgtcgtgggcagtgagttgggtggcggccgcagcgtcgacggcgaggtgggcggtggccgcggtggaaagagagcgatagctcgctgttaacagtgaaatttggtaatcggcaaagacgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggtatgtcagtttatctattaattaggaatagtttgttagtttccttttatctttaggaaagtgtgtttagtgtccgataaggactttatcttttcctttttagtttctttcttgtccgacaaggacttgtatcaacccatgggtataaatatgtacacccggggtctatgtaatctatctctatgaccaatacaattcggcgcatcgccaccttttaccttttctactttattttatcgcccagtgggacttggcacccgacgtggggctgcatcgtcttcgatctccggcgaagggataagtccaatgttccgtcggtccaggcaattgtatcgtctacgttggtgtcgttcaaggctgcatcagtacattcgacctcttggattactctgctttggataatatatttgcctacctatttatcatatgtctctgttaatctagtcttagcatatcaatttagctctatcggctgcttcccgttttagggtttctgccggtatcggctaaatcgcgttgctagattagattagcttagacatctaccaccctgaaaactcagtcaacggcttgattgtctagatattatgtttctttttatacttagtgctgcatcagttaagtttgatctactaagtcgtgcttagaaccataatctctagcctgcttcttgattgccaataagggtttcatcggggtttcagtcggtgagttatctagacgttgcatcagctcataaggattgcatatacatataagttggatttagccgatgacaacaaaggcttcactgtttaatctagtcttgtggatttcatgacatcggacctccagccgatgtgtgctttgaccttcggatcgatgtttatttatcatatcattatttgctgattggtttatactggactatattattgttatattttattatcggtagccgattgcctttataccattatctacattggacgtatagccgattgcttaaaccctatcgctatcagctggtatcggcatcggctattatcggcatcggcttgtcagctgatcggctgttttgatctactatttgcatatcttgtcagttgcaggatcaaactgactggcacgcccgcatctcaacaacctttggacctgcactggagctaagcagatctcccaggctagtgtgttcgattttttcgtcaacactcgcgccccccaatgcgcggtggcgaactggcctcgagcgctccggcgtcgacctgaccatgatgcgtagcgacggctggagctcctcctcctcctccgacacgggccccctccccaaccacgtccgtcgcgagaccacccccttcttcctcttggacttgccgccggccgcgcccgtggcgacctcgcgaaggctgaggaagttggcggcaggagcagggggctcggtggccactagggcggcggggttctcgcgctcctcctcctcctcctcatcctcggtgcactcggtgtcctccgccgtgcacattccttcgtgccaccgctccctgctcgctccctccccgccgcggccgccccgcgccatcatcgctggaatcatcccgctcgtcgctgttgtgccctcaccgccacacccttgctgagcgctgccaccgccgaacctgaatccctgctactgcagcagcggaggcggcagaggcgacgcgaagactgtcggctgccgctccgtccatcgcccaccgtcgccgccgccgatccggacgccactccccacgcacgaagagaaagagggagagatagagaagggaggaggaagaagggataagagagggtggcatgtgggacccacatgtcagtgggttccacaatttt

SEQ ID NO: 60764 - DNA, 20126 bp, Oryza sativa
  unsure (1)..(20126): unsure at all n locations
tatatatatatatatatatatatatatatatatatatatatatgtatgtataggatcaggatgtgttcctgccgaccggccggttgatcgacccatgcatggacagaactgatcaccacacgcatatactctgtcctgcgtgtaaaccagctagcatgaatgtcatatgcacatgcgcgcgcgcgcgacgccgcgacgcccgatcactcctcggagagcttctcgagcagcatccgcatgagcttcacctgcacctgcaggtcctcgatgtggctcgccgcgtcctggaacagctcgccgagcccgcacggctcgcggcggcagggcaccagcctcctcagctcccgaacctgcttcaccagcctagggtcctccaccacgccgcccctctcgctcccaccggccatggaccgtgccgccgccgccgccgccttgccgctatgccgccctttcatcctccgatcctcctcctcctcctgatcggctctgctcacagcttcttcagttcttctcttctctctcgcccagcagcgagctaacgaagcaggagcgcagcagccagcgaggacgggagaggccggccgcatcactcttgcgcagtagcaatgagtgcgcgcatatatagccgcaatctttgtttggatatatgcacggattgatacgatagaacgtgcaggcgttagctgatcgatcgatcgatcgatgatgatgatgatcaatcatggcgttgccggtgcgcctccatatgcgcatgtccgtggccgtcaccgcgaaccacctacaaaaggatacgagcgcggcttattctaatggcgccgttgctgcggttggccagacacccgccgattctaatagtgatcctagctaggcaagcaacgttctactactagtatattgcttcgcgccgcacacactcgatctctccatcgatcgatccgtcggccgcgcccggcgccttcgcagaaactaagcagctcagctggccggacggacgacggacggctggcttgcacttgcatgtcagtatgctgcatgcatatgcatgcatccgcttggtgtagctaggcttgtagcgtagtgtatagctaggtagccaccagttttaattcattcgctcggcgttgcaacgagaggggaggtctctgcacatgcacccacatgattcgggctatgcgcgccacgccgggccaacaaaccgaacacacaccaactcaggcatatgaatgcaggcattcattcatgcatggtgcgtcaatcgctcgcctttgtgcctaactagcgaagcgagcgatccgtacgtggcgcccgttcgtcgctgggaacaccctggattattcgcccgcctactgcacctttctgttccttgcaccgatcgcgagtatattttagcacgttaggaaggaaggcttgggatgggctccttgggatgggctcctaatcaggtagccctcatgacaccgtcattccagctcagtctgcgtgtactgatcatgtagtgcagttttagagcgagctagctaggtctcttcttgttgcaacgagagaaagagaaagggaggtggtttatattagctggccaattaactttgctgtgcattattggacgacgtctgtgctcaccttccggcaaactctaaacatactgctaatataagtgaagtttcgaagtcatcatgttatgttcggaaaaggcaaccggttgttgagttgatcataataatttgggccctgatttttagctgattctcaactgaccaaaggccatccagaagcatcggcagggcagacattagtatttcgcattccgaatgcaagaggataaagaaaacactacttcatttggtgccggttgagaaacctccatatatagatgtcagatatcccaacaggcgccatggaggtagtattgatgaggatgacttaaaggtgggtgctggtttaagaaccgatacctttgagttatatggtttgcaaataaaaaaaagccagctcggctcaattcgagccgaaccgatgcttcaaagcaaaaaaaaaaataaatcaaaaaatctaacaaaaaaaatacaagacacataaaagaatcaacatttcatagatcacataatcaaatattcacatcagagaatcaacaagtttgtggaggaagataacaaaatcaaatattcacatcaaagaatcaacaaatttgcggcggaggagccccagcggtccgccgtggcaacgtcacggggtagcaggagcgccttgaggagcagtggcgacgagcgaggcgaggacggcgacggccccgtatggccggtcctggggttttggggccctaggacaaaaacttatatagaggcccctatatatatatatataaacataactaatatatgtatatttatatagtcttataaacacacaacattcgatgtgataaaattatctatatataacattttaaaaaaagaaataaatagcagtaccgagctgagaagacgaccggcgaacgatcgacacgagcgtggctactggtgaaccgtgattctccgacttgctgtttccgtttgtgagacaccgagaagtcgagaagtcaccgagagcgcaggagcaacgagcggcgtgatgtgatcaaggcgacatggcgagtggcgtgatgtgatcgaggcgaagcgactggagtcagatgaagagatcgaggcgaagcgactggagtcagatgaagatcgcttcggctttgctaaaataggcctgacgatggactaaaatttattttctgtattggactattcagttgtctagcttaatatagacctatgacccatggactagaattatccaatacgtagtatatatactatatgtgtataggggccccctagattttgggggccttgggcggccgcacggcctgagccccctccccccaagggccggccctgtggccccgtgacgcaagaggcatggttgacggtgacgggcgccggcactcctcctgctccctcacacgacaaggacgacggcaccgcgttggctcggccacatcggcattgtgctttcccttgtgagggcgctgcagcgtcagcgtgcagcgaggggggcgaggatggcaacggcgccgtggcgcaggaggtgtggttgacggtgacgggcgccggcactctcccactcccccacccaatgaggacaacatcgccgtggggtgcccctacgtcggctcaaccccgtcggcaccacgcttccccttgcggctccgttggccctggaggcagaagggaggaggcggcatggtgaattacgactagtgatttagggaggagaagagacgagaagggaggagaggtgagggaggtggtggcttgggaaagaggaaggaaagggagaggagcacgggctggacgagaaaggaaaagaaggaagaaaagagaataagaagaaagcgaagagactgaagagacaaggacaggaggacgggagataggtatctgttgtattaaaaaccagcacttttaccttgtataaaggtgtcgttttttaatagaaattgacacctttctttgacagaaaagataggtgccggtaccatttaaaaaccgacacctatttataaaaaaggtgtcgatttttgccattggcacccttgcgagtgtgcgtgcgtgtggaaaaaacattataaatgtcggtttagctattccaaccctatagtgccgtctcctttatggctttcttagtcgtcaaatgacatatgaacattatatatacataactgttaaccttaaatgaagaacacattaaggtggatttatgtcgtatcctctaccattttaatccatgttatgatttatattacccttcttcttcgatccagctccaacgagatgacgatgtctccgacgagatggcgacggtctgatcagtttgagtttgtggttagggttaggatgagagggattgcgaaagaggaaagaatattgttggccttaattagagggatgtcaatcagagatggtggcgtggtagtgggagaggcgcgcgataccaaagccatgggagatggatgccaacgatgggctaggtaggcaacgggatgagggatgtcgttcggtgcggataccaatcttcaaaggaacaaattattcattgatgtcactcgaattacaaaacttctagttatgtacctaatacagaagaacattcagtttaattggtatttaccgggtatttttgcttaagccgaatttgagttcacagctgagcgtggtgttgcgccacgcattctcttctagtgtgctctatgcctctagttaacatataagcttataagtttcaccgcgttagctagtactaggcttttgtttgtcaagcttgtattagagagacatactcatggtgtatgtaataatgtgtgacaacgaaacgggcatatgtagacaaaggctttgcccaatgaaattattggtaaggagctttaaatcactagagaagtatggttcaattttcagtagcatcggaaaaaaaatccaaaaaggaactcccatcatacagcacatcggctttgcaagaaagccaatggacgaaacaaattaaagtctgacaattaacatctccgattgaaagatatattgcaaattctttgctggataatactccatataagaatgttttctaagggtcagcgttatacgggtattcccaaattacgcttctgttcaatgtatcatattttttttctagctatagtatacattatccttgtactacgagagatggctctttgtgcttccctacaagaaaccagtgatcaagtagcttatgattatgctccaatgatgcccccttgcatgtacatacgcgtgcgaacttgacaatgtctacgtaaacaaacagctgcagagttatataatacctagattctcattgctaggataaggatgtgggtgggtgatcatctcgttgcaacgaaaatatagtttagttagtataagagctcaaagaggcagcatctgtagaacaagctaggtgtgccgcctttgcatcatgatcccacgtgcatccaatagcagcaaaaccgtaataaacggcactggagtgacccgcacgtatcttcttccagcgcaagccgtttaagcgaggagacagggggcattaggccggcctaaccatcatgaacactccatcatattattgaagagatcaattagagacactcttagcacaagcctaacttgtgtactagtttctgtttactctgttttgcagatcttgcttttcttctctaaagtctggagggaaactattgtaaactctcgagaagatgatatctcgttatttatatgtcacttaaatagttctaaaataattttaaaaaataagatagatagattaatatgtggtatgtcactccacaaacatttaaatatatgtcaactagctataatttaatttgttttctacagctcgtaaagttgaattttaggttgtacgtttgttaagggatatatcacatgttaatacatcttattattattatttttatttttttcataattatatttttataacatgtaaacaataagaaaatattttctcgagagtttaaaaaccactctcgaaatctaaagtacgtaatctcggaagttctgtaacgttttttttccctattcatgcgactactctgagctcacgagagtacgaagctgaggccattggatgcggtaggaagctatctttaatagggttaactgaatccatgtcattcaaaattaccatataagaaaaatattaatactatttgtgattagttacatgtcacggaattttttgaaattaaaaccgcatcatcgctgtcacattttatgtcattatatagaccaaaatgcttctgtatgtgggacctacatgtcagttttatcttcttcctccacccttccctcttatctctttccagttatccctcggtggtcaaagaatgtggcggtgggtgggccatgggtgtgtggcacgggtggctagagagcgaggcaatggtgaccttgttggcgagggaagtagaggtcgtcgaaatttgctctatggatggagccgtcgtgcgagctccccgagggcaagtaggaactttgagatgtcgatggtgttgcacatggaagtagccggacgagcgacacgcaattgacgctaatctcccctctcttttctcactcaggaggagatgcatgagctactcatccttactgtcaggaggtcgccagtagaggtgatgggcggcgtgagcatatccaatgataaagaagggggtggaggggatgggcgatggctgcaggtggtcggcgcctgaaagagcatagatgtaacctagagggggggtatgctttcctgaaaaatacacaaaataatcgtagcagtcaaattaaatagggcccggaacctcctggtaaagaacacatgaacttacgggtagttatatactgcccggaacttctggtgttcttggcttaggaattttcgggtacaccgaaacttagaaaaacgacttgaagattaaattattttctaatcatattcaatcacagggatgcatagaggaataaaagaagagaaaaacacaggcacaaacacagatcaagcacaggagagacaagaccgactttttcccaaagtccggatctcaccgatcctactctccgttgaggaactccgaagagctgggtctcgattaaccccttgcctcacttatgcaaagatcccagaagaagtctacagccttcaaaccaacacccctaggtcattctctagaattgagtgacaaccaagatccatcttaaactccttctagagaagaccacaagtgaggcttgctctactaggacaacctctaatctcagcacaatttccttaatcacttacctcttttacttgcagaggtgtggaataaattcacaaactttcctaggacatccacaattgcaaaggaaggtcgcgggtgacacctaaccgcctaggagaggatctccaagagtaataaggccaaagtgacagcccacgaggtacccaaagtgctcacaccttcctaaccttcaatccttctccaaatcactccaacaccctcatcaacgctctcaatctcactataatggctcaagatttgggtggaggaagcaaaaggatcttgggagaggctagaaacagctaggaggtgaaagaacaaaagtgaaatggccaaagagtgagcgggagatgaaatccatatatatataacgggtaggtgacgccatctagccgttactcacatttttgaactggaatactacctggaagttccagactggggtgccaggaacatccggccaacacttaggaaaaatctcaatttcacctagtggcccagaagttccggacaagagtgccaaaacttccgggtgggactctctgtcctgggaggggctattttcaaaaataactcccaaaaatagttcaatgagttgaagagcctaagagcacttagggaacctcagagcatcacttgaaacccctcttaatagtacagtttttttcctaaactcgaagcgaaaaataaaactagcctaaaccggctccggttcttctcaccacattgaatctgaagaactggtggggggggtctccaagcgtcctagccacctcgtaagcaacctgggactaatctcttgtacttaagctcaataaaatgcattagttcatttaaccatttagtcattaatcaccaaaacccactagggggttagatgcactttcaacgtcggcatcggagtcagagaagccagggaggttgatgcagcgcgggctacaggagaggatgcagatctaacaacgatgacgaaaaacgtgacgacgatggtatggttctatttcacaaaattccaatggcacgtaggagatatcacgaatagtaatagcatttttataatatagtaattttgcaatggcatgatccaattaaccccttttaataaggattcttttattaataagatgtttatgagtcttaaaaaaagtccgaggctgagccacacgtgtttctatagagagcatatgattgatgaggcattaaaaaggttttttttttgttatgcttcgaacggtatataacctacttaagggattcctttaagaaaggatgtagccagaagtagaaatagaattggaaattcacctttgtatccgctcttgagtttttcgttagtctttgagaggtgcataccattactactaggaggtatatatctattgattagaactacaaagtatatattcctttttacactacaaaaggtgttttgcagagggcttccacggcgaggttgtgtggtggcgtgttgggacgaagtcgaagctgcttgtcggaagtggcaaaatcagcaatgataacccttttctgctttgtctcggcaccgttatggacttgtggcggctttagtgtagttgaaaaagagggggaactggctgaaagccgcacatgtttttttactagtgccaatgacgctgtgacacccataggcgtcatcctccttcttgaaggtgtatttatttgctctcttccttctccttgccccgccgatagttcacactctaagtctagtgggagtgcactcgtcgatagctgcctgatcaccttagaagaggattcggcttcctgatccttctcattacctggaatctctggttagagaggaccgctcgcgtttttgatggggtcctctcccaagtggatacggttattgatcacgtcgtgcaggaggggaggctctgggtgaaagcgaagctgagtccttctggagttcttcttggcatatatagtcatttagttttttcttttcttttccatgcgattttgcttgttcagggtttggttctatctagcttagctagctgttgatctccttttctccccgtgtaaaccttccatacccgttacagtagattatagttgtacaaaagaattttctcgtaatattaacatgtaaggttcttgcgtgttcgaaaaaacaacgaatcagtcagcgagatatcccagcagcatttcttcgtaatcatgcatatcaaaaggtactgaagtagcctcgttgcggttaaccaccatatataaattcacgtgcttcctgattagttcagtttggggaacgatccatatctcacccaaaatagatctcagcataatccaacgttctgtgaaagaacatatagccgactggttacagtggcctgagtaacactctaagatcagtcatgagttcaaatctgtctaagctaagatcccaatttcaaaggctgcatacatagcctcatgtgtacagggtcccttcctgatatactcccgtatcagcgtatctcaaaaccgcagaaaatatgaactcctaccgtatattaatttaacaaacgaggtctttatacttgacaccagcaaacaagctagttagccagtactaatgatactactaacaaatagcctgaaacaaagccctgacttgggaaaatctgacaataatagcccgaaagaactcgtcgatgtgtatagtttcttttttcaaattgtccatgtttacactataccccgcctgaaatttacaaaggatctggcgagaaaaagggcttccgtgtccagtggatcaatagtaagaagtagtactcccgagtacagaaacccctataggtgccggttgggaactggctataggtgccggtttctaagccggaacctattggtcggcacctttatctcaatcttattggtgccggttataaaaccgacacctatactatcaaaaaaattaaaaaaacgatggcacctacactgccggccttctccaccgccgccaccaccacctcgcccggcctccacgccgtgccaaccttcgcgccggcctccacgacgtcaccgccacgaggagaggaagccgagaggggtgagtctccacctagccatgcccgcctccgcgccgccacccaacgtcgcgctggaggatgatgaggacatcctccactattacccgctggcaaagatgcaaaattcgggcggcgaccgtgtgagcctctgaataatcccaccttgcttagcttgggaggaggaagccaccttaaaagggagagccacccttcccctaccggactagtcttttagggagattgggcctttccccgagtgggtgtgcctatgaactggagattgggcctttccccgagtgggtgtgcctatgaactgttggggtccgggcaaccttaagttattgggcctcggccaacctcacctgggacggattgttatcaaggggggaggtcccctgggagagaggccgccaccttgccggggccggattgttatcaaggggggaggtcccctaggagagaggccgccacctcgccggggccggattgttatcaaggggggaggtcccctgggagaaaggccgccacctcgccgcggcggccgccaccccacgccatgctagaggagaagaagggaagggaggcgaggtcccccgggagagaggatgctggcgagatccaggcctactccaccaccactgccgtcgccgccacctcgccgcgccagccttcgcgctatcgccaccgcgaggagaggcagccgagaggggtgagcctcctccagctgtcagccgccacgccggccaaccttctccaccaccgcaccgtctcttcgcccgcgtcggtcggccttctccactgtcgagccaccctggaggaggagagaacgggggagggcccccaggccgagagaggaccgccgcgccattcttctccgtcggccgccgccactactctgtcaccgtcgctgcgcaatgggagaggaggggcgagcgagcgagagagagggagggaggtcagaggtggatggatggattaagatgaggctggcactgtgggtggtcaagaagagccggctcggtttttttaaatataggtgccggtttttaaatagaaccgacacctatatttatattataggtgtcggttctaaacaaaaaaccgacacctacagtgtaggtgccggtttttttaataaaaccgacacctataatgtttaaaggtgccaattttaacttttttttatcgtgcggaggtgggaaaatgctcataggtgtcggtttatttaaaacctacattatttatctataaatctataaggtcggtccctatgagggcttttgtagtagtgttactccttgaaggagtttaataatataacgattaactactagctccaaaaattgaaatattatttatagataatctaatagtccactcatacaataagagcaagtacaataagatgccataagcatattgtataagttgccacatcacatttgtatttatgtggataggtaaggaaatgagagagaaacaaagcggactatagatttatagccagcttcagcgtgagttccaataaactatgtgagagagatgggtgaatgatatattaatgatgcagtatatatctccaactaacgattatatgagtgtactattatgttggctatatatgatatttagatttttgaagccagtagttaactatattattgattttgctctaattagttgtagatatatatattgtatcactaatatctaatccatctatctctctcacatagtcagtgtttggctaataggatagggaaataatttcccaccaaccaaaagacatacttaaatcataaccattcattctccctcttccatttaattctaacccttcattcattttccaatcccaatcccactccctatttcctattatccaaacacacccatagtttattggagcttgtgctgcaattggctaaaatttgtagcccactttttctctctccttcacataagtaaaaatatgatgtgacaacttgtacctccacctacatcaggcctatcttactcgcagtaacactcctaatacaaagaacatgaaataatttaatcactttctcggttggatcacctcaataatgcgaacaatgtgattgagggttttgatggtataggatttaaaacaaattaattttacaagatcagagctgttagttaagtatgtatgcatacacgtcttatatattataaaacatgagaaaaaagtggttgtgttttatattataggataatagaagtactacatagtaataagtttcatccggcagaaattcgtgccgagaacatgcaaaacaaaactgggccagagaaatgcacacatatctgtagaagcccagcgcgcagcctgagctgagccggccggccttttcaccttttctcgtgcatgtttcctgtattttcaatcaaaatcatctagtaatgctctctagctatgctgtcgtttcttccctccgggaaatcctcctctgcatgtgcgagcgactgcgtcgacaggatccaggcaggcgcatgcgtgtatgtctccatccatcgggtgccctgtcaaccaaactagtactactactcgtattcctagtgcaatctctttcgtaaaaaaaacaatagtattaaatatgacataacttaatactattataaatttaaatatatctctgtctaaaattatattactcagatatatcatgtttaaagctagattgattttttaatgtaagggagagagtactgcactgcagtgtgcgtgttttgcccattcaagcgcacctacgttagtgtacgtgtggccgctttatctgcccactgccgagctatctatcaatcgcgtcgactacagcggaagccgtcaatccaccggcgatcggtgtcgcgtatgcgcaagcgcaatgcatggatgagtgacttcaactattgctctccggccagttctctcgtgtatatatacgtggaatcaccaactcccaaatcttctcccgttgtcggggcgataatctcttcttgtttctttattttgcgattgcgattagccgcgggttggccagatgtctggtgatcgaggaaattactccctccatctcttaatatagcaacctaatattgaatgggacagctaggttactatgttatggaacgggggagtattattctccgtggctcctaaccatccatccatcgtagtagtacgttttatcgatcaacggtcatcggtcgacggatcgacttgacgagggtgtgtgatcagtgtgttcccttgttgatgtcatgttgtcattctaagttgaacatttgtcgcttactttgagatttttgagattcatgtatatatgtcataaatcacattattgtactttcttttcttttcagtacaggacgaatcttaacaaaagcattcaatggttcagcatgttgcacatgaacttggatcgtgaaaacaatctttccgtttcgattttactgtactgtccgtggataacgtcttacctggagtgtttagctcatgttatgccgttcacaatttctatttgggcttaggcccaaaactctaacagtaaccacattccccgctgtcccgtgacagttgctccaaatgtacactcgaatatgattcgacgatctttttccctgctcaaatcagcggctgagagcgctgagagcacagagagcacggtttgttatcattacttttatctctttcaataaatcagagacagatattagaacggtgaaagctaaaactatcaaaagcatacaagtcaattgcaagcccgccccgcgagacctgccatgtgcatgtgacatgcacgagggcaaagtgaaaaaaatgcggcattgcgtttggagatatgtcccttccgcacgggggaatccacgagcgctgcagcaggctgcatccgtacgctctgggggccagaggcgggggctggctggctggcttgctggcttgcttgctccaacaaagctgcaagctgctcccggtgtccggctggatcgtagggccctgccgtgccggagagcgagcacgcgcatgtgccgacgccgtgcaaagtccccccctgcgcgcgcgcaaccgatcgactcatggcacgcaggcagcagcagtaccagcgacgcgcgcgcttattattggtggtccacgctacttgctgtggctccgctcaacagccagagccagcggtagcgaagccgatcgatcgcgcgcgcgctcgctctctcgctcgctccaccgcgttgtttgtgtcgcattggttggccctctctggtctttagctaagctaccgtaacggctggccggacaggccacatgcatgcgcgctgccacacagcagagacagagcttatcttagggtgtgtttagttctaaagttttttttcaaacttctaactttccatcacatcaaatctttcatacacacaactttttagtcacatcgtctccaatttcaatcaaattctaaactttggttagaactaaatacagccttagctctaagctccgcgccgcgacgcgatcgatcataccaccacggtccacgaccaccacgaggcaaagcaaagcagctgcggccctagctcccgtacgcgtcgcatgcgggacatgctgagataaaactcgtaagtgcacagataaactagtagtgcgtggtgtatcgtacgtacggcccggccgtccggtcggcagtcaggccactttgcaggtcggcccgcccccggccgggctggatggctcagcgtgcatgtgagcgatgtaaaacgaaccgagaaagcttgcgatcgatcgaggggactccatgtcacaccacgtaaagtacatcatcccggcttcttccctgctaagctagctagtagtagctcgcggcttttgcgacccaattcgctttgccattttggtgcgccggggtggtgtggtagtgtacaggtgtgcgtgcattgccgcgctcgacgagccgtgtactccgtatgtgtgtgtcccgggcatcgtgtcgtgtccccccatccccatgtgcaactccggtctactccctctctcctctcgtcaggctcaggccagcctgccgtataaatgaaggcgtcgacgcgtcgacgtgacagtgtgcggcttactgaagtactcttcatactctctcgtctctacgtgtacgtacgagtcagagttatgcactccaattatttctcaatcatgcatgactggtgaggatgtgagtgtgttgaatgtgcgtgcatgcatgcatgacacacgtttgatggagtgatggctgtcatttctcgagtgatctcggaaccaccgcggcgtgcagccggccagtgcatgcatatcagcatatccattggacggtgacgcatttcttgtgggctgttcgtgtcccccgcaagaagatttttttaaaaaaaatacttactcctgatcaaaagagcacatgcatacgctgaaatgcatatgctagtaactctcagcatctgccagaagtggctttgacccctgaatatgaatatatgatcgtgatgatcgcgctcgtggccagccggccggccggtcagtccaaaccctgcatgcgccggcaaggttgcatggcgactctgccccattttgcgagtcttgtcggtacaggcagccacatgtacacgcatgctttcagggtcaggttatacagcagccctccctttctcttggagccgtcgtggccggagcccctccaatcgcttgctcgtgcatttttcaattgcgtgccccctgcgcatgtgttaaagacattctttccacccaatttggccttttcaatccgatcgtgcctttctggctgccatatattttagctcccaaccacatttacggtatgacgaaaaaaatgatcgatgtgacacacccaattattggacgcggtaccagcacaaaaatcttgcgtaactttatatatatggatcgagacatttggatgtgtgatggtcacatacaaaagttcagtaagaaactagtaagaatatttaatttccctgttggatccccgcaaaaaaaaaaattccctgttggaacattcatgcaatcaacttaattagcacccaaacagtcaaattttgtgacacaaaattctttatttgaacttgcgtttgtgaaaaattatttgtactccctccatttcaaatcacttgttttattctagttttgtcgtaaaataaaacatttctatctttaatattaatttataaaaagttcgtaaagtttatcaacatgtgagtatatatatgtcatggaagtattaatactaaggataaatcatgataaatcaaaaatctgaatcttataatataaaacagtatcaatttacttaggatatacataccaggatatataatcgaaaatgcatttagtcggtatcccgttccaagagattggcacgggatcctctccctccctcacgcgactacagcaataaaaaaaatgcagatgcggctggattttgctggggctattgtagcacagaggcatatggattttgcggaaaggttgtggcgtggcgttggccattcagtgctttagtgcggcgtcgcttcttcgcatatgggggtcggaacgggtgcatgcaaggctaggtcgagttaatggcggtgatgacggagccgccgagagatgggggcaactcgcctcctagccacatggtgcaaagaagggaggagtcgggtatctcttggtctagaagaacttgaacagaaagaagattggaaggaggaaggaaaaatgaaaagagaaaggaaggggaaatggtaaagggattgatagagctatcaaaattttgttttaaccattgcacaggagtgaagcggctgcaacggctgcttcaccgggtcaccatggccacacacagaggagagggatgaggaggtctaggtcttgaggagtggccgaagaaggatggaaaacaccgccaccatcacgtcaagggaggatgggaaacactaccaccgttgtgccggtaaccatctccatcccttcctctctcccctctccgcttagatttgataccagataggtacaggatttgtatcggcaagtacatgtgtgataccaatgaggtttaagttggtacctgacaaggtatcggttggtatatggcagatattggccagtaccgacgaggtatcagttggtaagtaacgggtatcggtcggtaccgatgagggccagtacctaccagaaatgataccgataggaatcaggatatgataccttctcggtatcatctccttgagacgggttctcgtatagccgtctcctatataacactagaatgacaagtaatttaaaagaagactaaccatcactattaaaaaaacatatattttgtaaacatgcaaaatagatttttccagacggccatccaccccgcctgcacataaaggcctgtgaaaatgcacgatttttgtaggcgcctcttcatttttgcaggcggtacaaccacccgcctgcgaaaatatactctatgaaaaaaacccccgccaccacccctacccgccatcgtcgcctgctgtggcccacgccctccgctggatctaggtgggagagggaagggagggaagccggatctgggagggtgggaggaagctaggggatgggagcgccgccaccgtcgctccctctacgccgccgccgccgccctccccctccaaccgaatctgagaggtcggggaggggagaggagtgccgccgaccggatatgagagggagggagggaactaggggaggggagtgcttccactgacgctcccgtctccgccacactgcatgtggtggccaccatatctccttccacaccgccccctccaccgcttgcggtggtcgctcccctggcctcttcctatcggatccatgagcgaggagggagagaggggagtagagcaccgccaccattgttccctccatgcgtgttgcctccgctgttgcatgcagtggccgtcactccacctcctccaggcagatctaggagtggggaaggagggagaggaggggagtatcgcctccacaccaccgccctcccctcctccggtcggatctaggagggccacacagcctgctgagaggggtggagggtgaggtgagggagatgggatgagcgatgggaggggagaggacttggtgaaaattaggctaggtagctaggtgatgatttttatgaggtatgaccttttcacaggcagacatattaagacctcgcctgtgaaaatcgattttcacaagtgggactaggtttatggtatctttaggtatttttatgaacattgattttatggtcgcttggaaaaataaatcgtaatgtttggaaaaatcgtttttctattagtgcatgatgcgttagctcatctcaattttaatgcacaataattattttatttaagtacctagctaaatggcagctactaattaacattcatatatacctaccggcttggtggactacgtgagaatgctattctagttttttctggcatttgtcgtaatggaaaatgtctaatatatgatcatcggattgagcagtcgcctaattgcgaaaagcgcgtgacttctccatcaatagcatgcagcctgcctactgtcatgattgatgaatatttgttcctcttcttgctcatcattattgtgtcgtttgcgtatttagaaacaacaattgttgcagtaaaatacaaatgtattggtgctgtgtggattgggaactggcagatctagtgatgcaagcaactaattagagacggaaaggtagagggaggacgagagaaacacatacctctacggctttacatcatgtcattgcgagaaaatatataaaccatgcttggtatggtcagttggagatctatccaacggctaacgcaatccacaactaagtaaccagtaacagagctctgctacggttactctagctagctaaggttgtattctttgtcctgggttcccaaccactctccctctttttcacgcacgcacttttcaaactgataaacgatacgttttttaaaaaaaaaaattctatacgaaaattacttaaaaaactcaaattaatctattttttttaaaaaaatctaatacttaattaatcacgcgctaatagactaatctgttttccgtgcggagaagatgggttcccaaccccattagcgaacacagacttagaggatccattttcccttatgctgatcaatgactatttttatttaccaatatattgattttttttcacattgcatttttttctttttttttctttcttatcgttagtccataaagaaacgcaatattcggaagaacgtgcaaaaatctttcttgtttgtattacaaactaactatggtagcccggcatgcaacgtgttatagctagctattgggagaagcgaccttgcgaccatctaattccaacagtacgtaggagaattgcttcaaaacatttgcatgtcttcatgtgccgacaaaacaaaaccagaccaactgagccagagaaaacacaaaaaggttccactaagaatagcgattggtaaattaacccaagcacatactgattgacagaatctaacacggcaacaacgacgtttgtctttttctttctcccctttattcctggtagacaataatcgcaaagaggaaattttaactgctcggccatgaatattcatacccggccataccctacgcgaagtggcggcatgcgcccctccgctccggcccatacacggttacgtaggaccagccaaattaatcgatccgcctttgtaaccgacccaaccgtagcagccatcccacatggctcgtcgtcactcctcactgccactggagctctttttcggcaagttggcgccaccacaacttgacgcacttggcatctgtttgccctcgtctctcggatcggacccacaatcacagtcggagttccatgtcccttcgctctcaaactagacgagctctctacagcatcgacgaccgaaaaagaaacagctataccgcacagcaccggccttaattcgacgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60765 - DNA, 1269 bp, Oryza sativa
tgttccgcctgtgtagccaaccttcgtactggataaccatgggtgtaagtctactcttcttttacgatacaatcgtcgtaaatcatgatttattactgcagcctaaccttacgcttcctcaaaccatctggtgaaaccatcttcttgcagctgattgttgcggtaggaatgggcccggtgctggctttgagatacttcaggaacatgtttcgacctaatgccatcaacatacttcagcaaatcgagcaatccaatggacatacccataccaccagaaatatggagtcacggatcatatctgctggcagttatctcacccatttactagccgattcgcgtcgcaacaggggcgctacctatcagcctcttctttcagattctgtagcatctgacggatgatctgctgcacctatcagcatcagaccttggcagcttgcgttaactgtatctcttaccagtgcaatatgctagcatgcacacccatagtctctaacagcaataggatttactgatcacacaaaattctgagagtcaaagcacagaagaaagtttcgcaggttcattgcaaaaatgctgcaatgcctggaattcaggaaaaaaaatacatgtgttccaaattatcccagatgtatagttttgctgttaaaacagaagtatatatggctgttttggtttgatggcaattattgccctaccaattatttggtacttcgttcgtcccaaaatataaagcttctagtattcagaatttgtcctaaaatataacaacttctccatttacattctcttattaaccaataacaatctcgcaccatttaacttcacctagtttcttcctcaaccaattataacattatcctatttaattccatctactttcttaatacccgtgttcaagtttaaacttcttacaccaaaactatacaccaaatggttactagataaccatttggatcggatctaagttcgccaattctacagggttggggcaaatcaacccaagaaaacagctactgtgtcgaagcatgtccaaaatttggtgctactaaccttattccttgcattgcataccacattgtcaaaaaaaaaaaaaaacagagagaaaccaacatcatctgttatccaaattgtccaaattcatgtgttccaaattgtcccagttgttttttaagcgtactctattaatacaacatcagaattgtaaaaaaaaaaaaggaactaaaagccagccaaacgaaccaatccgaggcgtcttcgcgggatatgctc

SEQ ID NO: 60766 - DNA, 1744 bp, Oryza sativa
aacatggaactctatgatttcaggttatgttcaaaatgatcagtcttcagaagctctaaaactgtttgcggtcatgtgccgattgtctattgaatgcagtgcttcaacgtttcctgctctactgcatgcatgtgccacaattggtaccatcgagcaaggcaaaatggttcatgctctcctatgcaagactccatttgagtccaatggctatgttgggacagctctagttgatatgtattcaaaatgcggctgtgtgagcgatgcacgggctgcatttagttgcattatgtcacccaatgttgcttcttggacatcactcatcaatgggcttgcacaaaacggccattggatggaagctatagtacaatttgcaaggatgctgaagaacaatgttaaacccaatgagatcacctttttgggcatcctgatggctagtgctcgcgctggtttggttaacaaggggatgagatttttccactctatggaaagctatggagtagttccaactgtggagcattatacgtgtgcagttgatcttcttggtcgagctagacgtgtaagggaagcggagaagttcatctccaaaatgcctataccagcagatggtgtggtgtggggagcccttcttactgcctgttggtacacaatggacttggagatgggtgagaaagttgctgaaaagctgttctacatgggcacgaagcacatatctgcctatgtcgctatgtcaaacatctatgctaagctggggaaatgggaagatgttgtgaaggtaagaacaaggttgaggagtatcaatgcaaaaaaggagccagggtgtagttggattgaggtgaaggatatggttcatgtattccttgtggaagataggaatcatccagagagagaagagatctatctaatgctagaagatttagtttctaatatatcttactctgaaactgatgatgaaacacatggttattatctcgagcctgcatcattagacctccttacttcccagaaaaggctagctaaccaatagtcaataggcaagttgaatggaattaacatttatgtacatatttcattttgcaaggtattctgtacagatgtaacatctcttttggcacaacaattgttagctcattgaatggggcaatcttggaagaaagaacgtattttcgttgtttttttttcatattttcgttgtttcgttgtttttttttcatatttagacatatttcaccctaaacggttcacttgaaacgtttatgtgccagaatccacagtcatctcaatcgtttttaatgtcttgggatagaaatgattcatctttttagtggtttgtgcacaaagaacaaaatgaaattgttttcacacctaataggtgtagaagaatatccatatatggtatatgatggtgcaaacatgtgtcgttgaattattttgtagcttttttcttcaattcggacgatatgcaaaaagacaagtgttgtccagacttgaatttatatttgttttcggattctaccgatatagtttagctatgcatatttatagaatgatctaatatatattgatatttttttatcatacttctttgctatttagatgtgttaacgaccaaatttggtaaattatgcattggatttggggttaaggctgaagcagatttggaaggaaatcaataacagagacagagcaaaaatcggcttcgggactgcatcggctacggtgtgcatcggcagataccgaatcggac

SEQ ID NO: 60767 - DNA, 6342 bp, Oryza sativa
atagattttttttttaaaaaagaaaacattgtaggggaatcccccacagtaaatgaatttatataaagatcaaaagaataaatttacaataggcttaaccaatccgaaagaaaattcctatctcctagaggtaatctataaataaggatataaaggtccttcttaaagaaacccctccaagaagaaacagatggaatcacaccatcaaagataagcccatttctctgattccaaatatttcaaaccacatagagaattttttcaacaaagtgccaagaccgataagtttgttttgcttaaagcaacatttgctcaaaagcaagagatacatcccagactattccaaattgagcccaacactgagagctgaaaggacattggaagaaacgatgcatgaaggtttctctaattccataagaacacaaaacacaagttaaatcactgttcacaggtgcacaatgctttctatctagcatatctcgggtatttaatctgtcaattagaagcagccatcgaaaaaccttaactttcatagtgcatttacttttccagatccaattcagataaccaggagcttgaatatacataaaatggattgcatatacttttcaagaagagaaagaagagttttcccaaacataactccgtaagtctctatcatctgaaagttgacacaaaggatcattagctgacattaccaaatattcctgaaaagcctgttctgacgttggaagcatgaagagttgtgacagccccttagtagaactcataaaaacagattcctttgtatttttagcgaaagagtaagctcttggataaatgactgatctaatcttgttgttccacagatcatcccagaataagcaggattttccatcacccactttacatgaagaaatccctctaaaaatgtctgcaaactacatcacatccctccaccaaaaagagcctctctgggaaacgtcatgaggtactttatcaatatagtaagaaaaccaaaccagcttaacccatggaacagggtgcttattatagaatttatgcagatttttcattaacaaagcattgttctgaagcctgagatcaattacccctaacctcctcttttctttggctgacaaaccgtctctcaaagtaccaaagaatttttagtagagtttatatgagagcctctccataagcaatgccttctagctcccatgaaattccatgtatgtacataaaattttatgggttgactgtgatatatttcttatatagaaaagtataggcatacgaatcttaatttgtttgtttagttataaatagagcaatagttatattagaaatcaaatgtgtagcatgtagcttaatcatttcaaaattataattattaattatttctcttttcgctggatagctaaataatatgaatggggagaggaatgaagagcgccagttcaagctagtgggaggagcagacagtgatacgcatgtgaggggacggggagggggagatgaagaatccttattttctttgagatatatgtattgggttcataggtggaggcgaaagtagatggaattgtttgcaaatgaatgtggtgttcaataattgttaatactatttggtgagaaaaggcataatacggtttaagtgtgataaattgttaattaaaatattgttaatatgtgatgtaataattttttcttttattatagataagatagatgtgctatgttttaaataaccatattgatcgtttgtttttctcgatgataggtgcctatgtacgtacgtgccctctttttttttatctactgtgtgtttgcttttttcttttttgcattttcttctcctgggatatgtacgtacataagtttttcttccttttttctggtgaatgtgtacatatttaattatactagcataatacacgtgcgttgcaacggattctaaataatattcattgacataaattaaaatccaaaaccatatattatagttgggcataaatgatgaaggaaatataaacgtataaataacaacatcaaactacaaataactttgttgggaatgataattcaatattaggaaaattatatgacttaatcctattttcaaatttagctataaataatttaatatagagaaaactataagttacaataatttttagtggatcaaatagtgctaaatctaataatgtaaatgaaaaaacaacttaaattagttagaaattgaaaaaaacttcttttagcccacgtatgaaaatctgattcattaattctgaacgggtgcttgtttcattgatataaattagaatttttcatgttctattcatactccatttgtcttaatattatgtgagtagtctaggatcatggttggatagactaagaaagaataatgcccaacataagctgttcattgttttccctagctcaaggcgagaaacaaaagaggagggaagatgggtgtcggtgctccggcgaccaaacgatggtaaggaaagtggtaggatgtatcccacgatgtgactcgttcataaacggtggaggttggcaatgaagaaaccagaacaagagggatgcaggggggcaaagagggagaaacgacaacgacgagctctagtggtgaacacaactggatgagtgtgtcaaaactagttcccggacgagaggattctgttttccttgaacacgcaggagaaaccaagtaatattatttatcgtcttccctaaccaacacaataaacaaaagagaagagaagaagggcaacggtgctccaacgaccaaacggcggtgagtatggtggtcgagtgtgttccacaatatgactcatccaaagatagtggtggttggcaacgaagaaaaccagaacaatgggcatgaggtagtcaacaacatggtcccgatagagagaaacaacaacggtgatctcttgtggtgaacatgactgagtgagtatgtcaaaacatgtttccaaacgaggaggttccgtttttcttgaatgcgcaagagagagggaatgaaggggatgttggtgatccttaaatgataatatttgaccgtcaatacctgcagataatgaaataaaatgtggtatccaactagtggtagggattattactaatcaattccactagtgttggtgaaatatgtgtatgcaggtattttaaggagaaaacacacccggcatacaaggaaacacacctctggccaatcagacacaagcacacggattggagggcccacaagtcaggtgaaactgccatggaacaagacataactgccataaccaccatcagggcccaccaatcagtgaccccgccaaaggagaggccaggaggtggggcccacggttcggccgaaccaccacaaactcccctcatcctggccttccacgtgtacattcctgacgaagtcccaatgatggttgagggcattttggacatttcccatagctataaccgttatatagaggctataaatagagctcctctccctcacttcaagacacacaactttgagctgaattacaagaggctctattgtatcttttgtacattagaaatagatggagagtgaggggaagctccgggggagtacccaaatacccatgcattgcaacggattactgagatagtaaaattaagtccttgttgaacaaatatatttttaattggttgaaacaagacctttcatcctaaaaacaaacaatatgccatgcctagaaaattaaagagctgagtctacaaagtacaaattcacccaaatcctaatatcattgcccacatgtcaatcatgtggcggggggcaaactcaccaacagcactactatcttttaataagtgctataaatatgatttctaatgtattggatttactatctcaattggcaaatagttggcagggaaactattcatctttcaattttggacacctatcagtttcgcataataaattataaatacttaaaaagtggccacattatcaaagtatgttgcatcctagatataagaatcaaactatcattcatcataaagtaaccattcaaaaaatattgagggtccaagaaaaataataaaagtcaatagtgccaaatatgtgtaacatgagggaggtagtactagttgtctgtcctagcactgctctaccaccggccttcttgaaccatgatctttagagctaataaaaaatgactgacatttgacacaacacatataatcataaatgtaattaataaaaagaagatatttcaacaatggcaaatttccaccagcagctgcactatgaatagctctagaatcacacgacatgtctgtcacctcagtttttgatagtaagccctcttatccactgaaacagcaacctttgcaaagtgaccaccaatagaatcactaatccaatatacatacctgtaaaagagggaaggctgcacatgtaggcattattaaggagctcatttactagggatgggtctgcaaacaaaggataaaatttagtctgcaaatatacccgttgtaatctaagtactgaagataagcaatttcaggtttaatcaaacttacagcagtttcataacccattattttaaccaaccatttcagcgtaagagaatttttcaaaaaaatttgacatcttcctgaaattgatagacattcctcgtatcccacatcttactatttgttgtgttccactgaatttagaatgataataataaggctaaaatggtcttttcatttgaaaattttctcctgattctcgtttggatttgagacttcgttcgaacaaaattttgaaacgtaacaagcaccttgtcgagttccttgggattctcccacttgtgtccctcggcgagcaccttcttgaaaatgtcgccgtacttgcagatgtccttgacactagcctaggaaagcagctcgacgtcaaaccgcagcatggcgttgggcgggatcgccggcggcgggccgacctcaccgaaggccagctccgttttcggaggaattggcggcttgcttgccgacgacggagatggcttttctgctgacattgttgtcacttgccgtttcccactgggcatgccaaaagcgtgttgatgcgaaaaacacacactggcctggaagatctgcttaacttcaatgcaggtccaaaatcttgcctttaggttcgtgagcgtgccagttgatttgatcctgcaatcaacaagaaataaagacaaaagaaacctcgggtaaattcataaacgatagctgatcggccagtcgtcgatgacatatcatttatcttcaagccgatgtcatatgtgaatcgatcggcagctataaataagcaagataagactaaatctactcgatcggctgtagatattaacgctatataatccttctgtcgatgtatatttaaaccaagtgattgggatagatcagacgccatgccgagacagtataaatcacttagattgaaatatatattaacataaagattataaacacttatagcatagccgatcagatatatctaacatgtatcggctagtactccgataccactctgcgttaagatattaaaacagaaaatatatcaaacagaagcctaatatactttattacgataagatcttaatataaagggcagatttagcatatcaatcaaacatataagacatgaagctaaatcaggtaagatcggctgaaaccctgatactaactctctcgatgatcataaaacaagccagatatcataattataaataccacttaatagatcgaactcaatcgatgtagcattaagcataaagacaagtatgagatctaagcaagatgatgaaaatctataagagatggtagatacatgatacaatctagattaataacaaaaacataattctaccgattgtttcctaacgataagaaccagtcaataacaagttatatagcgtaactagcatagattgcaacatgtatatgataactcgacggattacataaaccaggttaaagtaccataaagatggaagcattaaccctgagaacgcaagccgccataacaagttttacctctagttgaagatcgaatcgatgcagctcaacccgaaagcaagaactcgtcaaaataaacgaaagtaaaaagggtggctatgcgccaagattgtattgaacgattattaattgatttcttgggttctggtcatatttatacccaagatacaaaatatgtccttgccggacacgacacttaactctaacaaactctaagataccataagtctttgcggcagatttttgcccaaacatatctctaaggaaattacatgaaatatcctaattaatagatacaattgccttatccgaaagctt

SEQ ID NO: 60768 - DNA, 5629 bp, Oryza sativa
agatccggtcgcctgtcaccaacgcatgccgccgaatctgcaaaggaggggaggagagccgccggatcgtcacggggagggaagggagggagtgcgcgccgccgcgcgtcgccggatcagccgccccctcccccggatctgcaaggggaataaggggagggggcgggcaccgccggatccgccgcctccaagcccccctccgccggatctgctaggggaaggaggggagggggcgtgcaccgccaccgctgtcgcccgtggcggccaccgccgcctgctctcctcccgccgccgtgcgccgtgctgtcgctgtggaggggagagagaggcagggagagagaggagaggagaggagaggagtagagtgggagagtggttggtggagcgggcggtgggaggtgggttaaatggtgggcccgtgcggggtgtgcggttggcttaggacgcccgcacgggaaaatcaattttcccgtgcgggcgacaccccaccgccagttctctatttttctatgcggttccacttacgaaccacatggaaacaaaaaggggggcgtccaggaaaatcaatcgtttagtagtggttaattagcctttattgggaagtaaggaagtctaatgatgcaggctcgagacaataaccatgtgtttcttcatcaggttcagaatacaaagatatattagaaactaaatcttctagcattaggtacatctcttctctctctggatgattcctatcttccacaaggaaaggaatacatgaacaatatccttcacctcaatccaactacaccctggctccttttttgcattgatactcaatcttgttcttgtttacacttaaatttggcacctgtggacgaaataggggaaaattgccaaagtttgaaaagtgacggatttccttcatagggacggtcagaccacaggtgtgtgggcggtttgaccggctaatagggccggtctgaccgcaggtatgtgggcagtcagaccgtcagggtccgagtccgagtctgttttcgtcgggtctcggatttccttactcgggaaggcatgtttcgtgtttcctttagtttctatctcgagttggacgtggagaagggcctgtagagggtaagaccaacccctatttaagggacaaggcaggtttattgtaaaacccccgaatacaatctacttgaatcgttcttttactatgttttctattttaccctagttttagtccatctttgtcggtttgtgccgtaaaccgtccgccgccgctgcgagagtgtgacacctctttgtaggtttgtcctgaaaaccttccgttttacccacgagacgggtaattatcctcatatcgatctaaatcagcatagaggctgattttgatctctaaatcggctccgctagccggtttatcttttctttttacaaaacccatcttgatttggccctttggcttgatcgaggtggttggcgactccatatcaccgcaaggcgtttaggtgttgcgatcgtacttgtcgacttgtcaaaaaagttgccaacacaatttttggcgactccactagggaacgatctaatcggcatatcagggccgaatttcgtttaatctaataattactgttcatcaaatcaggagtttcggctaaatagctgaaatcaatctacactgtaattgctatcgctacgcactggttcttttcgccgaattaatccgttcggcggcgaagttaattatctggtcgtcactgaatccatctgaatacttgccgtccagcacgccgcgtataccgaggatcatcgtcaggaggcagaagccggctcgacggcctcgtttctttgtgtttcatacggcaacagagaaaagatcaggctactagagccgatctaccgagcaacagcagcaagaacattgtttccttttattgctacacactgttaccgagaagaaataggaaacagagcagccgatcttatttcagatcggttaattttgtatagtttgctacagtaccgaagttactgttacgtccagaaaaatcaacaaaggctagttttaataaaattggctaaacacaataacatatcaagaccgtatattaatctattcggtcagcgatttcggctatgatctgtatgaccagatttaatcaagaaatttcttcattaactataacgagcgggaacgagctcaacaatgttactacacaatacattaggaccgatcaaggcgtcgtgaaaggaaacgtcccgctacctcaagttgtagtttcaccgaaggtaacctccgattcatccaacccatactttgctattcaaaaggttaatgatcattatgtagatgcatatgctatttctagttttgctcctatacaatatgcttataatgctatgggggggcgtcaatgggtgattatacagccgattacacaggaatcggctatatgcaaaacctagctaacggtatgaccggtcatgacactggtctaaccgcatcctatgccgttcagaccgtacctaccatagccggtcagaccgtccatagccggtcagaccgtgccctatttagccagatcggacctcctgtggccggtctgaccgcaccactgatcaccggtcagacagggccatgggccggtcagaccggtttcctgggagtttctccaggtttttataccacgactagcagtactgattttaattattattcatcacctgttaatactgttagtcatactattccacgtatccctaatgcctacaatgatattaataggggatatcctcccgatactaggtatggccaatataacaatattgtgccgcaacaaccaccttttaggccaccaagtccaccaccagatccaccaaagcctgaaactgcggaggattggtttagaaatactatcagagagaatttcgcaaagctaaggaatcgtgctagggagtaccaaaagccgtatcctgatttttatgatattaggcagcatatcctgtgcacacgggagtaaagctgcactcgtgtacacatgcgtccggatccgttcgatcgacatcctacggccaagtctcctagcgtggcaattttacgaatacacgcccgcctcctccacttctgttttgcataacagcccatctggtaccgcctcttcagctgatctcgttaatcacggcgctgatatgctacgcctcttcagctcctcttgtggttccatgcgcggcgcgccgccggcaaaatatttcatcgagacgaaggggatcgttgttttactctcagatgtcttctgttcatccgaatctggtgactacttcgaatcattctacaccatcaagagacgaatcattctactacttcgaacctgatgctacggtatttttagtttctctcattcatatcgtcatatacaggctagttagggatagctggtgctggcgtgcggctgctccaaattgcatacatcaagagacaagattagattgcactaattttcgttcagactagctacagatttccataacctgacaagtacactgtattgttgttacttctccgcttcccttacacgtctagctcgaccaacaagatcaaccgcacacatataatgctccacagtttgaactactccatagctttccactagtgaacgtgcacgtgcaaggcacgttttcgtaatatatattattgctgatcatatatatactgatacattattaaagaatcgtcatagacactggtaaaaataaaattattacattggtcattcatgaaataaacctaatttgttattttattacatagcaatggaatggaaaaaatgtacaggacaaaaatgtgaaccgattccatcacacatccaatcaataccattcaaaatcatagctagtcagttagtggccaagttcagtttgtggaagtccacatataaagattcaaagtgtagacctagaaggtgtattaatcagtgaccaactgctatagttacatcacaatatatcccagaaaggtactgtaaattataggacaacaagagattatatgaactgatgcaaacatattgctgcagaaacctcagctccctgtcggcatttccttagacaacaagagattatatgaacagtaaattgtaggcatttccttttttttttcctggggttgccatcatctccttgtctatggtgctttactttttgcaaaacctcagctcctcaagtgcacctgaaattgagaaaacatgtaatgttatactgtatcaagatgcaatgcagtagataaaatttagggacatctctcttatacagtcaaataaaatttaactggacaataaatctctaggatgtaccaggcgctagttgaagacccaaagttcatgacatagccgaaaaaatatactgtaacatgcagagataaagatatattaagaagatgataaatcccaatgctttcatggtagttttgcagtaagtatatatatagatacatacatattacagattgtgaagtatcccacctccacaagggtcatttacagtaagtttaataatcgtcagttataccatgttccatagtccataatataattgagttgtcaaactaatacataatatatactgtagatatgaccatgcatattaatgatagaaagcaaatagtctgaaacactaataaaggtcttcagataagttgaaatgatagcatgctagcatattgctggttaaaaatggctaggaatagagagcacaataaacatatcccaccatgatcaagcaccaacttcaatcagatcggtcaaccttgttttttcattattttacctcttgtgaaactctaggcactctgcgcacagcacgggcgcaggtggcggaggggcacagggctgccggcggcggcgcacggcgggctgggcgcaggtggcggcggggcaaggcacaggcgcaggcgacggctggtggcacaggagcggatttctttccctctcgttcccttcttcccaacctatccagaatattcttgaccgtttgctctcttttactgagcctcttttacacgctgcatccaacggcaggggctgaattttggttgcatccaacggctcatataaaacatatgacgtggcttaatattatttgagaaagcttgttgctttcacatatttagatatattgtccatcaagcaagctgctgacagcttgagagtaaggatgaatgacaacacacagctcatacaggagaactgagaaagcatcacctatagaaacaacaccatgcctgaaattgcacgttactcatcctcgctctggctacagttttttataagaaaaagtacgaatgacaccccccgaactatcgtgttcgtccgaattaccctcctgaaccacaaaaccggacattcttcacctcaaactatgcaaaccggatgaattacccccctcgacccaatccgcggtggttttggactacatggcgtacacgtggcagttcaatcagcattttatttataaaaaaaaagtgggacccacatgtcactctctctctcctatctctctctcacacacacactctctctcctctcggcaatggcggagtcagcaagcgcggggaggcgaggcgagccggcggcggcaaggcagtggaggaggctagcgg

SEQ ID NO: 60769 - DNA, 2469 bp, Oryza sativa
gcctccccgccgccgctcgcctcgcctcgcctccgcgctcgttgcctccgctgtcgcctcaccgccgccgctcgcctcacttccgcgctcgctgcctccgccgccgcctcgcctcggctccccgcactcgctgcctccgccattgccgagatgagagagagagaaagtgtgagagagatagaagagatagaagagagagagtatgacatgtgggtcccacattttttaaataaatagaatgctgactggactgccacgtgtacgccacgttgtccaaaaccaccacggattgggtcgaagggggtaattcgtccggtttgcatagttaggggtgaagtgtccggttttgtggttcaggggggtaattcggacgaccgcgatagttcagggaggtaattcgtactttttccttttttatatgaacctgacaggtggcattccactattcataactaagaggtcaacaacgtaaggcaacattgcaaagcaatactgtttaatgattcatacaggtctcctatgtaactacctgagccaaaactacaaaaaagaagggggcaagaatttttatctgggtcatgaaagaactggttcataatgacctataaaatcatataactctacacagatgctgtaaattcacaagcaaacaaataggcactgtgaaagatatttcgaaaaaaaaaaggtcaggaagaggcaccctacccttcatcaaacctcaaagcctcgagctacaataatcatattgccatccatccatgtacaatctgagcaaaagacagggcagtgaataagtgaacagtgtgacaaccaacaattgcacacaccatgttcaaatcaatccacaatgtagtaaaatacttttcagattattttttctcaaatacacatttcagattatgtatcataaaaatagtttcaatatagtaaaaggcataggtagtactgaggaggtttcatacatctaaaatattcacacatagatctaaaagaggtttgaattatcaaatagaaatcgccactcacaaccatcaacttgaaagtcccaactcctaaaagccaaaatctatagaattcaatattagttcgattgccaggtttctgaaattgtaatctctacttctgtcagtcagtcccagtaacaccaagttgaaaatgtattaatgaggcggcagtgaattaaaagcaagtccaagccaacagaacatcatgtatatagaagtgattccttgcgtaagttgaagtctacatgagcaatgaacaaatataattgatgtttgcatgactcagatattaagcaagataggggaattatggaagagttgagcaccttctttttctgttacaagaatttttcactcagacaaaattcttctttgataacacttttactgaacccagtccatatatatatatattttttgaccaaacagtagacacgttagatgtaaaatgacccaaatcggtcccccaaaaaaaagagcagtaccgctgcttcaagaacagccacattatctgtggctgtgataagagatctcgcttgagactgcggagatagcggccgtcggagtacagttggtcgtcgtcgcctcgtcgcccggctgcgatcctctgctggctggccgttaatgtggcggggtcgatggtatatgctgcggtgtgagcagaccccagctctctttcctctccgtcgcggcgcgagcagggaagcagggcagctccagcgggaggcggcggcggcaggctggaaaagctaacgcgcacgtacgcgttggcggcgagcgtttccgattgtttagcctaattaattaagtgattagtagataatgacggtaattaagatatgattttttttttccggaagatttttcatactaaccgattgaaaactttcaagttagatttgaaaacttttgaagtcaaattttaaaaactttcaaaactcaatttgaaaattttcaaatcaaaatttaaatgtgtaatacaaattttgaaaactttcaactcatatttaaaaactttcaactcatatttgaaaactttcaactcgagatttgaaaactttcaagtacagatttgaaaatttttaagttaagatttgaaaaaatatgaaaactttcaacttgagatttgaaaactttcgactcagattcgaaaactttcgactccaattcgaaaactttcgactcagatttgaaaactttcgactcgagatttgaaaactttcagcccaaattcaaaaactttcaactcgagatttgaatactttcaaatcggatttaaaaattttcaagttaagatttaaaaactttcaactcaaaacattttgaaaaaaataagtgtgctaaagattaaaaaaaagtaatcagaaaaaacgaaaaaaaaccggaaaaaaatcgcaaaagaaaaaggaaaaaacaaatcgcgaaaaaaaaagaaaaatgggctaatgggcccggaggcccg

SEQ ID NO: 60770 - DNA, 2748 bp, Oryza sativa
ggagttagcatcagaggcagcggtggcggcagcgcaggtggaaggaagcggcggagcgagcgggaacggggaggatagcaccgacgagcggcatggggaggcggagggaagaggcgcgcgacgtgaggagggcggcacaggcgtgaggagggcggcgcaggcggagggaagcgtccgagagagcggtggtttgtgggttttctcttttttttttctttttctttctcccagacgatgtgggttcggtttgtggagacgtgataaggagttggtccaggtggctgggtgggttggatccaggattgtaggattggaagattgcatgattgtggatgaacttgtactttttatattagtatagatggagtggaaaaatctcatccccttgctaaccaaaccaacgcgagcactagccatcagtaggcccactagctaatcagcgcaaacgccctacttctcgatctagcgcgcatttctggcccacttcgttgtgttttattctggcccaccagcgaggaagtgagaggaaacgctgattagcgcgtaaacgctaacgaccaatgcacacgtgacacgtgttaggtttagtctttttttctgtcgttacttttctttaggaaaacgctcatttttttcttccacgattatttaaattttgtcaccgcatgcatctttttttcgtgatattttataaattgatttttttcatcttcaatgtccattgaaagtttttaagatttgagttgaatttttgaattttgagatgaaagttttcaaatttgacttgaatgttttgaattttgagatgaaagtttcaaatctcgagttgaaagttttaaatctcgagataaaagttttcaaatctgagtagaaagttttaaatcttgagttgaaacttttcaaatctgggttaaaagttttcaaagttgagttgaaagttttcaaatctaacttgatagtttttaaatcaagatttgaaagttttaacatcagagttgaattttttaaaaaaaattaagttgaaaatattcaaatattgacttaaaaatttttaaatctaattttaaatctaaacttgaaagttttcaaattttagttgaaaaattttcaaatcgtaaataaatatgagttaaaagtttgtttcagacaaaagaaaataagaatgaaacttatgcatggcagttttttatcaaaaaaaatgagtgtgggttttcttatccaaaattaagcgctattagtcctgcgaaacgcgcggcgcctcgattcatgtcacgcacacgcgaggtaggaacccccaagagaaattaagatgattagtgttgatatcctcgccacgggaagctcactgatgtgatacgaaggaggttagtgccaatgacactgacactgtcaccgagaacctactcataagaaataatgtttacattttaacctttttgaaaaaaaaaatacgaatagatcctcggcaccagtgtcattggcaccgaccccttcactgaattagcttctataagaggtgagggtgtcagcgcccgcattattagtgcagagatattggacctccacgccaacatcaccatgagtaaaaaaagatttatttttagaataagtttttccagatgtgcatttataaactaagtttttataacaagtactaaaatgaataaaagtccagctgacccaggaccctgagaaaattgggctttgagatgggccttacttcctaaagcccgtggaaacctcaagcaggtccgtggcatttctctttttctttttctatttttataaataactagcaaaaatatccgtgcgttgcaacgggtgaaaagttctaatgataatatacatttttcatgcataatcatgtcaatgacaatgtttgtattttaacgagcgacttgtctttctataaacgattttttttcttgtgcgattttctcaaaccatttttaaaaaatggcgcatttctttctaacagatttttcctagcatgttctttttgtttttttactgacgacgaaaaccatatttttctcccttttttgcttttcttttctcgtgtgttttttgcatgttttttctgacaattattttctcgtgcgttttttgcttgtttttttcgaatgttcttttttgttttttccaatacaggagaatatatgacgaaataaaaaccgtgtaatagatgacaaaaaaaatggatggatcctatccagctcaagcgtccatcaatttagcgttttttcgacagatttttcagagcgatttgttttttaatagatgatgtttttttcttatacggttttttcaaaccattttttagaaatggtgcgttttttctgacagttttttcctcgcatgttttttttaaaaaaatttccgatgtttttttaaaaaaattctgatgaaataaaaccgtgtagtagatgacaaaaaatggatggatcctatccggctcaagcgtccatcaatttagctttttttttcttacagatttttcagagcgatttgtttttcaatagacgatgtttttttcttgcacggttttttcaaaccattttttagaaatggcgtgttttttctgacagttttttcctcgtatttttttaagtaatttttttaccgacgatggaaataattattgttgcgtgtttttttttatggaaaatggaaacctttttagcgtgtttttttgcgcttttttctaacttttctcacacgtttctttgaaccttttattgtcgtgca

SEQ ID NO: 60771 - DNA, 2839 bp, Oryza sativa
tttacccttggatgatcaaaaaattcatgaattacattattaaaaatataaaagcttctcgcatgagactattatagttatgagtttgttgtgcgatgcattatttatcccaaaaaaatatttttagataatgaaataaaaaaaatacgtatttattttttaaaaaaaaggtcataaaaatgaggagcattcatataaagataggtataccaatgttcacaacatttttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacattaaaatgatggaaaatgtaacggtaggggcatggaagggatcaaattgaaatttcaggggtatagaagggatcgggtaaattttagtggtataaaagggattgagtgagttttcaggggtacccagggaatttactctttttttttccctttcatatagcaaatcggtaggagtcggactttttttaaaaaaaatttcgctatttttttttgaccggacctggaatcggtagagtcggactttttttttatttttggatcggactcttttttcgcccagtttttttcccaaggttttttttagccagttttttttcgctcttttttttttatcggacgttttttttttctcccggtttttttctttttttgatcggactcttttttttcatccgggttttttccgcctggttttttacggatgataaaagcacctcttgtttttttaaaagtaagcagagattacggccagttggaccttcccttctggaaccatccacggccttccaaacccctcccgccaacccccgtcttctctctcgaaccatccgtccccaaaatccgccttctccactctccaccctcgtcctcgagcttcgtcgaacactctagaacctccataaatacccacctccaccacactattataacaacctcgcctcccttccctcgctcttcccaagtcacagctacgcacgcacgcacgcgcaccacgaaccagcacgcgcaccacccaatggcggacgacgcgtacgacgacctcccaatggccggcgcggaggaggaggtggacgacgtgatgaaggacgagctcgacgaggagggggactcctcctccccggtggcaatgaaggtcggggaggagaaggagatcgggaagcaggggctcaggaagaggctcctccacgaaggggaagggatgggatcgccccgaatccggcgacgaggtccaaggttagtaggcgcccaccatgcctgtgattcttcatcctcccgttgattcgaatcacacgaatccattcaagcacgcagagcgttgaataattcgaatttttttgtttgtttttgtttatttcagttcactacaccggcactctcctcgacggaaccaagttcgattccagccgcgatcgtggaacccccttcaaattcagcctcggccaaggtgcggatcggattcccaatttccccccacatttcgtcgcaatattcaccatagttgaattgaattgccgaatcgtactgaatttttttgaaaaatctgcaggggaggtgatcaaggggtgggatgagggtatcaagacgatgaagaagggggagcaggcggtgttcaccgttccgccggagctcgcctacggcgaggccggctcgccgccggcgatcccgcccaacgccacgctgcggttcgacgtcgagctgctctcctgggccagcgtcaaggacatctgcaaggacggcggaatcttcaagaaggtgctcgccgagggacacaagtgggagaatcccaaggacctcgacgaggtgctcggtacgtttcaaaattttgttcgaacgaaatctcaagtcgaaacgagaatcaggagaaaattttcaaatgagaagaccattttagcattattgtgatcattttaaattcagttcaacacagcaaatagtaacatatggggtatgatgaatttctatgaaattcaggaagatggcaagtttctgaaaatttcaaattggaagactattttagatttttgttcttctcattttaaagtccgtgaaacaaagtgagacagtaagataaggggcagaaggaatttctacaaaattaaagaaaaatataggcgaatttcgaaattgcatacactgattggtggtttggtaaattggtatccatcagtgaaaattctcttatactgaaatggttgctaaactttttttttgaaagaatggttgcaaaacttgttctctatttgcagtcaagtacgaagcgaggctcgaagacggaactgtggtatcgaaatctgacggtgttgagtttgctgtcaaagatggtttgtatcccctgcatcattgagcctctgcaattcagaatttaaccctgaaaaatgccatgtcactctccgatgaacataattctgtttatcttcaggctatttctgcccggcgctttcaaaggctgtcaagacgatgagaagggcgagaaggtcctctcactgtcaagccacaatgtgagtcaatcggagtcctcctttcaagagattttgcaactaatctatgtctttggtggtaatgttctgatgatcttggaaatggcattgttgagtgctgacatgcacttttctgatctgtagatggctttggtgagcaaggcaaa

SEQ ID NO: 60772 - DNA, 1163 bp, Oryza sativa
atacaaatacgcaaaccctatttctatgatagacaaatatttatccaaaaagaaaaaaaagaaaaaaaacaaacgtccatacgagaaactacgtttcgctagaaaaaaacatacatataactacatttatctctttttttatgtcgtccccatcaaaatagtgttaacatttagcacaaataattttaataaatttcatcgaatattaatccccacaaacatgaattggtgaattagatgtataatacacgaaaaaaataaaaatatatattaacttgtatgtttgcaaaggatcacagtttgagaaaaaaaaaattacgtggtcctcaccatcgaagctattagatttttcgaagtagagtccaatgatcaaccctgctaatttttaaaagagaaaattatatatataccactaaaatgtagtactatcgattaacaccacaaacaaactatgtatactctatataataaatcaactcaagacataaaaaaaatattttcatctaccttattttaaactgtctaccttattttaaattgttagatctgtatattaaaaaaacctactgatcgatcaggtcgtcagactgcgtatgtacagcacatgtatccagttccctcctcacggactaaacgaacccactggatctcgcctctttgttttccttacaacaattaagttaaccactgaataaaagatcctaaaaattaccccgaaaaaatatccaccataattttttaataaaattggtagactaattacttcataccattagacatctaacgactttctaccaacttaattatatttcccaacttgtataccaggtctatttaagctaaatcaatctataaggtacaaataaatccgtctatgaatgaagctcttttttattactatatatctccatcttataatggatcctaaaattttataccccctccatcccaaaatataacaacttttagcacttacggtacattaccaccaacattcatgtcccaaccaatcacaatcctccacctttcacttttctcacatacacttgatttctcaaaccaatataacatctccctattaattctacctactttcttaataattgtatccaactctaaaacttcttatattctgggacggagggagtagaaatcaaggagga

SEQ ID NO: 60773 - DNA, 1731 bp, Oryza sativa
ttagttatgtgaagtcgaacaaatgttttatatgccaacacgtaacacttatacaaatgcttctaaactttcacatgatggaaatgattttgttgttgtattccttatgtattatgcttatttttatcatatagattagtttcatatataaagagagacttaaatttcaagataatgataataaataatcgtgattggccagtgtagatgtaatcgggacaaagtgattttagtttaatatgagtgacattcaatatatcaaagtctataatctatttcatagtatagaatattatttttcaatttccctgattataacgtaatttattgtacttataacgaatacgatgaggaaggattacttttagcattgtttttacgatcaataaataacatgcccgcgcagatgcgcgggcttcgttcctagttattaaaatatataaaccgatgggccattcttgctgcactatgattttttatcagtcgtaccaactgaaatggcatggctagaaaggtttaaaactaaataatgttttcgaggatttattttaaaattttaaaatttttaagaaatataaaaaatcaaaggtaaccgttaagttatcagctttattgagccaagatcgaggaaccagagtggtaaataggttgagtttttgtaagaaaagataaaataaagtttaaattttgagtcaatggactgtatatgcgtgagctacgataacaaattttgttttaaacccattttgtggggaggcactatgattcgattatatatggttcttggatttttttttatgaaaggttgacaatattgatttgtacaactgcttggtctcttgtacaacatgacgctcgtaaattgcaaaactatctggtgctatatgcaactcaaactgatgtactgatctctgtttggaacgcatgccaggatactttatttctataacatttgataattaaattgtatatatatcattgtgaaaattgtatgttcctaattagtaaggccaacaaggacacattttctgcgaatttcgcattacacatgcatgaacgcagagcgctttatactgaaaaagaattaacaaatgcataataattaattgcagtgatacatatatcgctcgagcttttttactggaaaagaattaacaaatccatatatcacaaagtctcaacatatatagttgcacagttcgtgcatccatgatcatccatatctcggaatggagctaactagctagtaaccttatctagcaggaagacggcggatgctcgagccttcactactggtaatagaatcatggaagctcttacgaagccttgctaaatttttttttgataacatatatgcgtacggaggatatatatatattcagactactactatttcttcgtgaatctgtccctaattaaactagatatagctagcagcaggtgccgctgccatttccgccggacttggagccgacgagcatctccaccaccgtccgtaccacgccgccggcctccggcatcagccactcctccccaggcagcgtcctcgccgccgccgccagcacgccggagacatgcagcagcaccaccaccaccagcacaagcttcgtcatcgtcgtcgtcgccgccgccgccgccatcgccgttaattgctgtgtgtcgcgaaaaggggagacagatcgagatgaaaggttttcgctagctaagccgaaattaagcgctaagtgagat

SEQ ID NO: 60774 - DNA, 904 bp, Oryza sativa
tgcggtgacgcccccgccctcgccatcgagctcttcaagcggatggaccgatgggcctgcccccgccactctcctcccaccatccacacctacaacatcctcatcgactgctaccgccgcgtgcaccgccccgacctagggctcgccatcgtcggccgcttgctcaagaacggcctggggccggatgatttctcgtactcgctcatctacggtttcgttaaggatggggaggtggacaaagctcactgcttgttccttgagatgatggagcagggcgtattgccgaagatactgatttgtaactcaattatcaaagagctttgcaagatgaaggaaatggacaaggccgagagcattgtgcagaagatggtcgattcgggtattgcaccggacttgtttacttatagcttgattattgacgggctgtgcaagtcaaaggcaatggacaaggctgagagggttttggagcagatggttgaggctggtactcgacctaacagtataacatacaatagcttaatccatggatattccatttcggggatgtggaacgaatcggttagagtgttcaaacaaatgtcaagttgtggtgtcatcccgactgttgataattgcaactcattcattcacgctctcttcaaacacggtagaaccaacgaagcaaaatgtatttttgactcaatggttctgaagggccccaaacctgatattatctcctactctacgatgcttcatgggtatgctactgctactgacagttgtttggctgatgtgcataatatcttcaatttgatgctaactaaaggtattgcacccaacaaacatgttttcaacatactgattaatgcatatgctcgttgtgggatgatggataaggctatgcttatatttgaagacatgcaga

SEQ ID NO: 60775 - DNA, 1790 bp, Oryza sativa
atctcagactgatttttgctttcatttcactattttctatttctacagagatttctttcaacggttctaagttctattatgatttgttggatattttggagtttacttccgatcgcaaaagaatgtctgctgtggtaaaggatgtccagagtgggaagatccttcttctttctaaaggagctgatgaagctattcttcctcgttgccatcaaggtacatggtataacagggaaaactgcatcgtgtttatgtgatatcatgcatgtacacccctccagagtaattaatccatttcgcttgaatataaatacattcttaggtgtcattttctgaatttaattatctcgaggcaagagtaattatgcttgttctaactcgaaacctgtcttctggtagataaagatccctccagaattttaaatggaacagcttccttgttctgatactgatggaactaattaattaaacagaatatcgctcttaggaaatatatatatatatgagtaatgtcttagttctattcatactataaaaaattatagtccatataatcctgtgatgtaaggcagtaatgcatctttatgtggatcaacttatctattacaaacatgggatatacctattgcataccttgactagggaaaatattaccaaccttttaaatttgggcatcaaactaaattggaaaattcccaaactttttggaggcagtcatttatgtaatgtaccatcagatttcaagtctaaacatgatcagtactaatggacactaaaggtaagatgtgctgctaatttagttagcgtttttctccatatgtcacaggacagcaaattagaacctatcttgagacagtagaaatgtattctcagttgggcttgcgaacattatgtttgggatggcgtgaattagaagaagatgaatacaaagattggtccaaaacatttcaagatgctagctgctccttggagaacagggaggtaagttgttgagcctgaccttggctattatttattgtttaactattttctgtatcttttgttgttcacactgttatctcaccaactttaactactgtattcttagctaaatattgcaatgcttcatcatatgtagcgtaaaattgccgaagtatgtcaccgtttagagcaagatcttcaaattcttggtgttagtgccatagaagaccgtctccaggtattcacgaccttccatttttcttagaataagtagaattacttgttgcaattgttatcattgcattcttgcacctctaatagagtcttgtggctagcaggatggtgtgccggaaaccattaaattgctaaagagtgccggaatcaatgtgtggatgctaactggtgataagcaacacacagcaattcagattggacttctttgtaatctcatagcacctggtactgcattgtcactagaaatttgatatgcattaaaattgagcatgctgtataggctactactccattaaaatgcattatcctgtaaaacgacaactgtttcccgactttgcttgcatcatttgtttttaatggcactttttttgtttgggttgttatttattagttcttgtactcacctgttcaagaattagagcttcatctaggtggatatttaatcccttagtccattatcttctttttttttagtataaaatgatttcatttctactgtatggtgctcaagtgctggtctcttgggttacagctagaagagaccagggtacctgttctcttggatatgtcaaaatgattaataaaaatgttcatcttat

SEQ ID NO: 60776 - DNA, 3713 bp, Oryza sativa
attttctttttcctggagttaaatttcggtttctgatttgaacggtgcaaaagggcccacttaatagtcgtcctctgcatttttggttgaggtcactttgtgcatgttcttggtgattagcgtacgcgtgcagtcgattaattacgagtcatattttacctttatgcttagctgacgccgtggttcctgatttgttcttcatgctattcgtccatcggttggaccagactaattaatcaagatcaaacttgttatgattgactcggctaacgggctaagctcttgatccattctccattctactttatgaactctggtctctcttgaactttcagtctgcaacaaaaaacaactaaattttcgtgcttcacaagagtactttttcttgcaagtgcaatcagctacttccaaatgaaggttgtaaggaggcaatgacaaataatgtcaactaaattgtttatcgattaatctggttgatttcttgctggtcatagattaaaatgtcagtgcgtagaacagagatatgtcatatgtgtgcacttgactttatatttcttttgaacaaatattcatattctttggcttgaccagaacgtagctgcagtagaattcaaaacgctggcatccatataggctgtgtttagttcagcgcaaagtttggattttagttgaaattggagatgatgtgactgaaaagttgtatgtgtatgataggttaatgtgatggaaaagactgaagtttggatccaaactttggatctaatcacagccatatttcgcacgctcgagcaacttccgtgacatttcatacagtgacacactgacactaaataagcctagctacttgatgcacaagcagcaggaaataaccattcaatctcccaagtgcacgtacaagtctagcttgatgattcagagtttcaaaccaaaataacccacatacatgggaaagaccaatcccagattattaattgaaggaattattgctgtggaatcgtggattgtgtactcgatttaagtggtagatatttcagaaaataaactgaacaaacatctggtttaagcaatgtaatacaatattaaaaaaacttattttcctaagcatggagtaaataatatgtttcaataatcagacgaataatctgaaaaaaaacaagaccttaattctctggctgcaagaaaattaacaaactaggacatcagtacgaacttgaaatgtccagccagcattgatgaattcgtcttaatgtgttcattacacttgaatcatgcccaacagaagctgaaacctggcgttgaatgaagtgcttgctatactacttgtttggagctattttttaaagttttttaaacatttttaattcatctctaattaagtaaataatcatcgtcaatatataatctagtgaataatctgttttgaacggggtcttattagttagaggctgtgatcgagttagtgaaaatctgttaaccattttcttgtgtgtaacaacttcggacgcctagcttgttcgtttaatccccgagagagagggccagaatagagcggattgagaagatataattccacactataataggtgtgtaataaatcttctccaaatcctactcaatcccctttgtgggaggaattaaacgaataaggcgttaaggagatgtctcacgtttaagagattttcttttgaagctctcattgtggactgcataaaaacagatcgagaatgtttttttttaaaaaattgttgtttgttcaaatgaaataaaacactgttgcgtattatcagctttgcggatctagaaatttcttcgagcctagacaaacgcatggacaaatgattttaaacgttattgaatattagtatggtgatctgctagcgagccccagcttgcccgaggtggcctggccttggatatgatccaccctgactctagtttattacctttaaagagactagaaaaaatacccgtgcattgtaacgggtaaagtctattttagtttattattattatatgatttagttaaaataaaattcactgtgggagttcgcttgaatcgatatatatatatatacgcaaaaccaggtagttctatagtttgtgaagcatatacgcaagaaactatagagggaaggttgagaaccaaaacttgcgaagacagcctaagtgatgctgtagataggatctcttataatttaagatagaggtattacattttttgcttttgaaaagaattaacagtgcttaggactttttcttcgattaattaagaagtaaacatgcttgcactcaaaagaaaatagcgaattaatatgccccagtaatgcatactagcatgttaatatattgattatatatacaagacagaactaatcaaataggaggagtacattttcacattgacatatcacaatcaaactagtatacaacacattcctgccaagcatgttacaccatctgtcccataatttttcgggtcacatatgatgtaacatgcttagccccataacttttcgggtcacaatcaactagaatcaatcaatcaatctcggccactcaatcggtagccgggaaaaaggataactactaccttcattctaaaatatatacatacggttgaaatatgggtattaaaaaaataggtaaaattaaaaggaagaagattatgattggtcgagaagtttggtaataaaattgaatggtgaagagttgtgtttggttgagaagaaaatattggtagagaagttatatatattttagaacaaatcttgaatgctccaaattgttatatttcggaacggatggtaattaagcttagctctagctagaggagctagctagctagcagcaggtgcctcttccatttccgccggacttggagccgacgagcatctccaccaccgtccgtacaacgccaccgccatccgtcagcagccactcctccccgctcagactcctcgccgccgccgccagcacgctggagacatgcatcagcaccaccaccaccagcacaagcttcgccgtcgtcctcgccggcaccgccatcgtcgcccgccgtgttcttgtcggacagatggagagacagggaaaagatgtgtgtgctaattgcatggggagaggtagtatatatatagcccgggaagccgcgttaattttgaagtttgaagccgtcgcgtcttgtgcaacggcgggagagtcagtgtcagtgtgttaatttgaagtcagcaagtgcgtgtgtttatatgctataactttgctaagcaaattaaattaaacgcagttaattaattaattacgtgctatgggtatatatatatgtagtatcgtgtttatatatattaagcagttcctgatcgattcaatcagttcaattcgatttcatatgatgctgaccaagaagattgactgctgaaaggaaattctccccagacgagagttttaatttcggtttttagaccgatgaatttccggtcttcaatgaactagtgatagtattgactcggttgtttttcacttgacgccgtaaaatccttgcggccctgaagtttgatcaccaatatatttagatttatgtattttgtatcattagatttttattagaaataatgctattgtaatatcataatgttattattgtatctcaatcaccgcaaaaataaaaatatatattggtcaaagttatactgggtcaccacgaaaataaaaaaaaaatg

SEQ ID NO: 60777 - DNA, 1042 bp, Oryza sativa
cagcagcgctcccgtcacgccgccgctctcgtcgccgacggtgtcgcagccgccaaagatcaggaagctggactgggacgtcgaccccttctagcaccccttcttcgcggtctccgcgccggcgagcccgacccgcggccgccgccttgagcacccggacacgataccggagtgcgacgagtccgacgtctcgacggtggactccggccggtggttcagcttccagatggccaccacggcgctgacgtcccgcacctacaacctcgtcaacccggcctggtggattgggaaatttcagggtgaagtcttcgattcgagtccttcccgtgcatgcaagaaagggcgatgtgccgtgaggagatccctcagctttgagcatccatggggttcctcaaccttgtgggcaactccattgggtgctcggcttccggcgagcggctcgtctcggcggacagggacggcgacctgcaggaggcgcgcgcgctgctcgagtacaacccgcggctcgcctggtactccactttcggtggccgcaactcgccgctgcactacgccgccgcgcagggtcaccatgaggtgatgccatttgtctgccaaactagctgaagtatcagtgtttctgtatagatgggtaaaagaactgcaatactgcattcacattttctgttgcttgcatgttcagattgtttctctgttgctcgaatccgaagtcgagatcaacctcaggaattacaggggccaggtaaaccaagatttatggtacatttaattgtttaagtttcacttgcgaaattcgacaaggggagggtgatgccatgggagggcgagaggaggtggcgtggactggggcgaaggacggcggccgcacaggaggacatgtgtggagagggagatgacttgtggggccggatgtaggtggcgacgtaggtgtcggagtggccgtcgaacacggcgaagaggccgacctcgttgccgtcctttaggcggcgaaactcggcggcgacctcctcctctggccacctccgccgcccgcgccctgccg

SEQ ID NO: 60778 - DNA, 2949 bp, Oryza sativa
ggttgttgtaatcatggtgagttggtaaaagccaaggaattgatttctgaaatgatgaacaaggatattcctcctcgtggtgtcaagtatttcagttcaataataaacaacctgtgcaaagagggaagggtagcagaagggaaagatatcatggacatgatggtacaaacggggcaaaggcctaatgttgttacttttaattcattgatggagggatattgcttagttggtaatatggaggaggcatttgcattacttgatgctatggcatcaattggcattgaaccgaattgttacatatatggtacgcttgttgatggctattgtaaaaatggaaggattgatgatgcattgactgtattcagagacatgttgcacaagggagtcaagcctacaagtgttttatatagcatcattctccatgggttatttcaggccaggaggacaactgctgcaaagaaaatgttccatgagatgattgaaagtggaacaaccgtgagcattcacacatacggtgttgtgcttgggggactttgtagaaacaattgcaccgatgaagcaaatatgctgttggagaaattatttgctatgaatgtaaaatttgatattattactttcaatattgtgattagtgcaatgttcaaagttggcagaaggcaagaggctaaggaattgtttgatgcaatctctacttatgggttggtgccaaatatacaaacctacagcatgatgataacaaatcttataaaagaagagtcatacgaagaggctgacaatctctttatatcagtggagaagagtggccatgcttctgactctcgtcttcttaatcatatcgtcaggatgttactcaataaagctgaggttgccaaggctagtaattatctgtctataattggcgagaataacctcactcttgaagcttcaactatttctttactggcttctctcttctcaagggaaggtaaatatcgggagcatataaaattgctccctgcaaagtatcagttttttgagggagcctggcaagattaatacattgttgtatctgaaattgtttcaacatgttgcactctagagtttcttctgctcccacgggaaggaaaataacctgtcccccaaaattctggcattgattattttattgttgttgtcagtaatgtgttgtttgtgttgaaatcgtgagcttgtcaattgctctgcataccttttatctgttgttattgaatgagaagctagacagcggagttcaaaataaactgttgcatttttaatacgacaacttctgatgaaaaaggtagcacaggtaggtgtatgcattgtgaagatatttgtgaagataggaactaacttacctttatattcttatgttttagttgatgttattcttggcgatcttctgcttataagcgactacttgattacttttgcttgaaggatattatcttcatttcagcacaaaaggtcctttgaagactgaatattgtttattcttcgacaaatttccaacgacactttatcagtaggaggttgttgcataatggtcagatcagctatagtttcgtttggacaatactcgatcctcaaatgttcaactggctgatctggtgatcgcctttatttcagacagttcagagcagagaaagccatttcctatgtttcgtggctatctttctggaccctgattcaaaacaattacttttttcataagcatatctttggcagatacaatcctagctagctagtgaacttcgtgatatggatgggcttattacttttgatacattgaagtcgtgtggaagcaggatttttgaacacgctgataaaatttttcactatcagcagacaagatgaatgcccatcaagttatacttgcataaaggtgagatgagtaatgctatgttttcattcttctgatgaaaacttgctatgttaaaatttcaactgcttggtttctatatttatttaacgaagtattaaacatacaaaatatattggcaatgtagggactgccatttaaaggaggggtaatcactcggtaaaaatttaaaaacattctgctaacaagtttttatcattgtttgcatcttggttgcctcctgctccgtggtaaatgacctagtcttctcctgtaacagaaatggaaaattgagttgctgcatgcgatgaggttcagcgttgtgtttacgattcactcagggaaaggctggaggtagcgaagagggagattcgccattgagttgaagatggaagtgctttcccatgattgcggtaggtagaagaaattattttgcaggtagtgttggtgcttttgatgtcttatttttgcatatcgttcacatttttctccttcttaaattctcctgaaacttgttagagctgtgacattcatcatctacgttttcagttcaggcaatgttgcttactgcttagttaaggtataagaaattatcgaagccaacttatatggagtgtggacagtttcatcgttattttagaaaaaccaactaatagtttcatcatggtttggatattgtgcatgtaggtttagatgcaagaaacataagtactgcagacctgaaaatcgaagcgctgacaacatagctgcaataataatttctctaactggcttgggtttgaggtctgaattaatcagctggttttggtcacaaaatgtgacatgaatatttctgaacgttggtcaacttacaattacatctgtccaaggctcacattctgttctctctttcagaattgcacttgtgaccatataaatctgcatggatagggatcactacctgtttatgattctctttccctttttgtactgaaattttccagggatgattaagggcctgtttggcacagctccagctccagctccggccctcctggagctggagctcagccaaacagtttcagctccaccaaaactgggagtggagctgg

SEQ ID NO: 60779 - DNA, 6813 bp, Oryza sativa
cagcgccatgcaaaatggacggcgtctccggccggccgcctcccgcattgctcgtcgtcatcctcgccggccaccgcgtgtacaaacgtacgacgttccgctcctcccacgccgccgatcgctgtgttggaaatagtccccacattgattatttaggagaagttgaaagtgaggagagtggattttaagctttttttttctccaataaaaactggataaacttttagataaaagtggcatgctttttaaactgctaaacggtgcgtttcgtgtgaaaactttcaatatgaaagttgctataaaatataagattaatctattttccagtttgtaacaattaaaactcaattaatcacatgttattatcaccttgttttacgtgaaacacttaatttttatcttcatctttgtcttcaggaaatttaaacaccaccagaaattcaaacacttaatctttctctattaagctagcttttaggatacaacaagattattttttccggttagaccaacatatctcggttttgggtcaacttgctgcgcaatacagcagtgggattgatcatggctgttgctgaggctaatcgctgctgcgaccgcggcgaaactggccggccggcacagcattaaagagttagcttagcttcctccgatgggtgtagctaccggccggccgccgggaggtcccccatctgcctgccgccaaagccttttaattatgctcactgtttgagtgtgttggtttcgtatgcttgcacaattaaggctaaacatgaacccatcgatcggtcgttgccctcagcttctctctcatttttttcatggcagtcggctgtgttttttttacgggtttggaaacatttctcctcggcgcataaaacggaggatggattaacgcatgattgattaagtatttagttttaaaaacttttaaaaccgcaatgtttaggctgtgttcgagaggtaaggttgggaacctttcctcctaatacggaaaacgaagcatacgattatagtgagattaattaagtattagcttaaaaaactttagaaatagattaatatgatcttttaaaacaactttcacataaaaaaacttttgttaaaaatacaccgtttagtagtttgaacagcgtgcgcatgaaaaacgagggaagtgagttgggaaagaggaaaaaagaacacggcgttagcagttcggaaaacatacgcgcaaaaaagagagtaaaagtttaaaatgagaagaaaaagaacacatccttaagagcataaaatgttttataggtgagggttacctctacctttgtctacatcatctatttataaatttaaaactagcctacatcaatacacctctaatacactagtcccagtacatttttcaccagtctacttctctattctctttcaatctttaaagtttgtgtagatgttacccttatatgaggggtgatttgtcctctcttatcttctctcctacacatcaccatttaaacctacataacaccttgtgtctactattaagaagcttatagtactttctctaccaacaagatactccattcgtcctaaaatataaatatttctaaaaaattttttaaaaaaattaagcatgtatatgaaattataggttgaaagttatgattgatttgagaagagaagatagatgaagaaactaaatgagaaaatgttgtgattggttaagatggggtaagtggagaaaatgggacggaggactaagacattattggttttagatattacgtttgacaattcatttccattaaaaaaaattatattatcatttttattgtaacttgttttacactaatcatgctctagatgtgacttatcttttcgtatttgtgctaaatttttaataaaataaatagtcaaaatgttatgtctacaaatcagcagcatatcatacatttataaataatgggagtacatttataaataatgggagtacaaggaaagataatttattgttcaatgcaaccttccattaccttaaaaaaaatcatttgccatatgtacttccatctagaacactcctgcttctttttaccttcagcctggtcagagtgattttctatgtaacgtgatcagaggccaaactagctttgtccccccgccaatatttaacattttagttcaaataaaacaacccacccaccaaatccaaattattaagaatgcctcttccccctctaaaaacagcattcatcctcgggcaacatatgcaaattaattcgtgatttctatataattctttcgttatacccataactttgatttgatcatgcaagaacgtactgtgtgtcaataaaacaaatggcacgggggtagcttagagcattattggagtactcttatataggagttagtagtgagtgatatatctgttctaattaagctccttcatcttattgggttaagggtttttatttttggtaaactggtcactaaaatacactgatacagactagtcctaataattcataagcacattgatgatgcagaggaggccatatgtaggggcatgggcaaaagtgctttgacagtggcagagcagttaagaaagttaaagtctaggagaacttgtgaacgaatgctgaggcccaatcaggctgaagatcgatgtgtgttctgactttggctagtttctgcttcccctttgcagacagcttattaatcagatcccccacagtctcatagttgcatagggtcgctagtggtgggcttgatctgcctctgcctctggaaacaatggaggagtagatccgatgtgttttatggaacatgatcgattgatcatatatcaaaggcggcttggatatgggtgtgcaaggcaatcagagatcctgtactatggttcacgtatcagtggcacaattgcaaactatacaaaatgacaatcagataagccacatccacaaacgtaaggatggcgatttttcaagtgcggtcgtttagatgggccgctgatagaaatatatttttcaccggggatactttgaaagggccgtctgtttaaaaatcaatttcccttaacctattttgctgatgtattttcacattcttaaccagactatcccgacgtatttacatatatagacgtgcatgttttaatccgcctctaaaaatacaaagggtgtcactaaaattgattttttttaacagtgttggccactaatactagtaagtacatgctaatttatataagcacattgatgtagagagggaccataaacaaaaggggctttggcaacggagggttgcggcgtggactgtagcgtagcaacaaagttactaagtctaggccaaacttgtgaaagggcgaggcccaactaggctaaagattggcctttttgcttacgcgtttgttgtgttcctctttgtatttagcttaattagatcccatgcatatggttcaattgtcagcgatctcccaatagttgcgcagggttgctgctggtggctctgcctctgcgtcaggaaagagtggaaaagagaacatcgggacatgcaacttcactgaaaataaatatcaaatatggatatgtaaaataaaaaaactactaattaagttttaataatttcaaacttgaaaaatgttttatctgatattttaaagcatcttctatttatatataaagttttcgcataaaatacactatttaacaatttaaaaaacatgctaacggaaaccgatgtaagatctatacgttaaacagaacgaacaaggtattaaaaatgagtagatatgatgtgcaatgtacgagtgagaatcatataaagatgcgaagaaatgtgacagtgacctgcactaatagaaaaaacatttttgtgacgttgggtatttatttttgcaggcagacatgatctttggagctaaatggcaacctaaaaaatgcaaaccggggtaagctcgctgtccacttgtaaaaatctattttcacaggcggaccacttaagcggtccgcctgcaaaagtaccctttatttttgcaggcaaatctcttatgtgccccgtctacaaaaataaacttggaatataaatagaggcgacataggggagattttttctaagtcctctctctttctccctcactcctctcctgcgtccctcaccttcggcccttccccctcccctcccctcccctccccggcgtgctcccggcagcgggcggcggcgactcccggccccttcctcccagatctggctagagggggcagggggagggcggtggctggcagtgctcccctccctcgcgacatggcggcggcggcctccggcagctgggcggtggtggcggccgcatgcggaggcggcgtggaggcgggaggtcggcggcagtggcggcgtccccacctcccacatccggcagctcccctctcctccctctctctctccaaaaacactaaccgagagtggagggcagcggtgggtagggctagggcaccgaatttttttttacgcttaaaaatatttttgcaggcgggtggatttagctgcctgtaaaagtcattaattttcgcaggcgtttggttgcaggcggaggctatggacgcctgcaaaaatgtgttttagccgccagtaaaaacgtgttttctagtagtgctagaaggacattacataccatcaaagataatttagataagagtgagaataggatcgaggtgtgtttgtgaagactttgtttggttaatcccatcaaaagggaattaatttcatacctatctttcttagagattaactgaacaaggtctaatggaagatgatagatgatcaaaggcatatataaatactacgcctcatacatagatcttgagcaagggtgagagagaagtaactaaggacataacgctgatattaatgtcaatataaatactactccacatgcatagatgtcgttgtattagcaaaacaatgtacacagttatccggtttcataattggaggccaaactttagaccatgttaatagactggacatgtaaaagataaatataaccgccgcatacaatttttaacatttcatatccttttctctggttgattttcgactatggtgcgacatcaacactattgtagcaaaaccacaaacaacttaactcgatcaacattttaacttgcacagtgaataagagatactcaaattagagaccatagaaattatacataattattatcaaatcaacatgtatataagagtaaaccaggatacccttcaaagaaaccaaaagaaataaagaagaatgtccgtcgtgatttcaaaggaaaaagagagaggggaaggttgggtgcgatccttcacctctctttttaaaagaaagttcatcgctctccacgtgcacgcttcttaaactgataaactgtattttttttaaacaagaagttatatagaaaattattttgaaaatcatattaatttatttttatatctaaaataattatatctaattaattgtacgcaagtggctcatctcattttccttttatctactcgtttctccttgcgtcaatcacacacttacaaaaaaaaaacttgggggtatctgtggtttccattttacgttttacccactagaaagcgtattccaccgcgctgtccatccactgactcctatatatattttcttgcgcgttatttaccgtgctcgtgccggcatctcttcccacccaccaatacggttacttccctccccctttcctgacttataggaaaaagtcagttttactcccctcaagtatgaccctggagcaaataaccccctaacctttaatttggtttacttaaccccctagattcttaaaaccggatcactattcacctttctaatctaatacaaaccgctttgctgatgtggcacatggattaggtggttttgcttactaggttggatctaacgtggagaaagagaacctgggagattaatcacacgtcgtattctcctccatgcgttggactcttctccctcacaagtcctctcatcatctcctctctcccttccgacggcggagaatccaggtgatgatcgtctcagataggcggtgctgatccgtgagatcgcagccccgtggtgtgtccctccccctccctcccttcctccctccctcctccccactcgatcttggcatgctttaggtttagggttgttctagaaggggataataagtgcgtgtggcagttggttgatgaaatttttttggttgatttcgttggtggtagggcactactgagggttaggttgttgctatcccttgctgtttttttttcttgcgagctcattatccatcgtcagatgccggcgctcggcgtgtgcgtcttgaagccgtcgcgagcgatggcacatgcaccgcaggcatcatacctagtggaaatgctgaaatggagcaaatcattgccatcgacgatgtagcatgggtggcagccgacgcccggcgagggtggctcacttcataagttgttgttcatcagctatctcacttcatactgtataagggactgttttttggttgatttttattttatcttgggatgagttgtttaggatttggtagataattgctgcttgattaatgtttcattttttaagataagtttactgatgatctcattgttgccatgttaggtgtaatggataatttggatgtactttgtatccggtttcactttggtggggaatttgattatgatggatattctgtggtttataatggtggtcaaactgagatgtcatacatagagagggacaaggtggcattaaaagacagggggatccatggtctataaaaacaccccgcg

SEQ ID NO: 60780 - DNA, 3879 bp, Oryza sativa
atatgatcaacaaaaatacatgaatattgatcctcatgctgtttcgtttaccaatgtagggactgtaagtgcagttgaggaatttttgccacaaattgagcacaggatgtgcactagacacatctatgctaattggaggaagaagtatagggatcaagcattccagaagccattttggaagtgtgccaaggcatcttgtagaccatttttcaacttttgtagagccaagcttgcacagctaactcctgctggtgccaaggacatgatgagcactgaacctatgcactggagtagagcttggtttaggatagggtccaattgtgatagtgtagacaacaatatgtgtgagagcttcaataattggataattgacatcagggcacatccaatcatatctatgtttgagggcataaggaccaaggtttatgtcaggatacaacagaacaggagcaaagcaaaaggatggctaggtaggatatgtccaaatatcttgaagaagttgaacaagtacattgacttatctggaaactgtgaagccatttggaatggaaaagatggatttgaggtcactgataaggataagagatacacagttgaccttgagaagagaacatgttcctgtaggtattggcaattggcaggtattccttgtgcacatgctattactgcattatttgtgagctcaaagcaacctgaagattacatagcagattgctacagtgttgaggtgtataacaaaatatatgaccattgcatgatgccaatggagggtatgatgcagtggccaattactggtcatccaaagccaggaccaccaggttatgtcaagatgccaggaaggccacggaaagagaggaggagggatccattggaagcaaaaaaagggaagaagttatccaaaactggcactaaaggaagatgtagccagtgcaagcaaactacccataacattagaacatgtccgatgaaaggaaattcaggaaaaaagatatcagtacaagagagagcaagagaggcaagtaatttacatgctacatatataagtggttgagtattgacatatgtgattctgatctctacattgaatgcaggttcaggaatgtagcaggccgcagaaaaggtttaggccatctgtagctgcaggaacttcgcagcaaaaagttcatgtaagttgcaactacattgcagactatattccatcacaataaaggtgcccaaaatatatgatcttttttttcatgtaaggtgcagattgatttgccatcccagagcagcagcttgtcaataacaaagaagggacaaacgatgaaagttgcaagaacaaacacaacaaagaagtgaagatttggttgcatatggcgtgttgtttttatggaatactttacatatttttcaataaagtacttgtcaaatatttggtggaaatggtaggtgtaatgtaaggtagattgagttttaagttattgaatctggttagggtgaacaaattttggtattacctttcagtctaacttgttataaatagtctgaatgtcaactcgttaatttagcatgtaggctggtgtgcttccttgctcctgctaccttgctgctatcttccagtagtctcaaaactgacatatgaaaaatcctcacgtcatcactttccacgtcaagtgcaaatttccttgtagcctcatcacctggcaagtaaaacctggctacaagtgaaaattctccacgttggatccaacctagtaagcaaaaccacctaatccatgtgccacatcagcaaagcggtttgcattaaattagaaaggtgaatagtgatccggttttgggaacctagggggttaagtaaaccaaattaaaggttagggggttatttgctccagggtcatacttgaggggagtaaaacggactttttccttaatttaataattaattcggtcagttttccatgcacgcgcgcgtttgttggtgtgtgactgaaactccaaatcatctcttacagacagtcttcagagtttgaatagttcgtggcacacttcctgcaaatcctgcttgtgcatcaagtagcgcgtctctgtgtgtgtgttagcacttactaatatcccatttaacgagagtatgcttttcaaactactaatcataaataaaatactacttccgtcctaaaatattaggatttgattcattcttggaaaaacaattggacactaccatataattgattttttcatgcggttaaaatcgattttcgcagacgggccggtggcccgtctacacccaggtgtttgcgaaaattatatttttgtatgcgggtagagcaaccatcatgaaggcgcttaagcctctgattgcaaaaagaaaaaaatgctaaaattattttttctaaagccccaaaactctagctagattcacccagccggattcactgcctactattactgctggatccacccggccgagcccgcggtcgattcgccgcctcccatcgccgtggtcgcccaccgccccacccgccccatgccaccagtagatcccacgctcgacggttgctcaagagagagggagaggtagagactggatagaggccaggagtgggagggaagtgaggagagtggggagtgggagggttggatagggagtgggcaggagaagagaggaatggacttatgggaagaaagggaggaggggagaaagaagagtgggatatttttcgcatgcggacctcttaaaatatccacatgcgaaaataggtttacttttttatgcaggcttgttaacacacccgatttttgcaagaggtcatcggatcgtccttgggggagcaatttttatatatgggatagttatgatccgtctataatataaaggggtctcgttggtaaaatcaattttataatagtgacagaggtcaaatcacattctagagagcaacacacattttgtaacaaagaaagtataaaagtttgtttttttaaaaaaatagttttaagtttttttttttaaaaaaatagtttttaagtttgcaaaggttaatacttaattaatcatatactagtaataattcatctcgtttcacgtgacacgatcagctcaccagacgcagctgaatcgaacgcagctactactagtatcgtcagtgcgacttaactgctgtgcagttgagttactgacatatgggccatagtaaggtgggacccacatatcagtgactcaactgtatgtgcagttaagttagaggatctgcttccgtccctgtagatactgtgtaacaccctaaaaattagaccgacaaaaatctaaactccaaaaaattgggccttcaaaaactttttaaataaattgcatcatgccgattttattcgattagtttattggattttgatttcggagtttataaatcacgaataatggaataattaattaggaataaaccctaaaagtaaattgacagggtaaataattaaagtgcaatttaaaataagatttggggaggacagaaatgagtaaaatattattacgaccatatttgtatcaattaaatctaaatgtgatggaataagaattaactctaattaaattcaagaaaattatataaaaataaaatatgggtgctatcaatctagagtgaatttttcgattaaaataaacacaagtatatgtaaacgtcatttgtggaaaaattaggaattaaaggacaagatttataaagaataggttaaattaggctagcactgttcattgcactctaggtgctcgacgaggttccctagccctaaccctccttgccgcgcacgcccggccgcctcaagccccgcgccgccgtcgcgttgccgctaccacaccgcgccaacgtcgctgtcgctgcctcgcgccgtgcgccgccgctg

SEQ ID NO: 60781 - DNA, 4391 bp, Oryza sativa
ctcctatataggagcagagactagaggggggctgctgatcacgggcgtgcgcggccgcgcgaccagtcgcggatcagcgcccctgtagcgagagcatagttaagaataagatggagataaatttaaatgatattgattgatatgataataagtatgttaggattgcacttattttagaaaaaaatttagaattacacttatagtgagacttagcgggcagtatactcttaagatgaaataaaagctgcaattagtgcgctaacagcatcacgcgcgttcatcatcctagtcatcaaactcatcagaatattgcaacatttcaggagtttctatttattttttttccaaagacccaacatgtctttgaatttatttcaggattcctttttgcattgtcgttgccttggttgtatcgtcctatctacggtacattcaacacgcgccggtgcgccttttagtttcagaattccaccatgtttggcaggcatgattcaagtgcgtgatagctgaataatttaagacgaatcgttagcctcgtcaaatttctttcagcgagattttcgggtccgccttgtcagttctcacacgttctggtctactttggtctgaagtctgaacccctgagagtcagagacgctcctgctctttttcccaaagctcagcctcgtcaggccatagctgatagctgccatgaggtgagtgaataatctgattttatcttcaaaggtttagttgttcctctccttcaggtcatccatctaattattgttgttattttcataaaatctaattatagttagtagatgcaaattttacacttttacagcatttcagtgtcctctctcctcttcttgatgtacttggtgcgcaccggtaagcgccaatcccgctacccacgtaaatatcctctttatagttaatttcctacctagtataaaacttgaaagaaaaaacttttctttaaggaataaagaaagagagaaactaaaatttcgataagcgaaaaaaaaactccacttgtccatttcacttgcatccctaattaaccggtgtcaccaatcatcaaactagggactaacagcttatttataagattttcctttgcggggaagcttagttataagttttagtttaggggactaataattgcctacaaatttggtgccagttaccgatacaaaattaaagtcgcgttcagagaaggcaaagtttgatttgatgccacactagtcgatcaggcagtaggatcttttgactagtgaagggcctggaatgggtgctagtttgctcacttgggccaaaatataagagttttcctgggccgaaacggactactactcttcaactatgtcaatcaaatttcaaaatatgaaatccttaacaagtaaaaaacttctatttaatatgtgaaaatggtattagttaatctctatgaaaataacttaaatatttatttttggaaatatttttcatgaatgaatatataattagaaaatagtagatacagatcgatgccagaaattttcaagtatagaaataaccaatatacggtacataataatataatatttagtttgcaaaatattatgctacttatttttttctcttccgaaagcacaggattaatttgtgcgacacagtgcttaatgttgatccctgataatgacacatcatatgccagggtgacagcaattgatgactacttcgattaattctttctttccatggaccatgacatgctgaacatgacagtgcccttttcctttgacctgaacaccgaggcacgtaagttcgactactcttcgaccgtaaaattaacaaaataaaaaataaaaaataaaaaccgtcgcccaaaatattacggcgtcaagtaaaaccgagtcaatatcactactcaactattatattgaagaccgggcataattcatcggtccaaatccaaatttaaacccgtgtgggaggaaaaatattttttagcatgcagtcaatctcaacgtacgaattcttggtcagcatcaagagaaacgaatttgaacagaatccaggaatgaactgcttaatcaaaacctagcacgtaattaattagactgagtttatatgctgcataataataataataataataattaaatttaaacacgtacgcatttgctgacttcaaaacatttgcctccatttgcagaagactgatctgacagcttcaacctaagctcaaaccgcggccggccggctatatatacgtagctacctgcttcgtctcgccatgcaattgattaagctaattaacatctctcttagcgcttaattttagcttagcttagccgctttcatctcgatctgtctccccgtttgcgcgacacagcaattaacggcgatggcggcggcggcgacgacggtgacgaagcttgtgctggtggtggtgctgctgctgcatgtctccggcgtgctggcggcggcggcgaggacgctgcctggggaggagtggctgatgccggaggccggcgtcgtcgtacggacggtggtggagatgctggtcggctccaagtccaacggaagtggtggcggccattgctgctagctccgtcgttccaagatggaccatggtttgcacgagctgtgtgctaactggtcgaactgacgaattagcagatgatgcatgctactagcagcttgatacttctgtatatagatagtggagaacttgtgatgtctatatatatatatggatttgttagttaattctcaattcctttttgttacaaagatgaaatgacttcccccatgatatattatgggggatagacgtggggtcttacggctagcactacatgatatgggctagccgatctaggttaattcgggcctcactcccctcctaacaaattttgatataaaagttctcatatccggtgttttctttatatattattaattatactgttatttattaaggtactactccctctgttttatattcccttcgtcttataatataagggattttgagtttttacttacactgttgaaccactcgtcttattataaaatttgtgcaaatataaaaaacgaaaagttatgcttaaaatactttaggtaataaagtaagtaaaataaataaataataattccaaaattttttgaataagataaatagtcaaacagtgcaaacaaaaactcaaaatcccttatattatgggatggagggattaccaattaagctcactaaatgcatgtgtatatatgcgaaatacgcagaaaatgttattttcagccatattaattaggaacgcacaattttcggaacatgcaattcaattatcaaatgctttataaaaaagtgtcctgcatggtgtgcgttccaaacaaacctcgatacatcagtctgagtttgatcggttgcatagcaccagatagttttgcaatttatgagtgtgttatggtataattaagatcccagtttcagctgtacaattttagtagaatgtacaagcccaagcagctgtagaaatcatcatcaacctttaaaaaaaatccacgaaccgtatagaatcatatttcttctccacaaaatgggcttaaaaccaaatttgttatagtatagctcacgcatatcattgactcaaaatttaagctttaatcttaacttctttttttttttaaaaaaaaactcaacctgtttaccgagtgtggttcctatctgtactggctcggttgataacttaatgatttttttaaaagtaaattttaaaaataaatcctctgaaaaattattcagttctaaacctttttagccacggcattttaattggtataaccgataaaaaaagtcatagcatagcgagaacggtgcactaagaaagatccaaaggtctcttctggcaaacatcacaagatggtaggtagtcagccaagatcgagcctcactcctcttaataaacccctttcatgtttagcgttttttctgtatagtacgcattgaacgctttgtttcagtctctgttggacatgattcatgcatgattctttaatttaagtgtaacaacaaattaagaagaattatattcatcgatcctgcgggacttttcaagttcatcctgatctgcctacatatacatagcttcgtttaaacttctcaaagcgcgcgagagattaatttactaattaattcggtcagtttttccacgcacgcgtttgttggcgtgtgtctgaaactacaaaatcatctctgccttccgagttaggtttagctagctactcagtcttcagagtttgaatggttcatggcatgcacttcctgcataatcctgcttgtgcatcaagctagtaggctaattagctaagtaaagcgccagtgcgtcactgtaggaaaggtcacagaacttgtaattaag

SEQ ID NO: 60782 - DNA, 1838 bp, Oryza sativa
cttgcctgtgtggcaataattaagtttaatatatatacaattactttagtttcagtattgcctagagctaggagttggactttttgctactgggatagataaaattaagtaaaaaaataataatcttttttgtaccgaaagtgtgagcactaactgcggtggttagtctatgcagccagtagtaattttgaccgtaatgcatgtaagctactagtagtactcctaagttaagctcccagtggtccaagaggatataataataattgattagttaataatctgagaggctcttgctctgtacttaaactaatcaaaccggctaatcaattgcaaggtcctggtggtttaggtggtgcgcacgattattttagttgccccaattattgccacggtagtgatgccaccgccggtggtcaaatttgggttgaattttaaatttggttgataacttttcttacctttttaaaatttattgctgagtttttttctagatgattgtttattgtttttgttttgttaattagttagcaaataaatgtgaatgttgcggtgtgcagatcaccggcaaggctctcatgctggacgagatcatcaactatgtgcagtcgctgcagcgtcaggtcgaggtaccaatgcaagcatttgctttaatagtgtgctaaatgaacttgttttaatgacaataaatatgttggagaaaaatgttgttgtgttctccttctgtcgtcctagctagctcttatttgaagttatgtatgaaattaagcccaaaagctaaattttgacattggtgtgtctcacagtttttgtccatgaagttggcgaccatgaatcctcagctggactttgacagccattacatgccttccaaagatgtaagtatagcatctgaaaacacttttatctgatctagagagacagttgacacagagtactattacgatattgtccctcaatttgcaaatgttatattcgccgcactcggggtatcattttcagatgagccatatgccagtacccgcatacccgtcaagcgatccgaccaccaccaccgcgttctcctacaccggctcacccgccactgctgatccattcaccgtctacaactgctgggagctcgacctccacaccgctatgcaaatgggagccaccaccggactcagccaagacggtccaatcgcaacgatggcaccctctccctcgccattgccgcaccatcctcctcttcacggcttctacggtaagtgaaatcgaaccaccacatctccttacatccctaacaaattatacatgaatttttaaaaatactcaattttttttttaaaaaaagttcaaaaataagattattttttttactggactacagtagtggagtggtggtggtcatactactccagtacggtaggtttgtttgtccaagtttgttgagtttcgctgttggtggtaattgggcgcaggggggcagcagcagcaggggacgacagtaaaccacatgaaggccgagccataataaatgcggcgacctctccttctgtacatacgcccagccgccgtacgtgtactccgcttttctgctcccatcctgcagcatcagcatcaccagcagcagcaaacccaagctcacaatcattgccatcaaagaagaaagaagaggatgttgtgtgtgactgtgtgtgtggctttgatcatggctttggcttgatcctacaaaagccactatctttttttccgcttttctacccctctgccgtctgtcactgcaggtggggcccagctgcacagggaaggagaaggttttccaaggcttaactttttccagatgcagtgtcatattgttt

SEQ ID NO: 60783 - DNA, 1837 bp, Oryza sativa
gcacaatcgttccatcataaaaaatcactaatcagtgatttcctagataccgcgataaccgagcggttactaataaaacccgagtagattaggacgaattctgtaaaaatctgaatttttatttttttttatttagctgatttacagatcgatttctaaatacaactggttcgataagggagactgataaccacaacaatcaagcggctgtcgatcgtcgcattttgaattatacaactatagctgacaccacaacatcgcactttcaattatacaactggatttgtgtgtggtgatccggcgtggcaaaaagattcctcaactcgtagcacattctttctgcttaatcctaggaaatcaaccagtaatctaagctaaaatcaatgtaccaaagtgggtactagccatgcagccagtggcaatgttcccttgcatttctttttcgattacacgataagcacacacattacagtatactcacacacccgtgaagcgtgaatgtgcccccctaacacatgctccagcgagacatatatctgatcccgtattacaatcctgttaaaagttcacctatacatgtataatattcgtagtcactacgatttaaactctagtgagtgaagccatgcacccacgattccaccaccgcacagccaatgcttcctcggttcccttgcatattgtcaccgctcaaatcactcaccaagatcgaagtgctttatttgtactacaaaattaacggtgtgtttagttcacgttaaaattggaagtttggttgaaattagaacgatgtgacggaaaagttgaaagtttatgtgtgtaggaaagttttgatgtgatggaaaagttgaaagtttgaaaaagaaaagtttggaactaaacacgatgtaaaggcatgtttttcctctctacaaaagtatatgtggtgaaaaagaagaacaaaagaaagaaagaaaggaagaaaggtgaaaagaaggttggatgtcctctctcaccggcctacatatgttgttgctgttgtttgtttctgtgtagcgtgtgctttccatcataccctgccaactggcttatgcatcgtctgctctcttcttttctgacgtcgacccatgctcaaagccatcgattgcatatgtgtgtacgtactgatgacaattgacactgcagtagttgtgatgtgcgggacctcaattttaaatcacgtgatccaaattcaaacgcgtctttgtgcggtggtttcttttgcgacattgttaacctcggatttcgacaacagatcgagcatcaatagatggatacgtcaaagtgaaagatgttgagttagaaatcaaagtataaattatgtattatttccctagagtacaagtttgaaaaacacgccgtcatcgcttcgcttattttgattataagttgtactccctccgtccctaatataagagattttgagttttttttgtttgaactctttcaccactcgtctgattcaaaaaatttgtgcaaatattaaaaacgaaaagttgtgcttaaagtactttaaataataaattaagtcaaaaaaataaataataattccaaaaaaattgaacaagacgagtggtcaaacagttcaaataaaaactaaaaatcccttaggtagtgtttggttgcaaggatgggatgggatgggatgggatgaacccacttttagaggtgtttggttgagaggtgagtgggatgggatggtccctggagaggaatattcctctcagatccgggatgagatggtccgccaaaatcggacggaccaatccatcccacttcgacggacaaaacggggtcaactcccgcacgcagcctcccc

SEQ ID NO: 60784 - DNA, 3659 bp, Oryza sativa
taacagtgtctaatatggaggagagagtgaagcaaatgcgcataaacagctcacaagagtgaaaatggctcagacacggctctaacacatttgttttcatttttctttaatcggaaatgaaaactggaaaggaatttcactataaaaaatcatctttgtaggtgcccctttttatttttagaggcggtctaaaaagtctcgcttgtgaaaatgtatggagaggtccctgatcaaggcccacctggtagttttcggtcgaacgcataaaaaaaagagggcagtcttttacaccgtcaccaacaaaaatcgattttagcttgcccactgctaaaatagattttcgctaacggtttgctgcccgcatgtaaaaatacattattttcaccgacttgaagtcacaggcattgctggccacttgtaaaatcatgttttgctcattcgtgattggctttttctaagtagtgattaattgtccaatagaggtacagatcgagtgaatatgagcggaagggacatgtactgattcttcattttgtactccatattttaatgtaatgacaccgttgactttttgtctaacgtttgatcattcgtcttattaaaaaaattatgtaattatcatttattttattgtgacttgattcatcatcaaatgttttttaagcacgacataaatattttcatatttacacaaaaaatttgaataaaacgaatggtcaaatgttgataaaaagtcaatggcgtcatacaaaatatgagaggaagggacaaacattgactctcaactaaaggattgtagtacaataggcatctatggtaagaatccatgggccatttgagaagggaatacttttaggtgaattatattgtaggacaattcggttgcgggaaataaatattgaggtcgtttagcttaaacgaaggagatacgtataacgtgtccatcagtaatgctcctctgtaacaactgagtataagacttttgcaggaattagttcaccttccacataaattctccattcaaaggagacattactccctcggttctatacagatgttttgagttatcataagtcaattatttttaagtttaattaaatttataaaaaatatagtaatattattaataaaaaagtactccattagttctaaaatgaagttatttctaccactggagtattatgctaaaatagagctatttttcacctatcctctcatatcaactaatcagaatcattttttatttaattttattacatattttctcttctcaaccaatcacagtctttcccaaatcatttacatctactttcttatattattcatacccaactctataactgtttacattctggacttgtaaaatatacagaatttctaaatggccattgacaacaaaattgggatcaaaatctttcaaatttttaacctcaggacatgtgtcatgattcatactccagcgaccccttctgtgtccctggcgaagttccagcaatcagaaacggcacaatgagttagggtttaagatcttggtttagggttgggttgggggaaagggaaaggggagggggggtcaagaggcttagagggatggccgtgggaggcggcaacccgttgtagtgggggacatgagcaggcgggtttagtgctgcagtaaaccgaagtttgtagttaggaggtgacagtcggtgatggcggatcggtagtggggagcccaaaaggagataagatggcgggccatgagcacttgctgtcatcacctgcttaggaaagagaagtgcgagggaaggaggctagccatgggtgcatcgctgacgccattgacaactttaggccagctggcgaggctatgcggcggcgcaggcatcgcacgctaggaacgacgagagaggagaggagatgggtcacagctagaagtgtagtgcacgaatctcaaagcgataaaatggtccaaaatttacaagattcagcttttctatcaaaataccatatagtcattccctaaaatatactatatttaatgatgaagttgatgggattaattttgtgttacagatgttggtatgtttttttttgtaagttgcacattggtctacctatggttaccaaggtttcaccttggagaaccccctcaacaaagttttcgcttgggctagatataattaccttttgttgccctttggatcacatgtgcccttcatctcccactttttctttttcccatgcaaatctctggttgacggacaatatcttgactgatcctaacttggtgttggaggtatgtgcatcccatctcaatgaaggtgagggtgaggtaacaggatctgctcatcagtgggagtatatagaagccacggtggaagtcttccgccagcgacctctatggaggttcttcaggcttctagatgtaactagccaacccctgtgctccacccatggtttcaatgtagaatcaaattggtgttggggaatgttagggatgagaaaaactagagtgaaaaagagaaggatgaagaagtaggggtagcccaaattgcgaaagataaagtaactttagctagcccaaattaaaacctcgttaaagggataattcaagatgaaacattataatgtgaaatttactctttttctctataaacgttatctatctatctatctattatcttctattatatactaaaagtccattaaacttcctacaaacgctcctaagtcgccatgtgaaatcttataaacgctcctaagccgccacatggcactctaaaaaataaccgttgattttcattaaatttggttgacccattatttataaccattagatttattttttttttaaaaaaaaatcatatcctaaactcggccccaacaggcattacatacgtgcgttgtaagttacgtacgtattccccccttccttcgattccctatttctattttctattaattatttctcctatttttatgctttatttgttaaaaaaattaagtaactacgatatgtaaatcatataattgtttttttatccatcgatatcttttgattgtttacgaccaaattcacggttaaagactaaatttcactataattaaaagttgaaaagaaatatgttacatttcagctatattttttgacttttgcatgcatttcaaaaaattagaataaataataataataataataataataataataataataataataataataataataaggaaaaagtataaattaccccctgaactatcgtggtcgtccgaattacccccctaaaccacaaaaccggacatttcttcacccccaactatgcaaaccggacgaattacccccctcgacccaatccgcggtggttttggtctacgtggcatacgtgtggcagcccagtcagcattttatttttttttttaaatgtgggacccacctgtcatagactcatagtctttcgtctctctcactcatcctctctctcgcgcgcaggacaagcggcagcggcagcgcacacggcgggcggctgcccgggtcaagcgggagcggcggcgcccaccgtgggaggcggcccgggacggccggtgggcaggggcgggcgggcgggcggtcggagcgaacggcgcggaccggggcgctcatggcagtgcgatgaccggcgggggcaggtggg

SEQ ID NO: 60785 - DNA, 3107 bp, Oryza sativa
tattttaaaatacttatatacaaaagtatatttatttttatttataaattaatttatagtattgaacataaatatagctatatacgtgtagattcatataaaaaagtaaaagtattttagaacagaggtagtataaggtgaagatataaaaggttcgcagctaaaatctctgcttcacaagaaacgatctcagggaaagcagaggaaaatttccttcccattgtattctccttaagaaaaacaaagaaaaaaaattccacccactccaacgtattttgttttatttcctatattttttcctttctcctgtccgaatatgtgttttacaatcctatctaatgaagtttcatttgtttttcaatctctggtttttaccatgcatttttatccttcttatgtgttatcactatatgtttttacaaacatgtttcaggaagagattttagctggttaagcaaatagtccttccttcccaaattaatcatcatataatgaaattcaaaatttcttaaattgatcatcatataaccgtatggacacggatttcatcaaaatacaattaatacagcatgagagaatatgtgcatgctaaggtgtaattggcatggtgttttaattgatgtatgcattgtgggagaatgtgtgcatggtgtcttgattgatttgatttaaattatccttagtgttggtgtataaatatatatgatgattaatttggaaaggagggagtattaaggttgacgttaaattatttgcatgtatgtgatataaaaatcacgcctagcaacacaactaccattgagcaataaatacagtagtcagatggatccgaaaattatgccctccatctatttgatagtcatatttcatcttggcataatgaccaaggataattaattctacttatcatccatttaaatatgctactagctattcctcgtaaacaagtgattcattaacatttacatttctcgatgcccatgtagccaatcttatgtggaagaatagagagtcacgtattaaatccgagaaagtcattaagagaatatatggttggattaaaatatgcctatcaaaagtaaatttttcagatttggaaatatgcttatcaaaagtagatggagtgagtagtgttctaaattctcatatattttgaagttgccgacgtgttcttaaggggaagattgtgaaatcaatattttttacttaaaagtttgaataaagtgcatgggcggtccttaaacttgtaatgatgtgtcatctgggtccctaaacactcaaaatgaatacccaagtcccataacttatcatagtgtgtcatctaaatcccaaatcgccacagccccttcaagattctacatggcgctgatgtggaataccacacggacatgacgtgacaaatgaaatccatttaaaaattttcatttttcatttttatttttttcttctctttcttttctccttctcttttttttcctttcttctcctttctctatgacccgagcagaagaaaaaagaaaaaaaagaagaatgagaagaaaacaaaaaggaaaaagaaaaagaaaagaagaaaacggtaaagaaaaggacacgtcatgtccatgtggcatgccacattatcgccacgtaggatcctagagggcctgtgtcgatttgggacctagatgatacactttgacaagttctgggacctaaatctgtattttgagagtttggggacctagatgacgtaatcctacaagtttaaggaccgcctatgcactttactctaaaagttttgtgatgaactattggttttacaagtgtttgaattgaatatggtgaagtgttttctttgactgactctcattctataagtgatcggcccaactgatcaggtatggccatacgataagagatgtatgtgtggttgttggatcaggttgcgcaatagcgggaccaacagactccaatgtggagttggtttccaatgtggagttggttttggggtaaatttgtgcttcctgatgattctttaatgtttataacctttaattgtttcatatgcttatcatatactatttgggtgctatgagtcacgttgagaaagaatttgtgttcaagttttttttttcatgtgtgaacatgtcttgaggccatgtgagtattatcgatgatggatcgggagtcaacttaagagaagttgatttctagatgatgaagaaaatcatacgagatgctcaggctaaagaaaaatatacattgaagtggagttttcatatggcatatatgagatgtatgtgtggaaatgaattaaattcggatagggatcaaagttcggaaagcttgagttcaattgtaaagagataaattgtatcttcgttgaagagggtttattggggaataggactactaatttgaattggcttcataatttttgagcagttcttttgggtataaatagatgagaagtttagactcaagagtaaaacttttgaaggagagaaatttagagtttagccatgagttatgacttgtattcatgagttgaaacatgggtactttggaggcactttacaaacacacaatttttatgatcctatcattcaacccttcttttgtagacttaaactgtgttcggaaggagaggttggcaacatctttctcgtgcatggaaaacggagttgtttgttgatatatgattaattaaatattatcttaaaattgaaaaataaattaatatgatttttaagtaacttttctatatttttttaaaaaacatttagcagtttgagaaacatacacatgaaaaactcccgaacacaactttagttattttattgggttaattagatacatgccgttataaatttaacggatttgaaatatgccattacaattcttgtatttgtaccaatgccattacaatttttatatagtttgcaacatgccacttgtatacacgtattttacctatattagacaaaaatgccccccctctttaacctctcgtcgttcatcgtcatcgtcacctcgccatcgctgcccacataggtcaccgccggcgccatcctctgcgtccccatcctcatcgccgattcccctcctccggaccatcgccggcttcc

SEQ ID NO: 60786 - DNA, 2580 bp, Oryza sativa
atgtctagcggcatggaggagctgagctagtagtacacacatgcagcatctgcaggttcgtcggtgtcgacggaggcgacgactgcggggatggtggccgcgagggccgtgcaggagttgtggaacggttcggacaccgagcagaagaggacatacccaccggttctgctcgccggagagggaggggacaacgactgcggtgtccatcactggctgcgcttgccactaccatcgctggtctcgtggaagagaggagaggggagaaagaggaagaagaaggaaagaagggcaatttgataaaaacaattattgtaaatgcatctcagtggcatatctcgaatatgtgtaaaattataatggtatgatccaaatacacgaatactgatggcatatttcgaaaccggcatatttttaattccatgtatctaattaatcctattttattcgatcttacaaaatattcctcttcccaccctgaacactacctccaacgacttataattcagatctaaccgtacactgttgtgctcaaatctgttctactagttgctaaaattaatatgcaaggcaagttgatcgatcaatatatccatcgtgcttcattgtatagcaacgagggcaaatggactataataaggtacaaacatgcacggttactaatttgcattgctccgatattcatcgcaaacattgactatctcctctatatttgtgtataatttttcttccttgtgttcccccccaaaaaaaattatatcttcctttgtttgtattgttcatcaaattaacttggatcaagaactcgatgtatcatcggctagaaatgcatgtgcaaaatggacagatatattcagaggctacattcaattaatactgttaattagcacgagaaagaaaaacaaaaaaactaggaaagagtggacaagagatgaaagaagaagctaggcatggccaagctgtatggtctattttggttagaccagaatctacagggctcccagaaacctgtctcctctttcatgctagctagctctccgtgacaaatctacagacatgccatgtcacatactttcacagtgaacccataaaaaactaacctaatacgatatgatacatcctaatattacgaatctagatataactctatttagattcattatactagaatgtgtcacattcagttttagattcgtctttttaggatggagaaagtatgtctatatctagatttatacagttcgacttttttttgtagaaggggtgcaaggaataagggtagatagatcggaaaacattcatggccatttgggttggattaatgattcaggagagaaataggcaggggtaagagaaacacatcattataaattagtcaggtgctatataggtccctccgttttaaaatgtttgacaccgttgactttttagcatatgtttgaccgttcgtcttattagaaaatttatgaaatatgtaaaattatatgtgtacataaaagtatatttaacaataaatcaaatgatatgaaaagaataaataattacttaaattttttgaataagacgaatggtcaaacacgtacttaaaagtcaactgtatcaaatatgttgaaacggagggagtatcatggagataaatatgtagggaatggcctcttaaagagaagggtctaggttaactgtattaaaaaaacagagaaaaataactgattggtcgtaactttggatggacagatttgttaatcgagaagaactcgacattggtcttgtttggatcctccggactattaaatagctctccggaatcttgctatttaggattattaaacgtagattatcgacaaaaccgatttcataacccctagcctattttgcgagacaaatctaatgatgtatattaatccataattagcggctgattactgtagcatcactatagcaaattatggattaatatacatcattagatttgtctcgcaaaatagcctaaaaattatggaataagttttgtcagtaatctacgtttaatactcttaaatagcaagattccgaagagctattaaataacccttcggatcaaaacagtgccattgtatagaaccagttaatggtacgtggcatgtgtgaatataacagatctcgagagaaaatctgtaaagataaaccatccattgtttgtcgcatatcacaagcctaaatcacgagacgggttaatatatcaatcatatgtacagttaattaaaattgaatatctgctctgcttcatatatatttttaaaactccgtgaactagtttttcacgtgtgagcctataacaccccaagtaaccttacaattaccagcccacatgcacataattagggcaattcattttatgattttcttattatttaaacatttttaatttcaaaaataaactctcccaaaacttattacgattctagacattttaaccaagtcagttagactagcatgacaaaacaatgtcatgtcaactaaactgatgcgggtgcattattagatcatgtcattctgactggcgtgatagtgtagtttcctcatgtcatcatgaagtacttgcag

SEQ ID NO: 60787 - DNA, 1801 bp, Oryza sativa
aaaatgttcagattttaaaaaacaagctatggtagagtttgttttgctaaaattacaaagtattttaaaaaaataagaaaaattaatcatttcatcctataatccatccgtcccataaaaaccaacatagtactggatgtgacatactaatactatgaatctggacatccatttgtccagatttattatagtagaatatgtcacacctaattttaggatatattttttttttggggtggagggagtaggctgtaaggcgcgtgtgagggagagaggggtttcttttgggggccgggcggggttgattggcgttaggtggagggtctcattaaaacggaggtgcctctgcctgcaaacacagtgacggtccttccaactgctgggatggctgtcccctagcggagataccaccacagcgacgtacctccaaacaaacaaaacccaacaacgagctttgctatacccctatagctagcaatgcacagacgacagctgggatgaaaagaatatcgatcgatcgatcgatcctcaattattttttctctggattgatcgatcgatctcacagttcgatcgattggtttacacgtgtgcttgttttccactggagcaatagtattttattttgtttatatatatatcctccttgtgttttttttaagaaaaaataatctcgatcgtacgtcctgatcgcgcttttatggaagatcacattttgtgacacccttttgatcgatcgttttctaatgcaatttattttgaatagaaatatgttaaatgtagtacagaaatttcttttgacctcttaatatgacttcagttgtcgaaatgttcctagaattcattaatccctactatcttataaacacaactccgtacttattccctttctctagaggaacaagagaaaaccattcaaaaaaacaaacaaaaaaatcattaaaagaaaccagtcaagaaaacctagataaaaatagggggaaacgggaaaaaaactgaaacttatccaacagaaaaaccgagaaaaaaattgcaagtatatgtttaaaattgcaagtatacttttcaacctatatttcttttctccaaaacatagctacttccaatgtttaaaattttgcttcaaaatatagctacttctcacacataccaacccagttcaacaaaaaacttgagataccaaggaaagatgagcaactcacttcatattttaacaacttctacacttaggttaagatttttttcgcttatgcttatgcttatcaaccaaaatttgaattttcaactttcaatttggagttgattttagggttttttttcattgaagtttatttttcaacaaatgctttttagatcgctaagaacatgtatataaaagttttaattattcacaaattatttttcgtttacaaatatgccgtttcgcttattccccgaatatacaaaacgatggggctttactatttcaatcttaaccaatcacaatcatctcttatatattttttcacgtacattttcatctcaatcaatcataattactttttatttaattttattgctctttaatctctataaaaacttatatgtataaatttttatattttaagatagaagtaaccctaagctcgagcttttgagttgtgaacttgtgaattgtgataggttggaatagtatggatgggtcgtcggccacccgcgcccacaataactgcagtgacgacgacgagaggattatcctgcaaataagcaacgtgtggtgctagccaccgcctcctgtagcgccacaaaaaccgggggatcc

SEQ ID NO: 60788 - DNA, 3123 bp, Oryza sativa
  unsure (1)..(3123): unsure at all n locations
caaaatatttttcttgttatttcattttgttccagttaattaatttatattgtatatttgggctgagggggttggtacagagtcatgtggggtagttgctacaaaacgagtggttaaaatccttgaccctagtcagaacagctagcatggatagtgttttttttaaaacaaaaagaaaacatcatttttggcaggtacgtttgtgtactttctacttttgtttgaaccccggacctttgaagcgttaaacgtgtaaaacaaccccaaaagcatatacataaaaaagactttgcccactacttattattatattatatatagaaatataaaaatatatgattttattgagtatcttttaaaattaatctatacatatagtctccatattttttaagataaatatttttaaaatcacttatactaaaatatttttaaagttcgacaccagtcttatccaaaacgacaagtattatcaattttaaagtttaacatcaatcttatctgaaaacgatgagcgagtatcgtcaaccaagagggagcagctgcaatgttgacttagttatgtgatttttttttactgcatatatatgtatatattatttttcaatgacaaattaacacgcatacttgcattggagctctactttgtgaaagtatggcccaaaatgaatatatcgtttatttgagtatgtgttaagttgcattgatatttgagtacagtggatgcatctgtgttgtgtgcgacgcacaatgatgcacactatttgcgtcttttatgtaatgctccaggaaaaaaatgatcttcaacatataaaacacaataatattatcttcatcaaactaaaactattaaactacaactacttatccagttgtatagctcgaaataaagtctttatgaaagggggattaaaaaaaattatattagtcaaagttaacgttattagttataaagaagaacgagttatatattacatattgatctctgtaataaacgaacgaatcaaaatgaattctgtccaatatatccctccagctaaaagttctaaagaaaactatgtatattttcctgaagtccaaagtaaactaatccaaaagcaaattatgctccgctaatcaactaaataacgggctcgagccatcgctgccaatgcttaggctagctagctgctcaaaaaaaaaaaaaaaagaaagaaaaaaggactgaatcaatattcaggaacagttcgtcgtcgtcttcttgtagctatctagcagcagtgcgtgcgcaggttgcccctcgatttcgcgccgccgagcatctccgtcaccatgccgatcacggcgccgccgtctgcctgcagcagcagcggcctcgccgccgccgcgccgccgccgatgacgctcatgacctgcaccaagaacagcagcagcagcgccacgttcgccatcgtcgccgccgccattatcgtcgtcaggctatgatcgtaattagcttcaatttggagtgctgagctgagcatcggagcaatggatcgagcttggagagaactctgccatggcgtgctcgtttatatatagacgatgcatactttggaatttggatggatatggtcggtgtgtgcgcactgtctgcatgcatgttttgaactttgaagtcttcttctgtggcgtccattcaattcttggctgcgtactgctttttattatggttgagattaggcctagtttctgatctcgtttgtttgtggctgcacacacacggttcaaacttcacacgcgcgcagagaaaagaaagggaggcattaatattcagttttgcaggactcgttcaaatctgaattaatctcgctccactgatcgatcagagtcatttatatgcgtttttgtctcccacgaggaacgattttcttttttttttgggcgcgtccgacacatttcaactttttgaacagttcgtgcttgtagcttgtgggactggtaagcagagcatgcagcaatctgggcagagtcaactggattattccctccggtaaaggttttaaaatattaatcatgtttttctaaaaaaaattaaatcatatgtttaatcataaaataaattataacaaaataaatactacctctgtttttttaatatataacaccgttgacttctctatatacgtctcactatatattcgtcttattaaatctattaatttaattattatttattttattttgacttgattttatcttcaaatgttttttaatcatgaactaatctttttatatttatatagaatttagggtaaattgcacccacggtgcatcaacttggcaggtcggtgcaacttgatacaagaacttgacaaatgagcgttttagtgcaacaacttagcatataattgcaattaattttgtacaagaactttataagtgatcgcataaatgcaacaacttgtaagatatgtacgattttgatataataagttaagtttaattatttggaacactttttttatacatattcaatttctaagtaattttgataatatactaacgtggatttgtatataagcatatttatatttttatcttaataattaataactgatagtcaattaaattggatgtataaattattatatttcggttgagatttgggaaggtgaagaaaacaaaaattcttgaaggcaattggatgtgcggtatgattattaaagattaagttcaatattataaagtaatatccgtaggattgctatgtaatagcatattgatatcatgaaaaaaaaaactcaccaagcatatgcttagctaagttgatgtgcaccaaaatactaaattgtcaagttattatgctagattgcacccacttgtcaagtagttatactcgaacgcttaattctcaaattcttatttttaaagataaatccaacctttaaattaggagtggcaacttaacttgagatctcaggaccatcagcacgcacctttatccttcatccctataaaaaatgattcagtacaagctactccctccgtcccataatataagggattttgagtttttacttgtatcgtttgaccactcntcttattcaaaaatttttaaaattattatttattttatttgtgacttactttattatctacact

SEQ ID NO: 60789 - DNA, 7990 bp, Oryza sativa
tttttccttgatcgatggaacaacaccctgttttttttatactactccatccaaaaaaaaaataatcctagcaatgaagctgtaccgtatgtgtgtttttttgattggttgcttggattggattttatgggacggacggggtatgtatgttaggaggggtatgtaacatactgaatataagatgtctcgtgtaaatgaaacaaagtgaattatgtacatttttttcttcctaaaaagttggaaagaactatgtcctttttcccctaaagtacaaagtaaactactaaattgatccaagagcgaattatgctccggaactaggtgcagtggcgatcgagtcctcgatctctgccgatgcttcaaggaatcaaggctgctcgatcccaaatctgaaccaacaatgttcaggaatttacagttcgtcggaattattgattttgatctctgctccctccctctaggggaagtgcgtgcctgggttgccgttcgatttcacgccgccgagcatcatctccgtcaccatgccgacggcgccgccgtctgctgctacctccagcagcggcctcgccgccgcgccgccgccgccgaggacgctcatcatgatctgcaccaagaacatcagcagcaacgccaccttcgccattgtccgtcgtcgtcaagcttaatttgctctacaccgacggcagagacgacagtcagctgatgcaggttctcagacagacaatttgtgcgtgagaaattgagagctgatcagctgatctgagcttaatttggagattgtattaacccctgcaatggcgagcttatatatagatgatgagttgattttgcacacatgtattggttggtgtgtgcattttttctgaaaacatggttttgaactttgaagtctttcgtcccgttcaattcttggcacgcatgcttaccattgtcatcattgaaatttagacctaagggtctgtgtagattatagccaaaataaacctggccaatattaacaagttggcaatattgcaaaattttagcatgatttcttatgtattaccaaatttagcaacaaactaaacgtagataatttttttataactttgttaaaaaaatggtatggttaaaaataacattaatctgaacagcccctaagtttctgatctcctttgtggctacacactgcacacatacacacggttcagacttctgatctccgtccaagactcgttcagtctgaattttcttttctttttttcctcccacgagttcttgaaccgtttgtgcagtcgtagcaggcagctaaattggattactgcatactaatggaaatgcacgaccttttttgaattacattgtgggtgatgatggcttactataagtttcatggtcaaacaaaagaaaatgaatattatgtacgtacgttaatttgattttcaacgggaggttgctagggttcaaaaaatgtgttcaacgagggcgtgaaatccgatggatggatggatgcatgcgtggggttgtttggtcttggtcatgaaagggagggaaccgggaaagttgcagtatgccagtatgtatgcatgcagtatgccgtgcctgctgctgcgtacagaaacggtctttctctgcagctctgctatgataaatataacaagtcaatagatcgttaatatcattggaaaaaatctcatgcactgtagttcttgatgtgtcaaaaaaaaacttgcattagtattggttaagagtttaattcctatatttatgtctatgaagtttttttttgtaattaagagttaagttcctatatttgtctaagtattagttcttggataagagtttaaaaaatacttcatgatcttaagttcctgattggccgaagaaagattttttttttttttttgcaattctgctagtattaattacagtctgattcgtacaattttgtccatgcatgaatattaataattattttttgtgagggaatattcataggtttgacatatatataagcatgcatgagaaaggtcgacgtcgtaactcaaaagtcacctgccggtctgctggttttggcgaaaatcaaagctgctatacccaataatattttagccgtcaaaaaaatcaaaagaggtcaaagatttggaacatgtcgtacgactcggaaacagcgactgtttccacacgaccaaacccaaaacacgtaatatctcaactctagctagctacttcgcctaatctaacccatcacctatatatatatctcaccaattcatccagaattcttcagctcatcaagcagcaaaaccaatcaagaacaacgaaagctattctgaacttctgaagaacccaactcaagctcgacagcaaccaatcaagatcatccctgttgatctctctcttctcatcgatcgttaatttctgtccgatatatatcaatggcgatgacagcagcgagggcgatggcgatggcgagggcggtggtggcggtgctgctgctggtgcagatcttgggcgccatggccgtctcggcgaggacgatgaagggggaagggtggctggaggacgggatcggcatggtggtcgacatgctcggcgagctcaagtctgggggcaactctcccacacactgctgctaactgagcagggtgtagtcagctaccagcatgtgtggtagaacaagagagatgatgcacatacggtggtgtacagaaattaatttctggatgatttgtttcttgatcaatttggaggtatagggtaggaaagatgcagagatttgaggcaaatttctcgagtctgtgcttcgatttttatctgtacattttgttttttgacatcttgagaagaaaatcaaaggtgtattgtgatggttttgatgatagggacatgattacatgaattgaattgattcattcattttgttcgaaaatgttcgtttatgttgtttctcattccgatgtcagagaacaaactgctcttgacagctaaatgtcactctgtttcaattccgtacatgtcatttcgtctttgatcgatcgagtttgtttaaaatatcgctctgcaatttcataattgaattggatcacaattcactacagttaacttctcttctacctgcaaaaagaaaaataataataacgacttctcttctgaaaagatagaagcagctttcctgtaatctttttctcccattatgttgctcttcaagtttggaaatgctgttctcaaaaaaagtttggaaatgcgacgacgaaaaaaaaaatgaaaatgaccgcaaagatgttctttaggaaagaaacaaattgacctgaaagtctgaacccctgtggttgttggtcatttgccaacaaccaaaactgctgaccttttgaggtgtccttgtaaagtcaaaaagtttgacacttgaattcgtcgaaaaaatgatattacaaacaatacatgtcaaggaccatgatgctgaacggttctacacggcttgtagtgcagcgtctctgactgttttgccgggacagaataagcagcgtgtgacacgtactgttgaattgtcggttctaattaattctaattccctcccatgatttactatttataatttgtggatttggtttgtataaaataaaatatagctatattcttcacatggtttgtatcaaataaattactgatatatttatgtttttattcaaaccatgtcgaaccaaattggtataaaataaaatttagatatgttcatctaaataggttacagataaatatttgcatacatctcttcaaaaataaactacaaccaaacatcaattcgtggtgcacaaatctgatatatgtttaagacataaaagacccaacgaaaaagtttttttgtttgaaggcccattggttttggatccaaagtgacaacgctatgtagtccttccgaagttaatgggcccaaagtggcaaaacgtacaggcctgtttagaattggaataagttcacataccgttctttaactttacatcaagtctgtctaagttccctaatctccaataccagaaatcttcacccctaaactatataaaatagtccaatttcggcccgctgacgtggcatcctagtcagcaaaataaaaaataaaaaagttacagggcccacatgtaagtaagaaaggaaaaaaatatggggtatgcctatcttctttttctcttttcttttcctctcttctttttactttcctctcttctcttctcttcaccggcggctgagaggggagaggcggccggcaagcccggccgagctccaactcgagaggctccgccgccgcacccgacgacgacgacaacgcacacgcgagcggcaggcgagcatggcagccgccacacccgacgacgacgacgtacaagcgagcggcagccgccggccgaccaaccgcgtggtgaaattggcgaagcggagtggcctcttgagcgaaaggatctttgtctcgccgttggcgtacgagagctggtggtgctcgtcgtcgatggctgcggtagagtgcggcgacgagtcgccggagtcggccatggtggcgacatacggcggcggtggtccaaccgttgggcgcagaggcgtggagcatgcacaagagcggctcatacaggttcaacagcagccagccggcatcctctcctccccctccagtgggacggtctaggctggcggtggttagcggagaagctcgttggcgatggcctcctcgagccaatcctcggcagcgccaagcaagctcgtcgggcagaaatggtgctccccctcctcctccgcctgccacacccccgccgcttcctcctctcccatcggcgcgacgcgtggagagggtgggagagggagaggcggtcggcaagagatgggggaggggaaaggcagccgacgagccggtggccggctgctgctgctgtcgcgctcgcgcatagccggcgctgaggacgacaccctcgacctcctcctcgatgcatgccgtggaataaaactagaaaagagaagaaagaaaggctgccatatgggtcccacatttttttaaaaaaataaatttactgactatgatgccacgtcagcgaaaccaggtatatatagtgctatgtgatctaaattggactgttttgtatagtttaggggtgaagatttccagtattgggatttagggatgtcaaataaactcatcgtaaagttgagggacggcaggtgaacttattccttcataatataggtccccacgatggactggtcctaacgacatccacaatgtacgtagtataaaactagttcataagcaatacaatatattattggaataagttcatctaaagtcctttaacttgtcaacgaatccgattttcgtccttcaaccagaaaacaagatacaatgggttttcaaccatcaaaaccggtgcaaaataagtcccgcaaggcggtttggacggcggtttcagctgacatggcgtttatgtggctaatttgactcttcatctggcgtggcattgacatggcacatgaagcaaaatttaacaattgacattgacatggcatcatcctccgcgcagatccaccggtgacggcggcaacggatccgcacctatctagggtcttatttttggggatttttatttttatttttatttttatttttgtgtacggacaacataagagcccacacatgaaaatcggatttttatgtacgggtgcaccacccgcataaaaaaatagcgattttcgtatatacttttgggcagacaggcgggtcaaccgcacgcaaaaatagctttaatgctttttgtagtagtgatattttcatcttcgatcaggtgcataagtattttcaatctttgtgcatattacaaaataaacatcacgtgtagtacattattttaacgtaattggtaatcttcaattgacaaaaagtttgggatagatttttagcgaatccatgccacaattcaaactgccgtcattttcttccaactccagcgagatggtgggatagctcaaccaattataggttggggttggaagtaggacgttccctgagtttagaggaatggttgcgggaggcggtagctcagtggtgcgcattggaacgggtgggtggtgaggcgatagtggcagcaggtgatgggccggtgttaagagcaggggcatagtatagtgagtggtttgaaggctgggacgccgatgacgtttctccaatggtgggaggaaggaaagccagtgtggcagggggcaccttgctgatgcacgctggcttgaggaggaggaaaggagggaggtctggcgggccttgttggcaccgttgagggaatcgaaggattgatgggagttgaggctgtgagggttgcatgaatctcaaagtagattccatattctagaaaatgtaagagggtatggttttaaaaagataaagaaaacataagagggtgagatgaaactttttcagcatgtttggtaagagaaggaaagggttttttgggagttgggggagggattcgcttttggagtgagtttcatatttactcttcttgctttgtttagtcatagagatgagaatcatgggaaatatcccataaattgaattttatgtgatgatttatgggttggtatagttggccaaaaggcctgaggcccgatagcccaacccgattggtgttgggcacatgccggcatggcccgaccgttggaccatgtctgggcctctgcctcggcgcggtgggccagcccggcacaacacagtccaaagatcagggagctcaatagacgagggagccaaaatagaataattccagccatgtatggtggccgaaggagatgagggatgcaaaatagacttactccagccatataagagatggccgaaagaaatgagggaggtaaaatagactttttccaagaaggagcacaataggctttcatgcctttgggctagcccgtcatggcccacaagtcttattgggctgtgcctggccgttgatctagcaagtgggtggcccggcccgggtggcccgtttggccatttatagttagggatgataatgggttgaggcccatggtccctttcatagcccatctcaaccctttaatatttcgagcattagaactactaaatttcagttaaatcctttttttacgtagccctcatagttttttagaccaaaaatttggatcaattatcacccatatgtacagttcaaatttatctcgtcatacttataagagaaattcccttccaaatacgtggtcatatcccggtattgaaaaagtgagagtttacacttgaactctttgtcctagtctctcctaaaactctcacgtccaccaacgaaatactagacttaatggtctcaaactctcatttctccataacaattcccccaaacagacgcatgcaccggttctatataggtagccgatccttctgctttactgaggagtgaggagagtgataaacctggtcagtgtccagtggcctcgtccaccggactgcgcggacgcatggggtgcgtgcacgtgcggtgctcgcgtcggccgtcgcgccgcgcacgcacgcacgcacgcatgtgcccaccctgtctgtcccgatgtccgtggacatcaaccaaaccatatgcatatgcacgcgcctcccataaaacacaagctggcaacgatccatttccactactcctcgagatccccaactcctctccctcctcttttatactcgatcgatcgccactctacctccatcactgatctagctagctactagtacagtacacgcgtacgtacacctacaccttagctagctagcttagcttgtcgtagagactagagaggcaggatagaagctctcaagctcaagctctcatggagacgagctcgcggagcagcagcgggtgccagtcggggtggactctctacctcgaccactccaatggcggccaccggcagtattacgcgcgcaagaatcacgagctcgacgacgacgacgacgacgacgacatggtctccgacgcctcct

SEQ ID NO: 60790 - DNA, 1465 bp, Oryza sativa
ctgccacaccggccacgacgacgacgacgacggcgacgacgactccggtagcagcggcgtcggcggcggctacagcacttgtacggcccggtcgatgtcgtcgaagaggagggccatcgccggcgaacacagcgtcgtcgacgcggcggttgtagtcgtgctgcgccaccgcgagcacaactgcggcggcggcgacgacgatctcgacgacacggcgagctcgtcgtccgccgtgtcctccagcctgcagccaagctgtgctttctcggcgaggcacttgcagcaatggtcgtcgacggcggcggttcgaggcacgagcatatactgcaggccgccggcgccggctacgcaatgctacatcgcaactgactagaagaagcatagactagcctagatgacaagactttttttgtgtgtgtgtttgtgtttttctgtctatagaattttcagttgttagctctctagctgaatgcaagcagatggaggctctgtttagaatctaactttttttttctctagacttctaactttttcatcatatcgaatttttctgcacagatatcgttccaatttctttaaacttttaattttagcgtggaactaaacataatgcagcatggtaactttgattgatgcgaattttgactagatcgatgcatatattcatgtgttgcccactgtgtgtgccaatatatggtcatctaactctgaatatctcactcagcggcgaatatattatcctgttcaagtgttcatctctgaacattctgaagagaagaaggaaaatggatatctgaagaagttcgttagtttaagccagtctctattctcttctctgtttttgctcagcgtatcctagctacaagacaatgacggcgcctaaatgtactgtagagcatatgttctgtagtcaggtaggattcagcagtgcttgcgcgggagttgattttaaactctcgaatggacatcacttcattatttacatgttatttaaatagttatgaaaaataattaaaaaatgagaagatagatttatatgtgatatatcactccacaaacatgttaaaatttaacttctacaagtaaaaaagaaattcaacaatagcttgttaattagaaattcaacaatagcttgttaacatatattggaaaggaattttttcattgcaacatgtagatgctaaattttattgtatgtttgttgagtgatctatcacatactcactccgtccaaaaattataagcatttttgaactttgacacgtcttcgagatgctattttaaccaataatatctataagaagaaaatgttttaaataaagcgtattatgatagtttgtttaatgataaatctattaacatcaaatttgcattatttacattagtttgtttataatcagctgcaaccaaaatttaaatttcaaatattaattttagagttgattttgatgtctttcgtcgtagt

SEQ ID NO: 60791 - DNA, 1643 bp, Oryza sativa
aggtgcatgtactactagtgagtcccaattaataagtactttctccgctcctataaaaaaccaataagtattagatgtgacccattctggtaatacgaatttggatatatctctatctatatttattatagatagaatttattatattcagttatagatttctttgtttagtccacgagcgcgcaggtgcaaggatgcttcctccttttcctctcctcgtgcagggccagcaacagccatgcttgaccaggtcgtccatcgcacggcgcatgcacgcgcgcgccgtgggcgtgtgcatggcgccatgtgcgcggacatcggcaacagcgacgcccgcccgccggcgcgcggccgccgggctgcgacccacgcccatatgccacgcggctccctcccagtcccatgcagatgcacatgacaacgccacgcatacctcacgtggcaaattgggccggcatcacgtggcgagaccgaccgctcgcgcgcccgcgcatgcacgacccaacccgcgggcgggcgggcggccgcgctactattgctagctagctgcatcgatctctataagagaaggtacaataacagtttataaactagctataaccacatattaaaaaaaaaagagaagagagagaataaagtgggctataaatttatagccggctgcaacacgaactctaatacgttatgagtgtatgagaggtaggaccgggtataaataatgtagtatatttttatagataattattatattaatggactattagattagctatagataatttagagttaacggttggctatactattgaacttgctctaatatctggcttgtgcagcgcccgccgtatcgtacgtaacgtgatcgagcgagcaccgaacggcgtgcgggcaaacacatgcgcgcacgcggcccgcgccccgcgccgcgcgttgcgtgctacgtactccatccatcctaaaataactcgattcttaagcttatgtgtctaacatttaaccatccgtcttatttaaaaaaattataaaaaaattaaaaagataaatcatgtataaaatattattcttgttttattatctaacaacaataaaaatagtaatcataaaaaaaatttcatataagatggacagtcaaacgtagtacacggaaacttaggaattgagttttttttatggagtttaatggcctttatccccccgggtctgcagccacgcgcgcatgtacctgatcgggctctggttacaagcgcggatgagatgaggtcgaatccaaggaaatttagaggatgaagacggcagagccgcagagggatcgaggaggagaatggaactgtgcaagtgtcgtcgtcgtcgtcgcgggtcatatgcactgcccggacacgggcacaggcacgcggggacggacggagttcacattctctatcataacaatatactatcattataactatagttactgatgatgtgtttgagtaataagaggatagatcatgtattaattggtagctatactaatagcaataagaggatgatacccaacttttgtatatactaatgatgtctcatgctttgccgcgggattatgttagatattggagaaatgatgaaataatttacatcaaaacaaataaatgatgaagtactgt

SEQ ID NO: 60792 - DNA, 1403 bp, Oryza sativa
tattatgtcaaagtctactgctctagggataacaggctcgtccaagtatttgtctagttctgacttgacatctgcactggagaacttgaaagcgatatatagatcgaagctagataactgatctggaccctcttcctcccccccacaaggctgcattgcaccgacttttgattggggaccctgatactgtttgatcaaatcataacagagctgccggactctatttatctcattgtatgcctcatcaccaaaaattgaggggaaataaaactgcagtagctcaagcttatatctggggtctaggacagttgccacagccatgagatcatgaacttcaacgcaatatttctcaaacaattcggctatttcatttctcatccttcctatcagttcatcctcacacccaggccatctcctcatggccatccgaattccacaaatcttggggaagtacatattagcagtaacatacttagcctctgaaattagttctgcaatgtcagaaaacagtttcaacttactgcagacctcttttgctaatttccagtcatcatcatcaggagcacaaatatactgttcctctatttgccttaagtgatcaaagacttgcttgtagcttatggcaacatttaacatggataaggtagagtaccatctattattacaatcaagagtcaacttcttgtcgagattaacattcaaaccacgagcaacatcagcaaacactacatctctttcagttgttgctgtccagaaatcaacactggcgcggatcctatcaacagcacctcccatcacacccaggcaactattggcaattctacttagcacataggcgcagcatctcatgttcagcaaagacccacctaacaaaagttgttcggtatccagcctttgctttaagagccccgtaaccgtatcatctgtagaacaatcatcagccatcaccattgataccctccttccaagattccattcgttcaaacaagaagacagagtttcagaaattgcttgagctgtatgcggccatggcacatgtataaagctgcatgtggcaatcaaagcacaataagtttttacattaaaatagtctgaatagaactttggaccgagaaaactgcaactatatttgaaaatatacatacacacatctatgcgctcgaaaaataatgaaaaaggaacacacctcagtagacggcactggaatgtccaggattggtcgataaaatgagctctgacagccacataacctctattttgatcatctgatgtccatatatctgctgttattgcaatccgacctttagcctcccacaaaatttccctggttctgaccctctccgtctcataaatgctgataacatccttcttaagactactgttgggaaccagctggaacaatg

SEQ ID NO: 60793 - DNA, 4507 bp, Oryza sativa
tcctgcagccctgttggtgccattcttagtgtcccctccgagcctcttatggcaccataggcactcggctttccacttgctgtcgattttcttcctcttgaattctttccacacactcgatgtcagctttctcttactaacatattcttcttcaacagcatgactggaatcaggagcagcagttgagtttttggcagctccaagacccagagggatgtcatctttcataaccaactctgaattctgcaaagtagaacaggcaacaggggtagtgagaaacaaatggcagtagaaagatgataattctccctggattttctttttcacttgggctaatttctcatctctatctctactattataaaaattcaagatgtttttgcggtactttggtacgtcatccgtgtatgagtcggtttttaagttcgtttgcttttggaaatacatattcgtatttgaataggtttttaagttcgttcgcttttggaaatacagaaggagtcgtataagaaatccttttttttaaaaaaatcgcatgctaacttacacggttggactcctaactacagctcatgatttttgtaaaatacatatattcaagcgaatttctacagtgaatttcacctgacttaaaacatataataataataagattaaaatagtcttttcccgttgcaacgcacgggcattttttctagtcatcccttaattgaaaaactagatacaactcatagctcacactctcaaaacaggataaatcttgtccccgtttgacatggttttgagcagcataggaggtgaggtccacttgtcattgaggataaatggtgggcccacacgacaaacgatgatcaagcaggtcccatctccagtttgggtaaaacccctgttaaacaggttggaggtacatgtttttacccggtttcaagagttaagggactgatcatatatgtatattacgcctagtctaaaaggaaggagaaacataaattttcttataatcttattgagcaattgagcaaagctgatgaattttctactagctgtatcgaactagaatgaatacagggaggcgcgagaattcagaatgtgtaggggcggagaggaggagggaccttggacttggagttggagcgagcaagatagtcttggatggacttcattgttgaaaccctagctagctacatgcctctgccgccgcccatcaaacggacagaaagggagcgccgtagctagggggttggatctggccggaggagcgtcggcgtcgggcgatgggcgcggggcggcgccggcggcggcggcaagggaggccgggagggagggagaagcttcggtgcggtgcggtgcggatgaacaactcgatccggtcagttcagtgcaggtggggcggaatgggttgggctgcccggcccaccatgtaagcccataaaccgcattccggccctgtgctgtgtccctttcttttctctttatctttatctttatctttatccttaccaatctaatctaacctaacctatttaaaaaatacttaatttttcgccgcgctttcctccgcaggttcacaattccgacgaaaaccggtcgaattctatgaaatttcgacgtttcgacacggctcggaattaagtttcgattagaatttcaaaggttaaataatagatttggtcaaaatttatcgaaaaccgatcgaaatttatagaaaaccgtgataacaatggaggtcaaaatttagtggtcaaccggtaataaaccatgttcctccgtcgccggcatccgccctctcggtattcttctgtcgtgtgcgcatagagacaaatgagaaggccaccatggagcagctttgctgcccggggtatgtgtctcacacatcctcgacactaagttcgtggtctctttggttccaccgaaaataataaaataatatctcgggagtccaacagctaattaccatatttttaccgtgtctacgagaagatacacgttctttgaatgtttcacaataaagaaattttaccatataataaaaatagaaccccatatttagaaacacgtgatgccccgttttgacagtaatggatccccccaaatccactcacctccaacagttggttccccatctccatcatctgtggggagagagcccgagaaatttagggttgagaggtgagtggcggcggaaggaatccacaagttgcaagggtgtggaggcggaggagtggcctcgattggggatcggaggtggtgaatctcggtggagaggcacaatccaaggcgataagcgtcgatttgcaagggtggttcgtgggcgaatggcgaatcaagggcatccaggcggagggtggcgtcggcgtccagccgtggtgaggaaggtcgccctcccgcagtggcgcaccaggggggctcctcgcaagctgggagtgagcaatccaccaaggctggaggtggagagatgaggggccagatgaacaaaggggggaagctgcagcaatatcgtccagttcagaaggagaagaatcaaactgaagagaagattgcgacatctgcagtgactcctcagactgcaacccagcaaccaactccaccacccaattctcgcactggtatgcaaactaacccacagagaattttctgccacagatgcaaaggttttggccacatggctagggattgtagcaatgttgtcttctgtataaattgtgccaaacccacacataggacagaggattgcatctatgacaagcagccgaggcctatggcaaagctagtagggtatggtgctccaggtttaggttgcatcttaattcaaaacactaagcctgacccacctaaggagcataataatcctctggctatgatctctactgtctttggtggagaattgacagaagctcaacttgagcaaggtttcacgcaacaatttaagtggaattgggtttggaaagctaaagcaatgcctaatggaagctttcagatgagatttcgtaacaagataaagtttgatgagcttgcaaactttgattatttcaatgtcaagggcactgatgtgcaagttaatgtgaaagaatggacccagaaatctgaagcagttgggaagttgcatattgtctgggtcaaaatcactggaattcctgaggaaatgaagggttaccaagctttgtatgaaattgggtcaaatctagggcctgtcttggaggttgatatggctactttcagagctagcaatgtgatcagggcaaaagttggaatgatggagctgggtgttctgcctttgaaactagtgttaacttctcccaagggacttttgttccaagctcatttcagtctagaggaggtggtggaactggggtggtttagtgatcagctagatgacacttttgagaaaattgagatacaagaaaatactctggagggtagcagtcagagagagggtaagcaagttgtggtggtggatcccatgacagaagatcaccatgtcagtaagacgggtaacgggctattgaagtttgtcagaagcaagtcctggtgccagaattgatgctgggagaacataagatcaaatgtgcacagatcttgagagacatggagttggcaatgcaactgcagaaaggagactgtattctgactcagtgctgtgaaggaaggaaagaggttgggaaaaaggaaatgtcacaggagcaggttgatactctgcagcaaccgatgaatcaaaagttggctgaagaattagaaagctcttagacagatgttccaggggataaggagaatagagtcagttttgatatgggtttgaatcaagaagacaaggacaaagtagatccgggggacagtgaagattacatggattctcaggagtctaagggaagttttgctaagaggttggggattaatctaactgaagaagctcttggaagtcaagatgaagagatgaggagaagcaagagactgaaagacaaggaagataagaggtcccaagagatggcaatggaaaggaaagaagcacaaaatgctttcatcaataaaaattccctccttcatacatgaatcaaatgtctctttaattgatattgctagtgttttaggggtcaatctgggttgtgctgttgatgatatagcctctaatattaatctgattagagacttagagatggccagaattaacctctttctgaaagagggaacaaattctgaaggtcaacattgtcttgattcctttgagaattcaaatcctgatttaaatgttttttctgatgatttggattctgaaactaatgatgaggattttaaagaaattgagcatgtgcttaaacagattcaatcttcagctagaaaaatgaaacagagaaaggggaaccttgagattttcaaggtaacccccaaagttgtcaggaaaagaaaaaagaaaactaaagattaatgaagggcctcttttggaatattagagggatgggaaatccagaaaaaataggtcatcttcaagaccttgttaaagatttaaaattag

SEQ ID NO: 60794 - DNA, 11223 bp, Oryza sativa
acgttataaattatataatcgcaagaaaccagactgcatttctcaaaaacagatttattatggaggggatagtaatacttcatgaagtatggaatacttctcacaaaaagaaacaaagtgggattcttttcaaagtggattttgaaaaagcttatgataaggttgattggacctttgtgtatagaatgctaattgcaaaaggtttccccacattatggtgtgattggattatgaaagtggtgagagggggcaaagttgcagtgagagttaatgatgagttgggtccttattttaacacacatgaggggcttagacaaggggacccactttctcctctgcttttcaacctggcagcagaagctttgactgttttgatacaaagagctgaagataataagttgattgaaggtctgaatgtgagcaataacaacaaagtgactatccttcaatatgcagatgacaccatctttctgctgtcagatgacttagaacaagccaaacatctgaaattcattctctgcttgtttgaacaactatctggactcaaaataaatttcaacaagagtgaggtgttttgtctaggtgaggcaagagagaaacagggcctctacagtcaaattttcacttgtaaaataggtgctttgcctatgagatatttgggggttcctattgataaaaaaagattgcataatagtgattggaaggctgctgaaaacaagatggaacataaactgagatgttggcaaggtagattacaatcaattggagggagactgattctcatcaactcaagtctcagtattgtccctttgtacatgatctctttttatagattattaccatagggtgttaaggaaaaaatggatttctttcgaagaagacttttgtggtaggaagaacaggggaaaaaagatatcacttggttcagtggcccatactttgttctccaaaagatcatggaggtttaggcattctagatttagatacaatgaacattgctcttctttgcaaatggatatggaaaattgaaaatgaatcaggttggtggcaagatatactaagagataagtatctcaaaaacaaaaatcttgctggtatctctgtcaaagctggtgattcacacttctggcaagggctcatggaagttaaaaacatcttctacaagttctgttcgaagaaagttggtgatggggaaaatacatgcttttgggaagacaattggattggtggtagaccattaaacattcaattcccttctctgtatgacataacttttacaaagtaagtttctcttgctaaggtcaaaaaagagggctgggggattttcaaatttagaagaactctacatggtgacaaaatggactggaacactttaaaaaactcttgtggggaggttcacttgattgaggggtgtcctgataaaatctggtggaatttaaccaagaatggaatctttactgtcaagtcactatatagtgctttgaaaactcaacattatgctttccctcataaaaaagtttggaagttcaagattcctctcaaaatcgaagtctttctttggttatttctaaaaaacaagattctcaccaaagataacttatataagagaggttggaagaaaaaagacaaattgtgccaattttgcagcaataccgaatcacttcaacacctgttttttgaatgtcctttagctcattttttatggaatgtgattgggtgtgctctaaacctgaaaccaattctcaataaagaacaactttttgggagttggttgtcaaattttaacaaacacatgaaatatttggtgatggttggagtagctgctgtcatctgggctttatggagaacacgaaacagagcttgttttgaacatgttttgccatatgatcctatagaaactgtgttcctggcttgcaattggactgaaaactgggttgtcttgcagaagttggaagcaaatcgaagaagattggtactgggagccagactcataaagcaggtggcaagtgaggtctttagttcaagacacagctggagaccaggtgccagaagactgaagatgtgaagaaggaggagttgttgatgtccctgcttcaaagactaaagttgatctagcagtacctttctaccgtagtgatttgtttatcaatctgtcagcagttcttctgtttcttttaaaaactgttacttccggtaggaggtggtttccctaggctattctgaatagcttctgtctcaatctagttccatccttttttttcttttgctgtaatggcttcctgtagagaccttttatcatttctcttaatggaaatgggggcttcaagccctagttctaaaaagaaaaagctagttgtataagaattatgtcaaaaccaaaagaagaaaaaaagagagtgttatctcaatctaccttgattaacaaaactgaatttcatgatcgtggatcaaacataattgaagcaaaaagtgtaagacgcattggaatgattaacctagctataaggctcaaggttcctataaacctcacaaattaaaaggcaaaagaggataagggaaatactccgtattcaaaccttgggataggaggaacaaagaaatacgtgccagaatgcatattacaaaagaaactcctgcatgcggtgtgatcagaatggaattggtggggaaccaactagtggcaatcgcaacagctcatgaaagaaaaataattcaaggtaacacctgaaaagttctcaaaaaaaaaagttacacctgaaaaggggcatgatatatataattgcattgaataaacttacaattcagtacaacgttataagatttttctttctttgacatatatatatatacgcaaagagcaaattaaagaaatcttcccagtcttaagtaaatgaatttgtataataactgctatatactgtacgttgcttaactcgtggtgctgctcgatcaattttaatttaaacctcaagaaacagggaggcaagaaactgtacctgtccatatagaagtattatcgatcctccctaaagaacgtactgatccacccgtggcggtggactgcacgccagctaattgtccacaacgtaccagtaccaataccataattaagcagctagcggtcgaggaggacacgacgaagccgccagcttagcagccggagggagcatccatcgtggtggcccgggcgtccttccagttccagcgaggatcctcatctcgatcgcgcgatccacagccacacgtacacctactatatacgcacgcactctgcaaagtactagctagctaggagtagatcgatcgatatagtatgtcgttccttaattttctgcacccacacccagctggccatgccatattgccatgcaactattgaaggaagctaggatccacctacactgcacgcgcaccttgagcgaacaacctcgtatgtgcgtatgttaattattgtcctccatatatgcatggatgccactgccacccgcaccagcatctatcgcactcacggaccacaatcgtctcctctcctagctagcttgctaccacaatcatgcatataccagtttgcctcattttttttctggggaaataaattagttgtccttgaattatcatcttatctgtcttgcttgctttccaacaaatagattcatgttcttgcgtggcttgtctctcgtcggatgacggtcggagcgcacgtgatgcccggagtacagagcgagaatggagagatttttgctccatctgataaccgacccgttttctgttttttctgagaggaccaaccaggacctagaaccaacctgatggacagtagagacgcgacaaacacattgaacctgaaaccgatcgcatccacaagaagacggacgatagaaaccttacagtacaggtattttaagtaggttaagattaaaattaaaataagataaagataaaggagcaaagtatacttttagttaattaaatttagtagttgccatgtcaacggttagcaaaatatgatattgactaccaagagctgccgccggatccacgctggagggaggcggtggagcctgactgccaaggttgcccagccagccgccgccacctttgctcgcccggccgcctaccgccgacctagaggacgataagagaggagaggagagtaggggtgaaaataatagagtggataggagatgtgaataatgtgaggagagagagagaggagaggaggtgaaaatttgaagtgccttaaagagaaaagagagaggagaggtccctgtctacttcatcgcaaggcatctccagtctcacccacggcttggttaggtctttccattcattccacaacaatcgcaaccgcaaggtcctcatgaacttatccaagtttagaacccccaggcctccctgactggtcggcaagcacgtctttgtccaattgaccttgcattttcctccaataatatctcccgtgctagcccagaggaagcggcgtcgctgtttgtctagctgctccaaggattccttcgtgatttccagggcggccaggaggtagattggttgtgctgaaagtacagatttgacgagtgtggttctcccagctgaccccatgtttttttccctccagcctactaccctccccgagattttgtcgaaaacaggctgcaagtctgtcttccacaacctcccaagtactaggggaagccctaggtattttagagggaaatttgccctcaccgctggaacaccatcaaggacacctgccaagtcaatgctatcacatctaatggccgccacttgggatttctgaaggttggtgacgaagcagtccagaatgtccacgaaagcttttacattgcctcgggtgggattaatgaagatgatggcatcgtctgcatacatcgagatccgtagttgagtcgttctacaccgtagtttcgaaattgcgcccagctctattgccttggaaaggattcgttggaggaagctaaatatttatagctttgactagaaaaaatgtccgtgccttgcaataggtaaagatgttttctcgatgatacaacaactattagaagttgggcaataaattgaaacattacgatcgctatacattataattgaaaaaattgatgaaaatcctaacattaggatcgctatacattatgattaaaaaagttaatgaaaattctttcttagatttgggccagaagctcattccttcattcctctttagtcctacgctaatccgctacctccctctactcggcctgcctccttctgcccatctcgaatagctgcctaccatcttcaacctcccgaagatagtcccataaccatacgatgctggagctgatcttccccgtcaaatccggccgaatgtttctcgatatccaaaattaattgagggcttttgatccaccgatcatttctttcccttttccaaaaaatagagcgtaaaactcggaagaccgggaagatcatggagattaaatccgacgaattaaagccgaatcgaaagggaaaatcatgtagaaaatgatggaaaatcatgtagaaaatgatgagcgagtaatgagaaatcgatttttgtaatcaactggaggaggaaacgcacgattgatacaaccgcggcgggaaggcgcgtggtgcaacagatcggttgatcgggaaaaaacagatagaagtaaaaaaagttgcaacagatcggttaggatcggaaaaaaccagtggcaaaaaaaaaccaagctgcgtatttttttaggttcggcccgggcggcggcggggagacgcgaggtgcatcaatttggatcgggaaaaaccaaggacataaaaacagatagaaacaaaaaaaagtgcaacagattcagtttggaaaaaaaccagctagcaaaaaggaccaaaattaacccgaggcgcctaccaagtagatcggaattgtttcactaagtagataaaaaatgtttcaatcgtttaaaaagctgaaacgcaaccaaatcacctcatgaaacattttgctaaaacgtatgaaacaatggtttttgaagctctttcaacatatataaaacaatgtttcagcaaatagcgaaaggacctttcactacaacatttaatctatatatatagtgaaatatcatgagtatacttgctgaaacattgttggtggaaaaaaaatgaaacggatttccttaataaagcgttatcgtaatatgtgggtgatttgttgcaacgacgcatgtggtggcactacgccagatcctcacagctctgacgggatacctgtgacgggcaaatgatttggtcactgatgaccatcacctttgacgggtcatacgggatgccgtcatcagtgaggcatccggccgcggcccgtcacgggtatcccctcacctgtgacgggctgaaaggcaaagccgtcacaggtgagacagtgatgggttttccaacccgtcactggtatcccctcacctgtgacgggccgcggcattataagccgtcacaggtgatgggccgccacctgtgacggatttgttttccggcccatcacaggtaggtcgataccttcgacgggaaactcaattgaagcccgtcaaagttatgaccaacacctttgacgggtttttttacctaacctgtttgaggtgtgttgggtctataaataccccctaaaccgtcaactgctttccatcccgacaagttcactgttcacaaatcgttgggagggcagggggcgaatttttgctaaaattgaaggtaaaacccacattattctccattcattctcgatcgatcatcatatatttttcttcctatgttgttgatttcagatggattgtagttggatgtaccatgttcatcgttcgtctacagagtatagagagggggtcactgaatttgtcacatttgcagagaatgacagaaaaagtaggatgagcatgtacatattgtgtccatgtagggactataagaatgaaaagatgaaccttgatagttcagaagcgcattctcatttgataacgaatggattcatgaagaaatatacatgctggaccaagcatggagagcaagaggcgcctgatgccgcaactgaagaagtgttggatcaggatgtagagaacaccgccgcagctcgagaaggcatgttcgtatcttctccgttaggtggagagaccatagatttggacactcaatgtctatctacaatgttgcatgacattggagacacagaggacaacgacagagattttgagaagtttagtaagttgatggaagattgttagatgcccttgtatgatggatgcaagtcgaagcacaacaagttgtcatgcgtgttggaactcatgaagcttaaggctagtaatggctggtccgacaagagttttacataacttcttgagttgttaaaggacctgttgccagaggggaataaattaccgcatacgacatatgaagcgaagcaagtattatgtccgttgggcctggaggtcagaagaattcatgcttgtccaaacgactgcattttgtattacaagcaatacgcagacttggatgtctaccctgtctgtgggggcatctagatacaaacgagtaaagattgaaggtgaaggaagtaattcaaagaggggaggccccgttaaggtggtatggtatctcccaattgcggagcgcatgaagagaatgtttgcgaataaggaacaagctaagctagtgcgctggcatgccgaagaacggaaagtcgatagtgagctgaggcacccagcagattcagtacagtggaggacaatcgataggatttaccaggaattctcaaaggacctaagaaacatgcgtttcgccatgtgtacggacgtcattaatccatttggtgatttgagcagtcgtcatagtacatggccagttctgcttgttaactataaccttcctccctggttgggcttcaaaagaaagtatattatgcttgccatgctcattcaatgactgagacaacctggcaacgatatcgatgtgttccttgaacgaggtcaatttacgctagagcttcactgatgtggttgactatgtcaatcggtgtttatgggcccactaagacaaggagtacatcatgtgcgcacacaaccaggagtaagaggacaatacccttcgtgtatattgtttttgaagttaaggttcttattactaacgctacataaccaccgcgtaagcaacattggattctcttagccattgtacctaagtggagtagggttacctaccttaaatccaataagacgaaatattatgatttcattgaaatcaccaaggtcttaaatatggcttggggcccatatgtggaaaagggtggtaggcacaaggagggcaaggacgaactttatcataaccccaagtttgcatgcgcacaacatatcggagaccagtgtggtttccacgtgtgccacaacatgttaacacttctaagagaggtgaaagattttgaccctgaggttgttgttaatggcaaataaactcatttcaataccaacattactattctatacgtgctaacctctgatttattaaacagaaaggtagagatggcttgaagatttcaccctcaatccccttgctatcagaggtgaagtgtacgccttcattcttgcagaaataatgaacaagaaaggacgttttcacgtcaaatagactcgtgaactgggctagatgtgatgtcgtgaacaatacagttatataatttcttgtgatgtaaaaaaagttgttttttatgattctacattatgagtgcaatgtaatttacttttatatgtgcaatatttaggtagtttgctaaattgtcatcaaatttgatcaactacgatttacgttgtactattcatttgttttctcctttttttttctaaatgacaggtcgtggaggtcgaggatattatggctttaatccatttggtaagtatatatgcggttctatgagcaatgaccgaaattgtggcattcaagggtatgaatttgctgtgcaaaattgtggcatttgaactgcatatgtgaatgatgtcaaatcttgagatggacctgtgatgttggggtctgtgatgtttgagatggatctgtgatgttatattaggggggtgactggaatttacctgtgatgtttctatgtttcagagggcatggctagcaaatcctgaggctagctaatatttagcatttatttttttctagaattaacacatcagtgacgggtcgtaaaaaaaatccatcaaaagtaacctcacctctgacgtctgacggactcgcaaacataggcccgtcagaggtgacccacctgtgacgggcctttacttttgggcccatcacaggtgtgccacctgtcacagcttctatctaccggagaccatcacctgtgacggcctttatttggaggtccgtcagagatgtgtcacctgtgacgggtcctaattggtcctaggctagcggagaccaatacgtctgacggccttctagtaacttgtccgtcaaaggtaggtgtcatctctgacggccagccacccgtcaaaggtgactggacacaccagtgaccactgatcactgaccaagcccaaagccgtcaaaggtgagggtttgggcccgtcacaggtgaccttgtccagtgtagtgtggggcgcgtggtgggaacagcgcaggaggcatgggaagcagcgggcgcccgatttttctgtcgctgatcgggcgcccaatcgctggcattttccaaattaactggaagatttgccaaatttttttttattattaggtaggtatagatatagattaattggattggatcataccattaaacttgaggcagcaagtctctactattataaaaattaaagatgtttttgccagtattttgatacgtcagtaggtttttaagtttgttcgcttttagaaatacaaatccgtgtttgagttgtattttaagctcgttcgcttttggaaatacaaaaggagtcgtataaaaaatatcattaaaaaaacccgcacgctaacttgagatgaaatacagactcttgcagttatgattttcgaaaaaaaatatctaagtgaattcccacagtgaattttaccctagctaaaccgtataacaacaataaaattaaaataatatatacccattgcaatgcacggatattgtttttatagtaacacatacgtttttggacctagtccgatcgaggtagccagtaccgttctcacgagttaattattgtcttcatgggccaaccatagaaaaaacatggcaacacaggggatctagtctcgatcgatcatcgtacgtgtttcttaattcgtacttatatgaggagcagaattcagagggcaaggacgccacatgctgattgtgtgaatgcaatgcaatagtacatgcatcaacacgagcaaaatttggtatatgtggtgcactattgttgtgaacaattagtttcatgtgcctgaaagcaccagcatatactacgacgtacacctaattaatttactagcttgactttatatatccttggtatatatagaggctggattattaaaaatccattatctaaaaaaataatttactagcagacgtgaaaagggaaactcttttctttccttaacaagatatatcccttatttttatatgacattctcagataattataatttttcttaaaaaaaactagcatgatagatcaatatgagatatgttacttcacaaacacatgtaaatttaaattcaatctacacatatagaaacaaaataacaaatttcagtatgaatagtacacacttcacagttaattttttttctacttatacaagttaaatttgcatgtatatagagtgatatatcacatattgatctatattgttattttttgttttttttgatgattttataggtgatatctactacaaatatatatgcttggtaggggcatgcccaagtgtccattttatgatgggaatactccgaattcttgatttaaacatcgctcatcatacggctctcaaacttaattaacggaggacacaaagaaaaatccatggagataggtacatagagggagctatttgctagaagtagacaccacccgccctatgaagaaaaagtgacatattcaatcctacgtttttgttttttttttcaacggatgaagtactgtactggtctgtatcgtatctgctcacaaaagttgggacagggggaatgaaaaagccatcggtggaatc

SEQ ID NO: 60795 - DNA, 936 bp, Oryza sativa
gcaggttcccccatggcggactccggcgctcgcaggcagcctagcttcaccaaggtcgaccagctccgccctgggacccatggccacaaccttctcctcaaggtcgtcgactccaagatggtccttcagaggggcggaggccctcagggcaggcacatgcggattgccgagtgcctcgtcggcgatgaaaccggcattattgtcttcaccgcaaggaacgaccagggtactttactttctatatcctcctcctctcttttatctactactcctcttctagactactcctatctttattcattctgtcattgatactcgtcttttgcttatgaaagatacgtaacagtaagtcttaatattcccacaatagccaaccgtgaccagcaccagagataatgcttgtatgattagttccctttgtattcatttctcatcatcttgcttattcataacttgatgctgtaactcatggagattgttccacatatattgatggagggcttctgctaaattttttttttctggttcaccagcaatcctttaacatgataataacttgctactcccaaatctccatctccatctcaacatgaagtctgctcttctgtctaaagtgctaccttgactacaagttttcacccatgatggtagtattaattggtgtcacaaatattttccagtcctttaatggtacttgtgtaacttatgctaaatagatgagaacgatttctttgtataaagatatcggtcataaaactaataagattggttacgtgttctgggacaactcattttcccacacaaggagcatgtattccttggtgaaaattgagcttgtacactggcgagcaagtcatgttgactgtatgttgatttcataattataacatgtactccctccgtcccataatataagggattttgagtttttgcttg

SEQ ID NO: 60796 - DNA, 4799 bp, Oryza sativa
caccaccaccactaccgccacccagaaattcaccatcgcctcctaaaccgccaagccaagcagcgcaatcgcctctgcccccgacaacaaccacgactacgcctccgactgctccagtaccagcagcagcgcctcctcctactgctccctccccttattctgctccgtctcccactcccactcccacccacacccagccccgcccatctccgccgctgctgcctacacctgccactgctgctgaccctgccaaccccaacaaggccaggcaccccagctccaacaaatcctccagccctgctgctcctcgacgcactaactcctcctcctcaccgcccaaccttgccattgctgtcggtgcagtgctcgccatccttgtgcttagcttattaggagctgctatatggtacactaccaagaagaagaagaagcagcgtaggagggataatggctaccgtgctggattcatgtcacccacttctcccttgtcttctcaccacccatcatcaggatcaggtactgcactcctcccatcccttgtactactgccattttttcagttttcacacctacttctattcctcactctacaatgtaaaatgagcacaaacttccttactgttcacacattttcaactgtccttccttatagaggtaccgcagtaccacaaagtaacgctatagaagctctcttattgtgtgattctaacattttcaccatgacgaatttcagcatgtagtcgttactatctttgtcactttttcttcaggtgcctccgcaaatgtaggatcatcgttggacccttctttcaaaacaaactatagcgccggaagtcccaaactgaaagcatgcatgtctgatattagcatgggcaattcccgcttcttcacataccaagaactgtaccagattactgatgctttctcagctcacaacctgctgggggaaggagggtttgggtctgtatacaagggccacttgccagatggaaaacaagtggctgttaagcaattaaaagatggtggtggacaaggggaacgtgaattccaggctgaagtcgagataattagtcgtgtgcatcaccgtcatctggtatctcttgtgggatattgcatttccaataaccaaagggtacttgtctacgactttgtgcctaataacacccttcattatcatcttcacggtatggtttaacctcttgctacattgtacatggccatttcgttcttctgcaagtagaaactgaaacatgtattgaatcaacctgtaatcacaggacaggggaggcctgttctagattggtcggctagggttaaaattgctgcaggtgctgctcgtggaatagcgtatctacatgaagattgtaatgctccttcctatttttgactatcttcacggtcattattccattatttcgacctaccttgtccctccacttatatctccatttttcaggccatccaaggataatccaccgagacatcaagtcctcaaacattttgttggataataacttcgaggcacatgtaattatattcccaaaatgatcccaagtgcatctctacactacatagttaatgtaaatgagtctggccatatctcatggcctacttaatttgctgatttgatcctgtccatgaattctaggtggctgattttggtcttgcgaggttggctttggacgctgtaactcatgtaactacccgtgtaatggggacatttgggttagtgaagtactggcaattttcagaagcagatctgtcgtgatcttacagagataattaataaaattcgtttttccttgcaggtacatggctccagagtatgcatcaagtgggaaattgactgagagatctgatgtgttctcttttggtgttgttctcttagagcttatcactggtagaaaacctgttgatgcatcaaggccattgggtgatgagagccttgttgagtgggtgagttatagctctggactgaaatcttattgcttaaaatggtttacttggtggcatatttttagttctgatactctataatgtccttatcggtgaattttttatctgactattaactggagatctcctagaatattgtttgttcactgggattggcttaagtttctattgtcacgtggcccttctttcctagtattttgatggaatgttgtcactttagaagttaagagggacatttagtttgaatgcgctatttgatatttggagtacccgttggctgatgagcggctcaaacaaatgtggaatactgtaaaataaatcctatgtatatattcagagaagaagatttttatcggagttttttttttgtatatgtatgtacttgtgtcatgtcgtaaaagctagtagctactaccctgaactgcacaatcgctacctgactctggttctcaactactgtatgcaataacaagacatcactaacagctaaatgagctacatatcactcaaatagttattttgttgtccttcaactttgcaaactcttgacatttcttgaatccctattgtttgcaggctagaccattgcttactcaagctattgagacaggtaatttggaagagttggtcgaccccaggcttgagaggaacttcaatgaagctgaaatgttccgtatgattgaagctgcagcagcctgtgttcgatactccgcatcaaggaggcccagaatgagccaggtgcatataatatacaagctacgtttggaatttgtctggaaacatttcatttttttacatgaactgggaacaatgctttgcattccaatctgcgcatacgaatagtgcatttcatttcaattggtactacggttgtggttttcagtctatctagaagcagttatcaagttaaaatcttgatttctttcaggtggtgcgagctcttgatagcttagccgatattgatcttacaaatggcgttcagccagggcagagcgagcttttcaatgtggcgaacacagcagaggttaggatgttccagcggatggtgctgggcaaccacgatgacagctccgacatgagccaatacggttggagcagcagtcgccagtagaggtactctactcatagcctcaagctccaggatcctgtagcgtgcagtagttgctttctttgctcagtattgactagtctattcttcttcactcactaatccgggttgaattgggtatggagtgtccagtgtaatccttactatgttagggctaagcaaagcgaactgaattgattgtttgattgttattcgcagaagaatagggtggcgaattgagtgctcccgtaacgtgtagatcgatcatgtatgtacacatgaactcattcttcttgtttgacaaaattatggtgttggtcaaagcacaaaagcacacacgagatcatttaagcttctagatgttctctttctctgaatttttgatgttgacgccaagaggaggacgacgacgttagggcatcagcaatgtatccttcccaagtagtaaataaggtgggaccaaccaaaagcaggtaattgttattcaagatctcacaatgtataggaggtaataagataggtcccacatgtatataaaaatctaaaagtatacggtagtatggatagagaagaaagattcaatacatagctgagagaatcaatgattttttattccttactagcaggtcatagcgctattgcttggtatttgttgcttactacctccacaatgtttactacctggtattaaggctgtatttattgcttactacctagtttttgagcacattatggatgccctatggtctcatgtggcgtctcaactgaaccacccacaagaaacgaaacgtcgtcgtggtggtggctaacaagttacatcattttagaatggaataatgctgcctgtaagtgtaacaattaacgccgaatgtcttgcctgaccaaaaacaagtgttcctgatttccaggccatcaaatttgactatcacacgagttctttttaggtgatcacatcacaaagaaagagccattggtgaaccaaaatgaaaacaagaaaagaatggaagtatctttattgttcctgaatgaatattaatgtgtgatgatgaaggaacaaaacaagataaaaatggatggtacgtacgtatgcgtccgctccaatgtacttacatgttgtcgtatgagatgagcaagtagggttaatgtacagttacaaggctagtactaggcttcagctagtataaattttgtacacgaaaaagggaaattgatttggatgtggaaaaaaaaatggtgctgttagtgaacagtagctgcttgctagactatactattactaggtagatgtggtttgtgaatgtgaatgtgattgggaaggaggagggaggtggaggtccctggcgtcgcggcgggcggagacgccaaccccggtggacctgacggagaactggcgcagggcgtggccgaactcggggtcgtcggcgttggagccacggtgctgcagccactggatcttgttgtggtagtcggggaagaagcgcgtcttggcggcggagtaggtgaagtaagggaggagcgcggcggcggggacgagcagggtgaccacccagtaggagggcgcggcggccaggccgtcggtgaagagcatgaagtagttggtggagaaggccggggtgatggcgccgtaggcgaggaggaacacgtaccacagcgccacgctgccccagatgcaggcgtgctgcaccagggtgaagtagttggccgtcaccgtcatctgcgcgttcaccgcccacaccacgcacgtgtaggcggtgcc

SEQ ID NO: 60797 - DNA, 3075 bp, Oryza sativa
tgtgatgttcttgtagaagaagtagcagatcatcgccgatatcctgctgtaacaccagtgaccatggaccagcagcagccgctccaggaacctgaactgcgcgatggacacgtcgctcgccatcaccgcctgcatcccttccgcgccgctgatcccgaccccgatgtccgcctcctggatcatgcccacgtcgttggcgccgtccccgatcgccaggctcaccttccccgtgctctccttcaccagcctcgtcaccagagccttctgcttcggcgacgaacggcagcagatcaccgacttgcagcccaccgcaaggtccatcaacgcgcccttggcatcctcctccagggcatatgtcagcgacttcccatcgatgatcaaagcaaaggcttcgccaactaccgatccatctatccgcttctttccctcgttgatttgcttcaccacgttttcctttgatgccttcgcaacagccgctttgtcgccaccgcctttctccagggcgatgatatccggttgctccagtgtgatggttatctgcgtcataccttgtctcagtagactgcacgcatacccgatgttgatggcggtttccatcttgtcgcccgtcagcacccatatcttgataccagcttgtgcaagtttgtcgatgcattcaggcacctaacaaattataaaatcatgaatgacaacagctatatatcagcaaaccatgcatgcatgatccatgatgggggaatcgaagatatatagatttttttttttactcagcaaaccacttacccccttctgtagtttatcctcgacagcggtagcaccaagaagaatcaatttcctctcaagcaaatccgcagcctcttcaatcatttcatctctatcagcactgacagagttcttggctgcagtgaacttcctgtcgaaattcgcatattcggcctcatcaagttggcggtatgcgagaacaagtgttctcagaccagcatcagcgtattcatttatgtgatcctgggtcacttctctgtacgcacaatcactacttgatagcctctcgaacatcacactgtatacatatatagtttttgagatcaagtcaatacatggataagaattaggggccgtcatgcaagcatattgagcaaaatacttaggagttccagcagaatatatactgacctgtcagcgcctttactaaagagaaagatcttcccctcctcattcctaactattaccgacatccgcttccgagcactgttgaactcaaggacatgcaagagcttatatgatctgccaaggaaattcaggaaaatattattagttctgaatctaatttcaaagaaaaggaaacaataaaaagctcactctaataagtggagtacctgtcgacttgttttccagacgagggatctaactcatgcagaaaaacaccggtctgtgtcctctggtaaaacgtgaaaccgagctcccgtgcggcaacaacaaaagcagcctcgtcaggtgactctgcttcataagaaatcgtgcctgattcttcgtcaacttcgggtatgcacgtatggcaaacggccaacaacctgaggaacatctgaatcacaccagagtggggttggctaacccagttaccgttcatcacacgctcatccgtgaaattaaatcctttgattgcagcttgagagccttgggtgttgctggccatgtcggcgatcaagggagaaccttttcttttcgccattgctctctccacctcagtgataccacggccatacgcagttccggcaattgagcatttgatgaactccatggaattgcaagtcagagtcccagttttatccgtaaggatcgtgtccacttgacccaactcctcgttcaagttggatgttctagcatgagccggtgtgtcggtctcctcatgatacatatgaatgtcttggttgatgaacagagcctgcagaagcttgacaatctcaatagagatgtacagagagattggtatgaagttcccatatagcatcatggctgtgaagaaatgaagtattgctgatatggctgctttggttggcttgaagtagatggtagagtcgtccggcctaaggtaccatcttttcggcctgccatcttgtaggtcatctctggttgtgatgccaaagaaaaccgatccgatgactgaaatcaggacaagtgcagacaaaagcaagtagatgatccggtccatcttcctttcaatcttacttctcttggatggggctttcatagcattctgcatgacctttgtatcatggcctgtgaagatgaccacaccgtacacatactcggtgttgcgaagctttgagtctctgagaaggatctgctggggtgacagaggatactgttcttcgatttcgatgttgccaacaaaggaatagaggtgtggatttgggtcctcacaccttattacagccctgaagctattgaagctgtcatcctcctgcaagccggatgatgcctctagagattgcttgagcttgagatttgtctccccatccaggttcatggtctcaacatagcaaatggcgtcttcgtagctagatgagaggaggattaggtcagcagggaaaaactcatctttttcaaccttgacaatatcaccaacttggaggttcatccatttggtagaatggaaagcaccgtcctggagcacttttgtctttctgttgtttacctcggtatcctggatgaaacaaacaaacaaacagttggtaagatttttcagtagctagctagttcaacaaatctaaatactcctagtagtgatgaaattgaggatcagttatcatttgcataagtaattgcctattatatggagtagtatggttgatctgtttctgcatgcatatgcccttaaataaaaatgggtaaaattgggcgattgcttgctagcaataatcggctagggaactactagtactactccctagtcctactggagtgaggagtatatactactggaaatactagattagtagctgttgatcgaatggaaattaattaaggaaatgaagggaagaaagtgacctgctgcttcctcctccagtcttcgat

SEQ ID NO: 60798 - DNA, 3857 bp, Oryza sativa
ccaacagggacttgggcacgaaggtgaccacgttgtacttggtcgtcgacaccgagttggagcggtacccgtactccgggatgccgccgccgccgttggcgttgacgacgcgcgtgaaccccggcccgccgatcctgctggagctttcgtcgtcgactgccgtcggcctccgcccgcacgcgaaactgtacagcctgctcagcctcatcttgctcctccgccggcccctccgacgaccatcgccgccgccagttgccatcatatatatggatggattttgccaactactcctacttactagtagcgacgagctagatgatgttgagcttcttttcttgccggccggctattccttccttaatactccagtacgagctaggtagcaacccaagaagaagaagaagaagaagccgctgccgcagaggacgaagaaatcgagggaaaaccaggctcaagggcagcctatcctaccctcaggcctcagcagctgcttccaatatgtactactcctactacttctactactactactacaagggagggatggtttgttcctatacatatggccgggcagtgggcttcttctcaatttcttaggaagctccgcccctcccctcttttcaggtttcacgcgggtctctcggtcagcaacggagaccgcaacttcttccccttctcttcttgacaattcacaagaagaagaagatgatgaagatgaggagggagtgggagaggcggtccgtcttttggtcgtacaagtgcagctgcctcttccttcttcccttggtttggatttggagatggagggacggttgacttgcgggttttttcttttacttgtcaattgctcgcctaactagaaaagattcctacttctcatttttaaactaccccaatattttactaggttttaaggaacctgcaattgaggggaactaccaactactccatttttctttaatactcccttcgtagtttattttttttccataatcaaactttattaagtttgactaaatttataaaaagatttagcaacatctaaaaggtcaagttagttttattaaatctaaaattacatatattttgatatatgtttgttttgtgttgaaaatactgctcccttcgtcctataataaagtactaggatgggacatatactaatactacgaatttaaacaatagtcctaggatacgtcctattcggttgtaggttgttgtattctaggacgaagggagtattatattttatataaacttagtcaaacgacttgtaatatggaacatatgaagtatatgaagtatgtaggagtacttacaattcttagaaggaaatgctttagaaaattctagactagtgttcttttctttcattttgctttgggatttacgcacgatcaatgatggtactaaaatggtaaggccatttgaaacgaggatgggggaaaacacagtaatatgaaaagccagtaatagattgttatattcatttgattcatagaggattttgaaacatagtagttctaaaactgtcatttgattaacacaggaaaagcacatgaattttagatacatgataagtgtttattttccttcaaaattgctttagaatagtctatttcacaagaatttaaaaaggaatgggtagaaatcaatcctttgtttcaaaagtctccctagaattatttctcataggataaaatcctctgcaattcctatcatttttcttttatttcaaagaaggtctaaatggtgttcacgaacagtacttgcctcgtgacggtcacaacctgtacaaatggttagatttatcacatcgccgatacaggtgttcgtctcatcgtagatagaaaggagagtaacgatagtacattacgaacccagccatatgaatacatacttagaagtatcttaactgtattatttttctttgtccaggaattcaaagcagaattatcattttctaatgtttatattatattagggtataaatttgaatcacaaaaatatttatattttaagtgtatacaataaattgaaagaagttctacacaaatcgagaagttgactagtggttctctcagaattaccttttctcctctttcaggtacttacctcagaattagagctgcctgatacactcacatggccatgtcggacctagcttaactagtagcctcatttctttcaattctagcataaattttctgatttgctactgtgccttactctcacatgatcttggtaaaaaaatcatgtttactctcccagtctataaatcttcatattaagtaaagaagaaaaagtttcaaaccgtggattgaataaacagagtccaagtatagttacaattaaatatatgaatatttagaataaaatagaatacaattatgcatgtgaataattaaaatttagaataaaatataatgaagccaagcatttttacaacacaaattccaaagtaaaattttcacaaaaatacgaaaattagcaattggattgccatgcaaatttcataaaaattccaaatgatagaatctgggatataatattaggaatattaaaaatagttgatgttaaacatgaataatgggaattgataataaaaagtagaatatatatatgtgtgtgtatattactttgaaacctttaaattaaaattactctactctaaggaaaacattaagcatccgtagtatcgtgctatctattagaattaatgaaaataatgatggagaagagtatttgaaatcctgaaaatattacaaatctatgaagcttggtaataatgaagtgcttatagcgagggattttttttcttgtttgaaaagggttgtagactatcaagaatgtgcaatacaatatgccatcttttgtaagtggaagaatgccattaaagagaacaattagtttgaaggtggtgtatacaataaagttttatcttcaatctatcttattgctaagagaatactaaaaagagccatcacgtttacttaatggacataggaattgccatattaaatcggaatatttaaacgtaaaagttaaagtttgctccatggtctacaacttggaatggaaactatggagttgcaggttaaagtcttggacgaaggagatgtttagctgagaattggaatattcattcattcggaagaagcttgaatttttgaaatcttaagctgttcactagttagttaaataatgaacgtgctaaagcagtccaaattttgacttgagcaccgttataacttttttttttggaaaaagaagttctctctccggtcatgaatatctaaaatttaggataaaacttttgaaattttgacaatattttctcaaatgcttaaactaaaaaaatggtaggcacacatttgcaacaccataaactcgttagatattataagttattttaatataaaatttataaatagcgttatcctatatgtcaaatattgatgactcaaaggagtattgagcagatttattcgtgccgtttttacaatatactcccccgtctctaaatatttgatcgttcgtcttattcaaatagtaattattaattcttttttttatcatttaattcattgttaaatatatttttatgtatacatatagttttatatatttcacaaaagtttatgaataagacgaatgatcaaacatattttaaaaagtcaacggcgttaaatattactacaatatgttatcaagatcaagtatgcggttgaagaaaagaatcacattacaaaactgcagtagtactgtatatcatctttcaaggctctacttaaccccctcgaatattcgcgctctcgaatattagcatttttgaaacccaaagcactcaagaatac

SEQ ID NO: 60799 - DNA, 6362 bp, Oryza sativa
ccaattacataattgaatgaagaccaagcgtgccagattgtacatgaggccaatgttttgtttttatatatgcacagcagtaaaaggccaaagttaggccctgcttagtttcaggggtgaaaagttttggcgtatcaccttaaatatatggacacacatttgaagtattaaatgtagtataacaaaacaaaatacatatttctcctgtaaactgcgagatgaatttattaagcctaattaatccgtcattagcaaatgtttattgtagcaccacattgtcaaatcatggcgtaattacgcttaaaagattcgtctcgcaatttacacaatctatagttctttttatatatttaatactttatatatgtgtgcaaacatttgatgtgacatgatgaaatgtttttttatgggaattaaacagggccttacattagtactcctgtttgctaagaagtgtacgtaccagacggaccgttttagatctttgattttgtctcaatctattactccctccgtttcaccctccgtttcaggctataatatgttttgattttagtcaaaagttaaactattcaaatttaactaagtttatgcacaaatatagtaatatttataatatcaaattagtttcattaaatcaataattggatatatttttataactaatttggggtgagttgaaaatattattattggtttttataaatttagacaaacttaaaataatttgactctaaccaaaacctttaacctaaccaaagtctttaacctaaaacggagaaggaagtagggtggagtaagtcttatctctaacttgctcttaagaaaaaggtgacacgtacgagtcgtccataaaacacgatggttggacttggaatagtataataataatgccagccatgcatgcataagcgctgacgaaacctcaattaggccacgttcgaatctcattgagacgaagatttttctagattttcgttagcatatatttcaaaccattagatagtatgtttcgtacaaaatttatatatatatatatgagttgctttaaaatattaaacaaatttatattttaagtttaaaataattaaaacttaattaattattatatgttatttttttccttgcacaaacttaggcctagtcctccgttcttttcttctctggcacatgttcttaaaaaagctgaaagatctctgccacatatcgttagaaaaactgaaaaatgcagtatgatgagatcaatttcgcgatctatctatctggcgcagtagcatcgacatctatctacgttttgcacttctgatgaaaaagtcaatgcatgtatgcattgagacgagttaggtgcagggctgcaggccgggttgctcaagtggcattaattaacaccagccaggcagccacctttgattgaatattcgaatttgactttgaccattaacgaatcatatgcaattagtaacttccatacaaaactttctctattctaaaaactgtcaaagtaattttggctcatgtgccggttttccgattgatttcaggaatctattgtcacacctagaaattctcgaaccagaatttctaagctgaatgtgcattaaatccctgtccaggaccagccaggatacacaaacgacaattgttgacatacagacccacgtcttacaaaaatataaaagattacaaatgcaacggaaaagataaaagcgagctaaaccgggaagcttgacttcagcagcgggcgactccactccacaggcaaaccttgacggcagcgacgaaaccaacctctctgagacggctccaactgagaagaacttcaactctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctctagtaattaatcaatattaaccaatcactgtccaacgctacaccatgttgcaacaggcccaaccaaccacctgaactacaccagttcattaagctaaactaggggtgagactaatcacggtgaatttggttgatcgcccataaccgcgggcacggctattcgaatagttttactctggccagaggtgtacaactgtacccacaagacaccattccacacatgtcgccatgccccgaagtatcaccatgatactgcaaagggggaaatcgtgacaagaccctccacataactctcccctaaccatccacaccacgctaaggtttcacccccacccctcaaaaggtagtgggcggtcccctcttgcgccgcggtgaatccggcagctggacaaccgaacacctcggccgacccaactccatcacgcccaccctcgccaccggtgcctcggaaagggtcaagctatacttcagatcaagcagttacccactcccgcttgtggtaagcacagtaagtctcccagggtttcccgtgaaccggtccttaactgccatgggtgcgaccagcaaaaccatgcacccacagcccaccattcagtgcattttaattagctaacaccattgcggtggcaccaatccaaaactatgctaatagacaaagtctatgtaataaggtgatccctttttgtgtactagttgagctaagcatggctaagcatttcctaaaccaacatctaattatattgatacccaggttatcaatggcatgtggtaaacaataaaaggctgagtaataggacccatcccatatgacattgtaaaagaatgcaacatttaatagaaatgcgggacatttgtaaattgggtacaatttgatcaattgtaatgcatgacttgccttgctctcgcactgatgagaccacatcaacgtcttcgagaaaccgcggatcgacgaaacagtcgaaacctacgcgacaaacaaagcacacaagcaaaacatgcatttttcttgatttactgagacttgaatggacttaaacggagctcggatgaattacttatgaattttagaagataaactgtgtttttattaataaagaaaaagtccttaattaattattgcgcaataatacccagggctaacgtcatccaggggggcggcgccgacaggcggggcccacgggtcagcggctcaaaggggagaggaagggggcgccggcatgtgggccccacgggcagtggctcaaggtggccggtctaccgtggaccgggaccacgcgggtggtccaccgccggtccacgggaccgacggtccggatcggccgggaggccgatcggacggcacggcggcggctaggcacggctcggctcggcttcaaaaccagccggccggccatggcaaccggcggcgacgcgcacggtcgccggcgacggcaatcggcggcgcgggaagcgacggcggacggggtacaggacagcggcgtcgaccgaaggcaacggcgagcgtgtggagagaggcggcgcaaacgagagagaggggaagagggaggagggggatcctcaccggcgagtatggcggccggagcggaggatgaaggtggcggcgacgacccggcgatgaggaggggcggacgggcggcggcggcacctacggagggagttgagaaggattaggagtagagagagtgaccacggcggccaccattgttggccggagacgaaggagaatggatagctcaccggcgtgcgaggagaaccgggctccggtggggtttagtggaaactgagcagcggccgaggtggctcacgcggcggcaatgctaatggcggcggcggcttggcgtggcggcggctctagcggctgcggcgcgcgaccggaggtggcggcaagcggcagcgctagtggcgagcggcgcggcggcggtaggaggcacgggagagcgcggcgaaaaggggaaaagggagagggagatgcggggaaattttataggggctcgagaggggcggacatggccgggaaaccccccgatttggccgccgacgtggggggagagagagagagagtgggggggattcaaatcgaatctcgcccatttgcgggcgcgcgcgcgggcgggaatggcagggagggcggcgacgtggggactcggagcgggggcgcggcgtggagcgaagaaggcggcggcgcggacggtttcggcggtggttgccgtcgtggggcgagcggctggaggaaggggacgacctgacaggtgggccccacctgtcagcgtcccggagagaggggaaaggggaacgggccggcccaaaggaaggaggccgagcgcgggagggagtgggtcgacggcccaatagagaaaaaagaaggaaaagaaaaagaaaaagaggaaaggatttttcctgggatttaaaattgcactttggtgatttttaattggttaaaattatttccaaggctctgaaaattccactaaaaatcttgttaatgcattggagcatggggaactcaagaaaaattccaccacgctatttccgattattaattgcatttattaattagggatttagctctaggttaattaagataatttcttcgggcaatttatttaaccaatttttaaagcaagaaaaggggggaaacttcagggtgtgacatctatccatattttatttgacagtagcaaaatttatgagatacttaggccctgtttagattctaacttttttcttcaaactttcaacttttccgtcacattgaactttcctacacaccttttctgtcatatcgtttcaatttcttcaaacttccaattttaacgtggaactaaacacagctttactatgttccatattcatcattatataagcttttcattaagataaaggaagccttaacttcctcacatttcatttaatgtaagtacgaggtgaagaaaaatcaagaaacatgtagacttttaactccccatacacaagaaataataagagttttactaccctcttttgatatgagtaactagatcctgatcaaatgatatgtattgataagttgattgtggagaactcaacgttgatgattcaaaaggttccggccagaacgattgatcccctctcaatcactacaacactgctctattggttatcaatcgtaccgaaatgcggttgacatcgtcaagtaggttatctcctgcaagcgaatcgagagcacaagcaagagagtagaaaaaacaatatgaatatatggcaaatattgaagccatataccaaactaagcagcgaaattgcaatagcagaataatctaagcaaagccctcctaattcattaatttttaaataaataggttctagggtcgaccaaggacccctagacgcgtacataatagatttcaacacgatacatgggccgatgacccaaaagatagtgacaacccacctggacaaattctagacaccaacttgttttgacgatttttgttgacttggaaggaatttctacgtaagatcaggtccattggaaggtagtctaattagctttccatgtatgcatagaacgtcgaaaactaagtccgaatgagatctggacaatgattttaatgcatactactcctagatctcgaggtgggcttgaacttgatttgaattggatctccatctcctagcctctttccaagtacttcttgattctcccactttcatatacaaaagagtgatggtctcatcaaatttttaattttttatatgataatcaatatggaacagaggaactaggcggagctagaatgaaatgaagaagaatgccacttgcttaatttactctattttaaatcacgtttaagcagatgcgggtgcctaaatttatattgtgggggcaccacctcccattctctacctccgccctagagaggaagtaatatggtttagctaaatttatctcgatagacttttgttcctattacagtcgatttttcagccactctccatttttttcctttcactacaaaaatgcccacgcgttgcaacggataaaagcatttttggatcgcatacattatactctttgctttgggctaaaagctcatttattccttccttttcagtcccagcctagcccgttaccttcctctgattagtctatctctctttgacctagcccacaagtggagctgtaggcccaattcgcatagccgactgccgtcatcaatttctagaagactcgcatagctgattgctgtcttcaatatctggaagacgtctcatgtcactataatgctagaaccgatcctcccatcaaatctgatcggatttttctcgatctcaccagattgagggcttttgataccctcgatctgctctttccgtttttatcaaataggagcaaa

SEQ ID NO: 60800 - DNA, 2252 bp, Oryza sativa
ccctttcaaccaaataaaacgaaccttctactacttacccgccacccatccgctgcaggctcgcttccagcaggaggaccacgtctacaagtccttcttaggcatcctcaacatgtaccgcttgcataacaagtccatccaagatgtttacggggaggtacgtaccttgcctcggcgcttgtgtatacgcctttttgaagaattctgtcttaccggctctctccttttgtcgttaggttgcagcgctcttccgtgactatcccgatttactcgaggagttcaagcatttcttgcctgatacgtcaaccgctccagaaccggtaactgttcctagaggtgtttcaagcagacacgacgacaggggcccactaatgccctcggcaaggaacgcgcagatcattaaggtaaatcttgaaacggacatcttgttacccgtgttaaattgcatatactttagagaatgtttccttatacgttgacaagtttatatgacatcagctttaggataagtactgcagagaacgtaatgcggcgtaatgtaaactaccttgacaagtttatatgacatcacatcatctttaggataagtactgaaacatttaattgacattagctccatgattcggggacatggatatagaatatcagagatccgctgaaacgcactggcatcggacatgaaagctactttctgtactaggatcatttttctgaatctactttttgttagacacaagttctatattttactagctatatttggtcacaaaagaacatctatggtgaaatgttgttttatccatctccagagggagagggcttatccatcaactgtcgatcgtgacttcagtattgatcgccctgatcctgaggatgatccccacagaaggcgtgttgacaagggaagggatggtaaggttgatcgcagtagaaaagattatgaaacggacgtgaaagacgttgaatatgacagcaaagatttggatggaggacaacgtaagcgcaaactagcaaggaagatggatggtgctcttgctgacacacaacaaggtggggttagcacctctacttcaccatacgacgataaggatgcattgaagagtgagtcttaatgtcatcttgtgtgaatatgtgtgcaatatggcatcttcagtgccttgcaggctcctattttccgttaactttaggatccatcttgtgttttcctccatcttagtgtatttcattaatatgtaagtaaagaaatgccttgcctctttgatgtactggattattttcttatttcttattcaaattaaggtgcatacacaaaggagttccgtttttgtgagaaagtaaaggagaagctagagcctgaagcttaccaggagtttttgaaatgccttcacatatacagccaggaaataattacaaggagtgaattgaaaaacttggtaagctggatcgatgtgttttaaaggatgattcccttatctcagggatttataagagcttgctagatctgaattaaagtgataaacctaatgctacatttctgaacaagaatagccttgctgcttttcaggtcaacgacatactgcagcactatccagatcttatgaatggatttaatgacttcctggaacagtgcgaaaatataggtaggtggcatatatagattcatttgtcacctttactttgttgggcacactttcttgatttcatgtttgaatatgttgcatttttgattcctaaagaattcctttactctgtagatgcctttctggagggagtcttcagtaaaagtaagcaacggttaatttaggaagttagaatttcatttctcatgctatttgtagagcctgtttattattagattatgattattattattttgaaatgaagggaaaacatcacaaatagttaaaatagtagaaaaaggatctgcactcaattctaaggaaggcgctacccacaaagctactacattctctagcaaagacaagtataacctatgcaagccaatatcagaacttgacctctcaaattgtcagcggtgtactccaagttaccgacttctgcctaaaaatgtaagctgatttaactctgcagtttgtgatgatttagtccataacatctgttgtttttctttcagtacccaatgcctcctgcaagttgcagaactgaccttggagcctcagttctcaatgatctctgggtgtctgtgacctcaggaagtgaggattattcgtttaagcacatgcggaagaatc

SEQ ID NO: 60801 - DNA, 1017 bp, Oryza sativa
  unsure (1)..(1017): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgctgcatcagttaagtctaatctactaagtcgtgtttagaaccataatctctagcctgcttttggattgccaataagggtttcatcggggtttcagccgatgagttatctggacgttgcatcggcttacaaggattacatacatattggatttaggcgattgcaacaaaaattttactgtttaatctaatcttgtggatttaatgacattagacctctagtcgatgtatgctttaaccatcggatcagtacttatcctgtcatattatgattagccgattggttatattattgttatatcatattatcatcagccgattgcctttatattggtatttacatcaagtgtcagaatatacattggacatatggccgatagctcaaaaccctcttgctatcggttggtatcggcatcggctggaattactccatcggcttgatagccgatcggcttattgatccgctgtttgtatatcttgtcagttgtaggatcaaactgattggcacgcccgcatctcaccaagatttggacctgcacaggagctaagcagatctcctaggctagtgtgtgtttttcgcgtcagcagggaccttctccatttccttgaccaagtcgtatagcgaggacaccagcgtggtctcgtcgccatgcgaagggatcttgaccttggcgcaaagctcctccacaaccttgtagaggctggtttagttcttgcggagggcctcccggatggac

SEQ ID NO: 60802 - DNA, 3417 bp, Oryza sativa
aactgagctacccgttcgtccaaggacgtagaacgtgtacccgcaccagcgatctcggccaacacctcccgagtaccagcctcaagaaggcgccaggcctccgccagcatttcctcctctgacaagggagcagcgggcggcgacaagatcggagatgtcacgaggacggtggacggagcgggcgttgcggcggtcgcaggcgacacgctggtcgcaatatggtcctcgctttgtgccgaggacgctggagagggcctgccaataaaaacacaaggagtcactgtcgaacacaatataaaatcggaattccgagaacgatagcttgagatttcacttattggtcctggccttcttcagcaacttgggagcaagggggagatcgctagtgccctaaataaaaaggtaaataagggctatgttctcgtcataaaacaagatatcttcggagtaaagagtactcaccttggggaatgagaactggtgcctgggggcagtgtcacccactttctcatagtgaccatgtgttgctgccactcggccccaatccgaccactgtcgttgtctcctgagagactttctccttcaaggaggcggcggcctggtgatcagcgagtggcccgatggcatccaccagggcagtgccagcacgagatgaagtcacttcgcttcccaaacctagagaagacaagttgacagaatcgaattaggcacttacgttgataatggcggacttctcggcgtccgcgaactcgtaaaaggtgttggacggctcaccgacaccggacgccggacttatcaacacttaccccacgcgttgggacaccgtcttgtcgctgagatctgcgaaaggagacaggaccatttcaagataatgaatactacgacatcaaaagaagaacatacacggtgacgcgagaacgagtaccccacgtcgagatctacgtcacgtcggcctcccccctgtagtcaaaggcagggtgagcgtgggcttggagcggttgaatccgccgggcaatgaagtcttgagcgatttcatacccagtcagaccccgttctcgcaggctgctgatggtgttgacaaattcttggagggagggagtcagaggaggcttggaggtccaatcctgagaacgctcaggcttgtcctctaggacaatcaaaacagggccgatatcttttatttcaagaaagaaccattttgacctccattagctccagggtgaagggcactagaaggggatgtaaaccgccttcatcccatctcagagacggaatctacagcatccttagattatgttggactccatccaccagagctcatagtagtatcggaagagatcaaggaatggcacgaccccaacataggcttagcaaagatgagcaaaaatgctcagaaaagcgatggagttggggttaaggtgcaaaagtgaaaggccgtagaagttcaagatcaggaggagaaattcagatggtggaggcaagaaaccacaccgaataaaattctctacaactaccatccgacctaagacgggttggggattagtacctccttcctcctgctccaggtgttcacggccggggagtgctccttccacctacaacttcttcatccctgcggtgtcggtgttggacgccccgagatccatcgccatcgtaggaccgccggagaggaagaagaaagctagggtttttcaggaagattggagaatccgagagtccgggcgcaaagagagttggaaaggctttttggcaaacggacttgaaatggatcaaaaactaccttatataagtgcactacttgacggtttatttttcgagggaaggagagatattgccaccgaaaatttctgaagcccgttactgacagattgattagacatcaaattaaattcacttatggacggttgaacttcctccaatgttatcgagaactcaagccaaaggactaacgaacccaccatagtttacgaagccgaaggactcaagccgaagccaccgggagatctcgtcgatcaatctcgacaaggatctcgccggtatcgtcggatttatctgttccctttgtactctgtggctttccatatcaatcccatataaactagactagtaatattaccttacgaggggcctgaaccagtaaaatccttgtctttttgtctgctttgatgtcatatgacgtagatcctcgtaccaacgtaccccaataccctatttatcctgtctacgagtatccctcatcgacaagtatatcacgggaatatcgggtaatggataactcatctttaattgtgctaaagaaaaaaaagtaaattacagattgtactatgtattcttaaaagttttcatattatgtcatcctttaaccattcttttcatttacaaaacaactaactttacatttcaatttggaccaccctattccatccatctccaagtctgatgactcagcaaccactctgcacaataactctctctctctctctctccattttcttttcccctttgatagttggggaaccgctagatccagcaagaaggagcccggatctagcgtcctcgctcttcttcatcgggtcgactcctacctccctaagtccctacaagcccgacaccaccgacatcaatggcgaccataacaatagtgtgcactacgagaggggaggagaaaaaaagggtggctcatggagaaagagcggtggtggcggtacgtggagtgacaattagtggttgctggtggtatgagaagtttgtagtcgacacaatcgctaaccgagtttgttattttttgatatgtgggtcaccggccattataaagaaatagatagttttgaagtaataaaaatattgagataaaggtgagagtactcgtctatgatacgtgggttcttatatgtctatgacatatggtccagggggaaattcttaattaccaatagtactccgagtatcatccccttcccttggcggcgtaaaagaaaatcccccgtctctttggcctcgtttgttagggctccaaactccaactcctagctctaaattcctactccagtgggagctaactcctcgggaaagagaaaattgcatatctaccatcgcataagatgggattcgctcaaataccattacttaaatgggcttcactgaaataccatcctcgaccaaggtgtctttgctcaaataccatcctgggcgaaaatgccccttagctcttcttcttcctccctccctccctccaatcgctaaattggtcgccggcggtccgtcgctcatgtcgtcattggccggcgagtcaaagcagggtggcggcgtgcgacggcggccgaccgagacgacacaagcgaggcggcgcgcgatggcggccgatgagtcggggcgtctcctccccccctctctctctctctctcttgtcgggatggc

SEQ ID NO: 60803 - DNA, 6853 bp, Oryza sativa
atctcatcttatgcgatggtagatatgcaattttcttggaagttgagaagccgaaaagtgtttttgtagcattcaaattaaaaaagagcaacccccataccgtaaaccgctcgtgcgccttccgccgccgccgcgcgcgccgtttcccccgccccccccacccacccaccccacacgccccgccggagctgtgccaaacggggcctttgtctcctctgctccttgcgccgccaagacgagtcgtggctgaacagaacactagaataggggaggggcggcgatctccatctggcgaggagagcagagcaggggaggggatcttggtgagcatccacatcctctttctgattcatctctctcccatcgggactacttttttctggaatttgcttgcgttcgttcgttaaccctagcttctcttctagatctggatattgtcaagaatcagctttcccttgcggatggcattgaagtttctagcttctcaaagttccaagaccttggtgctaattcattagatactgtcagtcaactggataatatgtgttctcttttgaagtttttaatagccaaattcaactatttccgataaggtccaagttaacactcatttatgaatcttttcagagttacctgatactgctacataatgtactgctgtttacagggttcaaagttggtgttgagaagcacagcacagaggtcattgtgaaaaaaaaaatctggaagcctgcttataaattctggaatccaaggatactcgctactaaagacaactcaggtatttcttcaacttgcttctgtgattctcaggccatcggttacatgagtgctacagcatgtttatggtgaactttttgtcgtctctggttgagtttgcatggttttgtatggactactgttgtaatgcaccgtagtgacctagttgcaatgtaccagtataacatggaatgctgtggctgtttgtgttgaagctgagtgcctatctcttttccagattagatgctgtgaaaatgggttggttgggtggcgtcctcatattttggtgctcagattgacttttcttgtttgtgggtattatgtttgggatactggccaagggaaatggacagaaatatgctagctttagtggacagggcctgtcatcgtatttgtttattctattgttaccttaagtccttaacatatatgttcttctgttaaaaaatgctagcctctgattatgccttcagccctccatggccttgaagtgcctgttgtcctgttggattctgtacatttcttgtggtgtagtctggcagcatttcttttgtaatcaactcagatgcagagcctggcagcctgcacggcagcatatatatgcttctgcctctaaagaataaaactaacgcttaaacctggttaggcagtatgcttcttttcatactgtctttgttttatgctgtgtgcttcttttcttattcagtttggcagtgatcattgaactgtgtcgtttctgtacttaagcaccctcccttgccgccgtccgctaccatggctgaaatcgaaactatctccagcctcgccgacgccgacgatgtcctggaaaacagggggatcaatcaggttgaagggatcaatcaggttcaatttcgtctagacgagcagatatccctcgtagctgcaacagaagtcaaggtgaggacccgtcctggaaggctcggattcaggttgttaaatcctgaactcatggattgcaagttccaaacaaaggtcaagctggacgaggcctacgagcggatgttcacagagtgtatgattgagtgtgaccaagagctcgtccctctcgaggcccacatcgccgagctgaagagactgttgctgctgcccaacaacgagattgaagatatcggacccgatattatgcagaggggtcgaggattgcagcaggtgctgtatctgcatccaccggtataactctcttttcatgctctccccctcttttctaaatcgtttttcagtttgtgttttttttttcagttctctctttttctgaatattatttttttcccagtttcctttgtatcctgagtacgagtatcatcctcctccgcaaccgcaaataccgtaccaaccagcatatgccactgctaaagaaagagagaatgcaagatctcgagaccgccgtgctcagagagcgtggtggcatgccaaccttactcttctggagactaagaaaaagatcttggaagggaaaagaatagacctggagagagggctgaggtctgaaatgaggaaagctttggagagtcaatctgacctgggggccggttataccaactaccattttcgccatagataggtaagcctttgtgtgtttcttcttagatctgttggtcttcaatcttcacttcttagaatcaaatcgaatggatggatggagggatgaactgggtggcggttcttgggcatggcttctgctttcgattgaattgttttttggattagggcctgcggattttaggatgtttatgtatatgatgaattatttgatttgagtgatataaaacactatgaattttaggataaagggtcctgtgttttcaatttgctcagcagtatgatcagtggcttgggaagcgaagctggccatgctgttgtcaggtgtcccttgcagatatctgctgcaggtaatgagacaaaaaattaggtgttcagattaggaacaatgtaggaccgttgaaccagagttgtaatttcagaaaataggcgctcaaacatgatgcatctatacttagttagagcccctgctaaccactattaccgatgctttagataaatgctgctgctattttttttcattgggatctattccgcgactgttttagtaattctactaattgaattgaaatttcccaaaagcaatccttctgttaagcttggttggactgaatagcagttttaccttggccatcagtgctcactttgagttgtcagataatgaatagctcatcactgatttttttttcagaaaaaaggtgctcatatatgcatgcatagatctctagaaaaaacggctggataatgaatagctcatcactttcctgttgatttgatgcaggggaggaataagctggttggatgcatgatcaatgggaaatcatgtttagttttctccctagatcatgatgctttgaactcaagccctgtttggattcagctataacaagttttgttgtgcaagtagtcacgtgatgtaacaagttttgcctcatgttacagattttgtaaggatgcttctctggtagcaatttaatatcatgttacagatttgcatacttcagttgaggtagatgtgagaggcgacgtcttgaattcaaattgtagcaatttttcagttgaggtagatgtgagaggcgacgtcttgaactaaagcagcctggtttgagcacctgcaaacaaaaccacacctccggttgtcgatcaatcagcttctagatttgccaaaattaatatatgaaaatcttgcaatggtcgagcacgtttaatacacgtctaataaaaccattttctatatacagacttagaacatattgtttttctcaattttatcaaaattatctaattgattgttgtggtttgtcagatacacattaaaacaaaaccctgctgaaattatctgaacttcgcattttaactccacctgctgaatcacggtaaaacaaaaacatttttttctctgaaccttgatgttcatcgccaaagttgggttaggcagtatccaacacatgggcctaaattatccctttaggcaatatacatacatatatacatatgaggtagtgtaagacaaaaacattttttctctgaaccttgatgtttatcgccaaagttgggttaggcagtatcaaacatatgggcctaaattgtccctttaggcaatatacatacatatgaggtagtgtaagagataaaggaatttggagagcaacaatatttacagtgctctgctgtctaaacaaatcgttccctgcttcaattatcttgagacatgtggtctatactccgtccatttcaataatcttgagacatgttgtctataatcagtccattacaatgctctccagtctaaacaggtgaaatggattgaagccataactcctactacgagtatatgaaataagagtattaacaatgtatatatttcttaccaacaatattgtagatatgcaataccagcatgacggcgtaggcagcgccgttgtaggacacgacgtcgacggagcactcaaagtagaccggggccaccggcgtcggctccggcgcgccacccaccccgacgccgccgtgagcagagagagaagagcggggaggacaccggcgccggctccgacaccgccacccgacctaacgtcgccgccagggaagggagaaaaaggggtagagggcagtgggcgccggctccgatgccgccgcgaggggaaggagaagaggggaggggtgcacgcgacgtcccgtgcaagggcggcggacaatgaaggagaagatggtgccgcacccgttggcctccgccgctccgtcgctagcgcctatggtggtcatcctcctccgtcgcgccgtcttctccaatcgccagatccgacggcggcgttagatctagccgcgggcgtagccaccgcgccagatcgggaggggagggccgccgctgccacctccctcccccctcccgacagagccgccgctcgtccaccctccaagccgcctccgccctccacctccgctggatttgggaggagggaggggagccgccgctggatccacccttcgcgtagccatagcctagagccgctgccgccacaggccttcggtcgaatccgcgccgagagatgagaggtgggatgggaaggggggtttagtgtaggacgttttgcagaaaaccccctatggcttttacgtttacaacgctacctctggaagcggaatttttgtatttttcatggaatacaagaggttatacgtaataaatacaacgtgatgtcaggtatatgtgatattatgtgtaaacacgagttttttgcaagacccccacaacgcccaaaatttcgtttgaccggttacagcttacgagcagtcaacgtgtaaagcaacgagatagccaaaaaaaattcgaaaaacggagaaaaaaggaatggttaggctggtaattggctgatgatatgtaaataaggaatggttaggctggtaattggcttatgatatgtaaatcactttgttgcaacgcactaacattatttctagtaatttaaaagaaaaattgttttaaatatcagtgtggattgtagagtgaactttggagataatagggtttcgcggcccggacaaaggaggcagtagggtgcccgaggcggcagacatacggatcgggagcaaaaccacatactacgtcaacacaggaaaacttttataaagcgcggcaccggtgacatttgcagcagctgcaacacagcatagatatgacatgatattataccatgggctgtcaagaccagcttcttagcacatctcacaagtgcaaggcaatgctcaatctcacaagtgcaacatcatgaacatgcgcgtatcagatagcacccaagaaaaataggataacatgcaaaactatattaacaggagtgacaagttagtgtagccagtacaattaacctgaataaatgcattctcatgatacatatgtacacaattttaggccattaagagaactcacggttgccacacacttcagcatttaccagagtatcccatctattattccaaaggtacagttgtctgaaattttggaatattaaggttcacatggcagttttcgaagcacgtcagcatctcggatttgatacagcggctgcaaaccagaaacatcacaaatatcgttttaaattaacagcagtcatgcctgtagagacattgcattcagtaaacgtggatgtagatgctcagattcaagggtctttttcttttattgttggcaaaaatcaagatgcatggtgtgcagtggtgactgatgctagttaagtttcaagatgctcacgtttgatgggagcaaactaagtgcaacctacatatagagtatagatgagacagcggcgtgtataactgatcaaaagcagcatataagtaactttaccagatatgatgactgactacaatataaagatgcatgtgaaggttactaaacatgaagctcataatgacaatctaataaagctaaaagattaccagaatttcgccgcttaaccctagggccttgatagaaatctatggaatcgctgtacttttacagcataagctttcacaaaatccgccttttcaggtatggttccactagatgaaactctcctctttcttatatgaaataagaaatcttcagtatcaaggacataggaaacctgcaaataagatattgagcattacaaaatacaacattaaaatggtcaaaatggtatcatgatcaatcaaaagggttctgctagatacaatgttaacttgcaatggggcacaaaattctcgctaaaattatgagtacctttgaggatttgcaggatatcttgcattcaagaccattagtaaccatgaaagcatcaatggccttcaaagaagcttgagagtcatcgtttcccccacgcttccgtttattcctgggaaatgatgtccaacaatgaaaatagccgtggaaagtaaaattgagactccaacataagatcaggaaagtacctcccaaggaagatatcgtcatacaatttagtattagaaatacttgacagatactcattatatagataagacgaaaaatttggatcaattgacactgcagttactt

SEQ ID NO: 60804 - DNA, 1512 bp, Oryza sativa
  unsure (1)..(1512): unsure at all n locations
ccactaataaagtaggagttatataccatgaagataagtgtataacgccaacttagagagcgtttgaaaagagaggaaatgagaaaatcgataagatacactaaacaaggtgataaattagcgtgttaaatattaattattttgaaattgaaaatagattaatatgattttttaaaataactttttatagatttttaaagagtattttcaaatttatattaatatcactattaggcaggacacgggaggtgatgacaaccgtctcgcgtgaacgggagaggttacgcctcctgcattgcactttgctctcccaattccttattcaattccctccgccctaaaataaatttatctttaccttattttatttatttaataagttcacttttaatcatcactacatcaaaatgtgtgtaaaggtaaggaataattgtcttagagcaagttttatagtagatgtgactaccacctctaatcttaaccatgtcatctacttaataattaagaggcaacatgtataatacattacctctaatacacaaccctaataattattttgttggttcactatgacatatctcactatctctttatacatctcatcttctcaaccaatcataatactccccatttaattccattaactttctttcaatcttaaaactcctgacattttgagacgaccacgtagagctagccgggtgcattcgtcactacacttttctaatttctactcctcatttttcacgctaacgttttccaaacaactaataatgggntttcttaatatatatatatatatatatatatatatatatatatatatatatatatatatatatatatatatatatatatatatttgtagtagatattcacatgggaggtggattttcatttcgaggggatatcttctcgttttatgcataccacctataaaatcatcaaaaaatttggaaaaaaaatcaacaacatagatcaatatgtgatttatcactctacatacatgcaaattcaacttgtataagtataaaaaaaattaactctgaagtgtatactattcgtactgaaatttgttgttttttcctatttgtgtaggttgaatttgaatttgcatgtggttatgaaataacgacatatctcatattgatctatcatgttagttttttcaaaaaaaaattataattatctgaatggcatataaaaataagggatatatcttgttaagaaagaaaagagtttcacatttctaaattactacttccatgcatatatgtataacgttggctagtataaatttgaagtagccaatgtcatataaaaaaactggagggattattttttttataatgaatttttattatatatatagagtcaagctagtaaattaattaggtgtacgtacgtcgtagtatgtgctggtgctttcttttttttgaacggaagtgctggtgctttcaggcacatgaaactaattgttcacaacaatagtgcaccacatataccaaattg

SEQ ID NO: 60805 - DNA, 1798 bp, Oryza sativa
aaataattagtaataacggtaggagtactaatctatgtactttgtggctttcctaggtagtccggtgtcgtcttaggacaaatctatgtgtgacctacattttatggcctttcacagtggaccacgcggggcgagttgcttcatgcctccaccccacttgcgtgatgccgtggaggagggagggtgtgggccctattacctttgcataggctctcgtccctcaggtaagacgcgagttccttgcctcgaaaaaactagaaaagcagcatagcatccaaagcatcgatcctggaaagctcaccccacccccgccatgcctggtccctcacgtaccacacgcagtcgctgttgtcgaggacaccgcatcagcacatccgctaccaatgccaccgaatctgcagaggaggtgaggaggagatcgggaatggagccgccagacccgagcgatggaggaggcctccttgacctctttttttctctcttttactgtctcgtcaacaaaccgtgtgaaaggagaaagaagactgcatgtgtcatgaggtggtgtggctctaacatagtgagccgaagccacttctacgccgttaagccgtcacatgtatgtatgtatgtattgttacgtgccatacgcagatcatgttgtgttgtatgtattatggttgctgcttctaccatactatcccctccatctcaatatgtagcaatctagcatgggattagatctatttctcattctagattgatacatattggaacggatgggagtactacctaggagaaagaaaaaacaacaaagcttctgttgaagacttgtagtacgaacaaacatgcacgcgtcgcgtcgcaggatgttactagttagctacagcagcaattactatcttacattttcggatttttcctttaatgatagaatttggatccaaaatcttaagatactactggtctctctctctatatatatatccatatacacgctcaagacagttgacaaaatccatagcatctaatacgtgccaaccatgaatcaatcagtaagtacatgacatcaacattactctatcatgcaagtcagctatagctagctcgagaacacagagagaaagatactgtatcgtatcaatcatcataagaagttttgattttggtcaaacttaaactactttaaatttaactaagtttatgtataaatatagtaatatttataataccaaattaattttattaaatcaacaatcgaacatattttcataataaatttgtgttgagttgaaaatattattattatgttctataaatttaatcaaatttgaagtagtctgattttaccaaagtcaaaacatcttacaaactgaaacggaaggagtagtagttattattattattattattattattattattattattattattattattataaggtaatagtagtggtttagttgtttgcggaagcataagatacacgtgatgtggacacgtgattttcgaagagattatttcttttggagtaatcaatggccaatatccacatgtttaagataaagatatgttcgccatcaatatgctgctgctgcctcctatactcctccatctaaccttcaatggatgtgacacggccgttgcaccatctcaaaatataacaaaatttaactttcgatggggatattaaagagttaaatataacaaaattttactttcgacgcggatataaaagaggggatcatatattttatgcacaaaaacctcccgtacacacttcatacacactaactagcaaatatcacgaaaaatt

SEQ ID NO: 60806 - DNA, 1673 bp, Oryza sativa
catagcaaagggtaaaaattcacgcaccaccctgatgatcaaaaacataccaaacaggtgggttttgcacatgttgccaccggttgccagctgtcttgcacattactcaggtatccttttttttcttctgttgactaaagtcatacttgatgtgatccacaggtacaactgtaagctgcttttggctgtcattgatgagaaccaccgaggaacctacgatttcatcatatctcccaattgattttaaggtctactttttttttcttagtgtaaaaaattgcaactgtgagtacaatttcaggactgacttttgcaatgttcacttttctcagaacaaatgtaatgtggggtatgcttttatcaatatgactgatccgcagcacataatcccattctataaggtatacatatcatgcatgcattactagttaagcttctccgtttttaatgtaccttccaagatctaagcatagcatatgatataacagtatttttattattgtgttgcattcttttttgtgggaggaagattttttaaaaagtatttctgccctgtagagtactgccagttttcccctggcattttctaattgaaagtatgcataggattaattggacttgacatttgctgcagacatttaatggcaagaaatgggagaaattcaatagtgaaaaggtggcgtcgctcgcatacgcccggattcaaggaaggagtgctttgattgctcattttcagaattctagcctgatgaatgaagacaaatggtgtcgacctatgcttttccacaaagatggtccaaatgcaggagatcaggtgtgaatatctctagtgcttattgtatacactaaatataccatatgagtgaccacttctgactgaccctattcgcacaaaatgattgacatggcggttttatacatattattattttctgataaagatacatattattattgcaggagccttttcctgtggggaacaatgtccggtctagggctgggagaaataggtcgctcatcagcttggacactaaagatgcaagtccatcaagctccccagaccaagaaagcaattctgtcggcaccgcgaactcaacttgccgtacgaccttggagcaaacctaatcactaactggagggcacaagaagctgtaatgataaactagggaattcccagttttgctaagtatttatttgactatcagggagccaaagtttgtgacctgtgagtgtaatgatgaatgaaaggctctgccaggcaaggcatcacctccactaaaattatgagagggatcatcagttttgccctgtgtatggatggagctgtgaactggttggtattgtaacggtactactacttcagtagagcaacaagtgtgtgcgtgtgaatgtgattgactctctgagagatgagaactggaagctgtacagttgatgagttgagtagtcgagtctttggttgagattgaccaccgaaagtacattcattctcttctcagattgactgcgccttgattcattcatttcatgtactactagtacatgtgtctctgactcttgtgccccttcttcaccccttgcacatcacacaactgcatggggaaatagtacacgagctgttggagttcattgcacatcaatctcaaaacctgcaaaaaagagtgctgtgcaga

SEQ ID NO: 60807 - DNA, 2527 bp, Oryza sativa
ctgttatgaaccaatagaaatcagaggttagcggtagcatagtatggtgacatggagccaaaataaagcattatatgatgatattgcatcacatagaaacaggcacatacatcaaagtcccatgaaggagttcctttcctctctgatatgtctgttgcacctttcagctcatcaactttggggagtggcctcggacggtcaccataaatatcacttaaaaccaaataacataatgtcagtatgaacaaaatgtgttgctcaaatgaataatgaacaatatgcatgtctcaagtcaaaagtaagcatttcaacgaacctagtccaaggagctggttcattgtcacaacgtacaaagagatacctgcaaaccttgaatttaccctaagagacaagacagcaaaatatccattatgtttccaataaaaagaattatcaactgatgaactgcagagcacaaaactacaaagcaacattcacaaagctgtgtacaagagaatggcgttacctgaacactaatcttcctccaacatttttcaatcctgtaaactccatcatacctcacaccagcttcaggagcatatgaagaacgcttctctttgtgggacctttttttaagggaatgtaatgagttaggggggcatgacaaactataaatcatttgaatagtgaaaaggatatatatttggatcatcaataacagacagacaaacaaaagagaacaaatatatacactaaacagtagtactccatagagcgacagtagtagtcctacaaaaattatctgtttcaagagccaacaaatatctacataactataacagcggcagatcagaattatctttctacagcaagattttaccaattataataataatggaaaggcacagattacaaaggtatgacaatttactcaggcataacattatctccttaagattaaactgctaagtgtaatcatggcagaaagaacataccgcacaaccctgacagggtaacccttgaggcaactaatacgaagagcagcattcagcttctcaaatttctggtctgaggactgctccttgtttgtacgcttgttcccacttagatctcttccaccactgtacaagtataaattatattatagagtgtattagcaattgctcatatcagagatcactgagaaaaactgaatgatggcaaatggtcaagtttgctaaccttccagtatatagaaaccattccccatggtcctcatcatcgacatacccacccgagagggctaccgactgagcaccatgtgtggattggccagcaataccagccacgtgaggaaaatgggcaccccattgcctgcactcaagtctgtcttcccatgtatccccaactagaacaccaatgcttctcttggggtcattctctgcaagaatggggccaaaatggtcgggtgggatagtaacaaagatctggccacttgaagcattagcttttccagccctcttagccctttcagttgtaaaagccttgtcaggtctatcatcatttcgtatgtaatgatacgcagctgcagagacagctgagttggcattctttgaaaccttagccatacggataacagaaactaatgctgagttgattcttggctgctctgccatttttgctggtatttgtgcccggcatttaccacatgtcctttttccgctgtggatccatttctggaagcacttcaagcaaaagttatggccacatggtgtctgcccaagacaaaagtagaatctgatggttagaaacgctacccaaaaaaaaaagggtccaatgaattgacagaatagcaagaacttttacctacctacaatgcatggatcaaaataagaattatgtgcagaaactggaaggttaaaccaataccccaaaagaacaagacagcacttttaacaatgcaaggtattgcatcaatccagaagaacaagcatgtgatggcaatagaagctagctgtaccacatacaaatgtctagtgactgattaggcagccgcttgggtgatgtaatgagctaggctggcaaggcaggacggtgtaagcctaatcctagagcctaggcaggttacgtggattgcctttttagaatactgtttgcattatcagaattgtacggtggatttggtatgagctaaaacaaacatatctaggcatagtaaatgtgtgcatgtggtgaaaattaggagtgacataccagttggcattaccaaagcaaacaattatcatctagaaagggcatgcaatcgatgtgttcaacaagttaaacttgaattgtaacaagcattgcagtctcaattaatagaaataaagaaatgtaagcatcactctacgaggtgcgtaacatcgatgatctggttcatgataatcagttaagagtggtctggtgggaggatgtaagcctagcacctaagcaggttatgtgggtgcctttttagaagacttgttccgttattggaattcaaatggtagcgtaaataagaaatataagaaatgagtagcaaaagcaaaca

SEQ ID NO: 60808 - DNA, 3551 bp, Oryza sativa
atataaatgtgtgaagagaggggataggatagcccccatcatcaccctagcgttaagataaatcatcgtacatataagcaaagcaagtagtaagaggaagaatgggggaaaggccccgcaagagtactgacggtgacggggcgttcgggcagcttcatgcagaaggcgcagctgaagttcttgccgatgacctcgaggacgtcgtccccctcgtcatcatcggcgtcggcaccggcgggcgcggcgccgccgagaagctcctggcggcggcgtgccttttcctggtcggagagggtggcgtcgcactcgatggcgcggatggcggcgacgagttggccggcactcccaggggcgagcggtgccggggccgggggcggggcgtcggtggagtccccggagcagtcggggcaactccattgggcggcgtcggcaagggcggggggcttggagaggcagggggagtgccacggggtggcgcaggtggagcaacggaggagatcgacctcgggaggggaggcgacgcggcagaccatgcagacgccatcgccgtcgcaggggagatcaggcatggcggcggcggcggctagggtttttgggggcgaggaagggagggaatggaggaggttttgaaatctcaaaaattttcgatctcaaaacccaacccgacagcggagtggggtggtctcctcctcttcactcgtccttgctatttgtagccccccagccccagcccaggcgtctctatctatctgtggatcgccggagggagacgatgatggaccccacgcgtcagctgccgtggcttggtgtgaacgcgtcccccgccccgcactcactgccaaccggaccccacacgccacgccacgctaccaaaatgaaatgaaaaggatcccttctttttttggatgggaactgggagaagcgcgcgcgcccccgcacccgcccgctcccgcgcccgccgatggaaattgggaaggaaggggaaatcaaacaagcaagaaaggaaggaaggaaaacgcgcggcaggttgaaatgaccaatatgccccccaccttcctctctagtctctccatttgccagttgtccacaccccaccacccacgtctttcccccttcagcggcgtgacccaccgtcacaacactactccaccccccctctctctctctcctctctgtcacaacttccgcaaacaaacatccatccatcaactcctcacatttttttataataatagattaaaccgccctttacacctaaaaagaatatccctcaccctcacgttttctaaagtcttcttttaacaaaagctaaaccggaccatataaaccaatatatagttttcctttttctggcccatggttataaactttgcttttaaaatatagaaacaatcaaaatatagcataagaggctctacatctttgaacgacacaagataaacatgcatacagccactgtcatggtagctaaccaatctcaacacagcaaaaaacatatgaacaaacacccgtcaacatttttattcttcccatacaacattgacccgatgttatcgaataaatcggaaaccaaggtcctaagtcaacaccgcaaatataattatcgacgacctaatagagaagtcttcccaaattttccatatatagccttacgaatggaatacccaccaccaaagggataaaaagcaaaagactttagagaagccaaagtcccatcaacatctaatcgatctaacctcgtacaagatttattgaaaacctaccgaagacgaacgaggaacttgttctcttcctccttatctccggcgataacgcacggagatgacatggaggggaggggacgaggtggcggcggagtcactcctaacagtcgagttgtgagttccttctgtttgggtagggcggatgcatttatatgcaaccagatgggggacatcttcatccctccttgtctccaatgaggacgcgaggagatgaaaataggggaggggccgatgaggtagcggcggagtcactccagacgagtcgtgagttcttctgctgggggagaggatgtattcatatacaaccaaatgagaggcatgctccattcatccttatctccagcgagaacgcatggagatgaaaggaggggaggggatgaggtggcggcggagtcgctctagacaatcgagtcatgagttccttatgctcgggggggggagagggtgtatttatatacaaccaaacgagggataggctcccttcatccttatctccagtgagaacgcgtggagatgaaagggaggggacgaggtggcggcggagtcgctccagacagtcgagtcatgagttccttatgcttgggggggagggggtgtatttatatacaaccaaaggagggacaggctcccttcatccttatctctagcagaacgcgcggagatgaaaagggggagggacaatgtggcggcggaatcactccaaacagtcgtaattcacgatattagatccatgcctctaataacgccttgtccatgcacactgactctttggataccatttcacttacctatattggtctccttataacaatacgtttgcgtattatcccaaaactatccttttatagtatatctagcatgccccgattttacacaagctaagttgcttttagaaagacatcttacttgaatcacatgcttttttttcacgttttagactaatgaaatgggattgatgacagtatccatgttggatatattcgtaacggtaccgatacggagggtactattgacatcaagacaaaagcgcttgcgtcttaggaagaaaataatatagtttggaacaaaacgacatgccattgttgtcatgccaaatcaaacatgttgtgcttgtggtattttatcttctataatattcccatcctatgttccattttttttaaaaaacttcaattcaattatatagagaaggtaaggctgcagcaagacaatagatataaaaaatcaatacaaatattccaataacacgtaggggtgtagagtaaatttgataaaacttatggttataagatgtgaatatctgaaatgtatttgggttaggctttgtttatgaaaccctagccttagagacggacgtctactttcatcgtcgtctcatttcaatgtatccttgtttctatcatcaatttttataaggctgatggaaacacatcctatctccttagtcagaggtgttgctcacgttagacgtctctcttcaaggagtgactatgacgcatcttatatacctcgaggacattaattagtgtcactcttattgatatactcttttgtacagagactaatagtagcatgatatatctcttgagcccgataatgagataggataacaaacatggttttgattgatgtatctcttctagagaccaacaattagattagaattaaatgatagaagtggtaatctttaccgttgatattttagaggcaaccaatatagaattcgatcaccacggatataaggaatgataaaacgatggtgtaaatggtgccttttttttaatctta

SEQ ID NO: 60809 - DNA, 961 bp, Oryza sativa
acgcatgccaacggtgcttcaagttcgtcgcctcttcctgaagaggcgcttgttaatggcagtgacgccggacgtagtgagatcgaagaacaagcagaagccatctagaaacaatttgttttaaattgggacgagatgatgttgagaagctggaatatgtatttattttggatcagtacgggaacgcctactgtggtaacagaagatctcgatttgtggtcgagtttatactacactacgtcaaataacaagtgttgctactagctgtgactgtgagtaataccgatacattacattacattacatacatacacggtgattaaaacaaacaagcagacatttttacttggttatgttatgacaggcagagatggcatatgttaaggaaggataatctttgttccttcttctccgcttgatgtgtcgcttgttaatagcatggcagtcgacgatcatatcagatgtgatcgatgctatggcaaacccagtaaacgaacaagagataaattagaggcagactagtgaggaggtgcatataagcatagatccatacattcatgcaactctagagccatacattaacaagtggagtggttaacatgagatgatgcggagattagcagcagctagctaccttaattagtagatactcctaaggtaggaggagtgagtactccacagtggggaagcagatggagcttagtggcgattggcaggggtagtggcagagagcatcttgtcaactttggccaaaaggcctcgcatctctcccgcaagcgcaagctttgctccatggtcatggctagcggtagcagtagctgtaggcgagcggcccagcagtgaggagatcatcttctggagattgttcctaacatccgtgagtgggagcctgattgttgttgttggagtagaagctgctgctgctgcttctttcttcttcttcttcttggttttactagta

SEQ ID NO: 60810 - DNA, 709 bp, Oryza sativa
gccactgccgttaggattccgtcctctcgcgccgttaaatactctattcatcataagtattttaagttattaattaattaagacgacacttgcgcacactcacccctatgaacgcacacacgcacaccctacccctatgagcacctccagaagactgggccggtatatcttgagattgacgaagtcaccacagacgcctcgctgtcgatgggtacgtcacctaccattgaaagaataattagccgtaaatgcgagcacccgtgtcaaatctaggatttgaacctgggtaggctggttccaccacaagaaacctaaccagttgagctatgctcacttcgcattgttcaaactataattaagaccccaaactgacgcatgttatatatatatatatattatttatttattaaaataataagaacaatagtccagtttacacctacagtggcgaagccaccgggggtgccggggtgggcctggcaccccccatccccatgcgctgcaaattaaccccccgatgattagccatctaatccatacaattaactcattagctagttgcaagttgagcctatacataactgaccaatagattttagctttatgtgattacctgagttaattaatgtaactaagcgatgtggttgcaagtctccaaaactaaaacggataaatagaaatgatgtcttgtcactcatgtattcagtaa

SEQ ID NO: 60811 - DNA, 3614 bp, Oryza sativa
agttgttttagttttttacatgaatctagaagaatgtgttgaaatatatccaaagtcatatcaacaatcaatttatttacatattagtgcaaattaaccacaaaattcaaattattattatacgagggacgactacgtatattagagcgaacaagaggtgaggtgaggccaacatgccactcagcatgaactgagccatcaagatccacaccgttgtctatcgaagcgctggcgagttcttacatttcgtggctagcacccctattactaaattctggcttcgccaatgtacacctatatatatcttcgatacccaattaaagttaatttagttaagtggaagctaattaattaagtatgtactatgtaatttaacagtgaaataattaagtgtgataccggccatcaaagataaacagtaaactaattaatgctctagaaaaaatggtgtgattattatttaggccttgtttagttgggaaaaatttttgggtttggtcacatgggcggacacatatttgaagtattaaacgtagtctaataacaaaacaaaaactacagattccaccagaaaactgcgagacgaatttattaagcttaattaatacgttattagcaaatgtttactgtaacaccatattatcaaatcatggtgcaattaggcttaaaagatccgtcttgtaaattgctggcgcgtacgcgtgtgctaggatccccataatcctttactttgatttaggaagaacaaggtatacaggcagtcattattcctcaagagatttaaaatccattccagtcacaacagatttatatatgttaattacaacacaaacacaataaaaacgtatttataataagataggaggatcacatctagaagagaaattgtggcccgggccggcgtccttccacttccagttccagcgaggatcggccactcgcagctcgcgcgatccacagccacactacgcctacgcgcgccgagcaagcaccttgagcgaacaacctcgtatgtaccactgccacccgcaccagcatgcatcgcactcacggaccacaatcgtctcctcttctagctagcttgctaccacaatcatgcatataccagtttgcctctttttttttctggggaaataaattaattagttggccttgaattatcatcttatctgtcatgcttgctttccaacaaatagattcggacttggcgatgcatcttcttgcgtggcttgtctcccgtcggatgatggtcggagcgcacgtgatggccggagtacagagtgagaagggagagatttttgctccactgataaccgacccgttttctatttttttctgagaggaccaaccaggacctagaaccaacctgatggacggtagagacacggcaaacacgttgaacctgaaaccgatggcatccacgagatgacggacgatagaaaccttgcagtactgatattttaagtaggttaagattaagattaagataaagataaaagagcaaagtatacttttagttaattaaatttattagttgccatgtcaatggttagcaacacttgataatgactacaagagccgccaccggatccacgctagagggaggcggtgaaggaggtggagcctgactgccgaggttgcccagctagccgctgccaccgttgcccgctagaggagaggagagtaggggtgaaaataatagactggataggagaggtgtgagaagagcgggagagagagagaggagatgaggtgaaaaattcgaagtgccttagagggaaaagagataggagaggagaaaaaaaaaatctatagaggaggtattttcgcttgcggaccacttaagaagtctgcatgcaaaaatctatttttgcattcagttctttaagataattgcatgtgtaaataggcttatttttacatgcatccacttaataggtctgcatgcgaaaatcgatttttgcatgcatacctcttaaggagccacatgtgaaaatggaggtcgatttttgcatgtgaaaatggaggtagattggttgtgtcgaaagcacaaatttgacgagcgtggttctcccagctgacccaggttttttcccctcctgctaccctccctgagattttgtcgaaaacaggctgcaagttcatcttccgcaacctcccacgtactaggggaagccctaggtattttagagggaaatttgccctcatcgctggaacaccatcaaggacacccgtcaagtcaatgctatcacatctgatggccgctactgaggatttctgaaggttggttacaaagcggtccaaaatgtccgcgaaagcttttacatcgccttgggtgggattaatgaagatgacgacattgtccgcatacgtcaagatccgtagtcgagtcgttctaccccgtagcttcgaaattgcgcctagctctgtttccttggaaaggattctttggaggaagctaaatatttatagctttgactagaaaaaatgtccgtgcgttgcaatgagtaaagattacgatattagaactgagcaataaattgaaacattacgatcgctatacattataattgaaaaagttaatgaaaatcctatcttcctatatagttggtacccaccaaggagaatttactgctataaaacaaggcatgcaagaagccacatcatcaataactctaagccatcggatcgcattagtacatagttatcagtcgttggatcaagaagctactcatccatctaattaatcattgattactcatcctgtcacctccctttagatcataatcacgcgtgacattgttatccattctgcacataatactatgttttctcctcccaagtcttccaagataatgcaaacttatctcctttatttagtacaactcaaattattgtataagatgtgagttttgttttgttacaaacaattgaataacatagagtaattatgcatcattaacccaaaccaatttttgaaacaagcttgagataaagcaaagatgtgcaaactaccctaattatgacgatatccgaattgtgcatgataataactttcgtatatcataacaatataaaatgtcgttttttttaaaaaaataaaacatgaattgtattgtaatagcaaaggctatatatgaagccacattatcatttattttatatatatatacagattaacatctaattattcaaaacattaattttatttgacgataaaactagcaaatcccgcggcaaggcgcggggtgccaactagttctttcttagttttaggccagaagctcattctttcattcctttttaatcatacgctagttcgctactcctttttagtcctacgctagtccgctacctccctctgcttgaccttcctccttctgcccatctcgaatagccgactaccgccttcaacctcccgaagatagtcccgtacccatacgatgctggagctgatcttctccgtcaaatccggccgaatgtttcttgatatccaaaattagttgagagcttttgatccaccgatcgtttctttccctttttcaaaaaattagagcgtaaaacccgggataaaaaagactaggaagatcgtggagattaaatccgacgaatta

SEQ ID NO: 60812 - DNA, 6215 bp, Oryza sativa
caatcctacattgtttttttacttgaatttgaatatgtttttattcagattaattgtattaggtttaatcacattcaatcctacattgtttttttactacggatgaattactagtctatatcatatcctcctcacaaaagttgggacagggaagtaaaaaagctgtcagtggaatcagagaaattaattcattaaattaatatgcacatctatatatttagagaaaatccaaagaaatgtcattggaagcgttcaatttcaagaaatgccatcaacaagtacatacatgttccatgaaatgttattgtacaagcgattttgtcctagaaatgtcaccgccgttaggttcccatgcatcccgcactattcatcctatatcatttaacggagggttgctaatagaaccctaacagcgatggcattttatggaactcacactggttgatggtatttttttggaattgggagcttgtcagtggtatttcttggattttcacatccatttaaattcaatttcaagaagagcacgtagtacgtttcgctaattattgaattcaaatttttggaattgataacttaagtattttaggttattaattaattataagacgacactccaatacatttaattacaactagggtgctatcctatatatctataaagttcatccccactaaatatagtagtgctaattttctcttctctcataaagccacatcacataaattgtttttagcctttggataattcatcaagggtgtaaattgcatctcttccctaaaaggcacaccatacaactcaaccgtttataacctatggataattgataaaaattaaaaaaaataaacatatgaaaaataattgtatattaagtaagaaagaaaaatttggaactcatatctactatgttctcacacaattctcctacagcaacgagcgaggtacccatctagttcattctaattttttgaattgttaaatatattgcgcaaaatataattaagactccaaattgacgcagtcttatatatattatttatttattaaaataataagaaaaatagtccagtttacacatatatatatatatagtaaatttgtttggtgctccatggtgcccggacaccattgttgaaattgagtatatacccaattcaaatgagtataaaactttttcaattacttaggtattaacattaactactttactaactagtttaaagcaagtttgaattgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaatatttgaaaaatttgagtgattttgtgcattagataccatggtgccatatatatatatatatatatatatatatatatatatatatatatatatatatatatatatatatatgttcgatacccaattaaagttaatttagttaagtggaagctaattaattaagtatctatgtaatttaacagtgaaataattaattgtgataccgccaatcaaagataaacagtaaattaattaatgctctagaaaaaaatcgtgtgattattatttacaaatgaagcagtcgtcacatttgttgtttgcaggtgacgtaacgtggatgtctctataagaattgacttgtcaaatttgtaagaaccacctgacacctgtctagcaacctgcatatcgtcgtggtcgtagtctaactacgcttgggcctagtgtatacatgtagggagatggattttcatcctcgggaggtgatatcatctcgttttcttatatgctatttataggttatgaaaaattattaacataattaatataaaatatatcatttcacaaaaatacaagacaaatacatttttttacaagttaaaaggaataaaataaattgaaaatagttaacacatatttataattatttttcttacaatatatgtatattatatccgtattaatagactattatttatatccgtattaataaactgaaaatagttaaatacatttagtggttaaatgtatttatttattaattaattgaaatattattgattaaaaattaatattaaaaattttggggaaaaaatatattttagcgcgaatatttttccaggtagctagactagcattttcgtaggcggcacatcatgctctcgttcacctaggaaaattgatcttcccaatcggatcggccggctgctgattgttttcgcatgtctttgcctacaggtggactggccgtccgcctaggaagaccgttttcatcagtgtagaaaaatggtgtcaaattttttgaaagaaaaatattgataaatgcatacgcagtccctatatggctatatatatggtggtaaactggcatgtacacatgctgttgtgagtagtgattagctaggcggctattagcagcagcaaccagttctttttgcgtatgatagatgatgcagagtgcagctggagcaatggagctgctggtggcgtcgcaagaagcaggcggcgttgtggtggtgggcatgaacagtggcgacgccggagagctgagctacgccaacaactcggacatgcagcggacgatcgctgcggcgacgaggaaggagcggcaggagatggcggcggccgttcggcgcggtcggcggcaggcgagagccatagccatcgccgacctcgggtgcgccacagggccgaacgcgctgctgatggccggcgacgccgttgaggccatgctgggcgacgcggagcggcagcaggaggcggcgcctgcagagttccacgtcttcctcaacgatctccccagcaacgacttcaacagcgtgttccggcagaagcagaagctggtggtgccgagcaataatgccaatagcagccggtgcctggtgtcggcgtggccggggtccttctacgggcgcgtgttcccggcggatagcctggactacgtggtgtcgtcgtcgagcctccacttcctgtctagggcacccgcagatgcggcgcccaacgaggggaggatgtacgtgtcggcgtcgtcgagctcgagctccagctccagggtgctgcacgcctacagggctcagttccaggccgacttccgcctcttcctctcctgccgcgccgaggaggtccgccgcggaggcgtcctcctcctcaccttcgtggccaggcgggaggcggtgccctcgccgcacgactgccacctctgggacctgctcgccgaggccgccgccgacgacaggaggctcgtcgactccttcgacgcgcccttctatgggccctgcccggaggagctgagggaggccatccgcgaggaggggtccttccaggtgacgaggatggagctcttcgaggtgagccgctcccgctcatgccaatcccaagcagatctagatcagctggcggctcagacaagcagcaccatcagggcggtggttgagcctatgcttggaccacacttcgggtgggacgccatggacgccctcttccggaggtacacccacctgctccacaattactaccgccacaacaacgaccagctcaccaacgtcttcctcgccttgcacaagatttgacttcattcatcccatccttccttccttcaaccatatatatataccacattccctacagtatcagtatgtattactgtatttccaaaacgtacctacaatatataccacgtgtcagttctacgatatatatatactacccggataaaatgatagtatcgtttctaaaatcgggataccaactgtttcatgtactagacaatatttaaattcaaaactatttaagtgtatttgtgtttatgtatcttcaaaatcaatcttaaataaaattattagaactagtgagtggctttctcttgacaaatgtctcttttcatgtactattctatttatttagaatggctatatatatttaatataaatattaaattaaacttaaaaaaataaaatattatatatcccgatactacgatgcgattaaacaatccgatactactcaccttctacatgttcaaagtgtatagtacaacttccattctagcagtatattatatactagtatatatctgttcaaagtgtatagtacaacttctcttctagatgtgatcctcctatcttattataaatatgtttttattgtgtttgtgttgtaattaacatatataaatctgttgtgactggaatggattttaaacctcttgagggataatgactgcttgtataccttgttcttcctaaatcaaagtaaaggattatgggggatcctagcacgcgcgtacgcaccagctggaccccgtccccgcatccctcttttttcgcacttttttgacgcgttttcttctctttttttcgcttcttcctttttttaatctttcgcatacctctttataaatgtagaattgaaaatttttaattttgacttgaaagtttttaaattttagttgaaagttttcaaatttgagttgaaagtttttcaaatttgaaataaaaagttgaaagtttttcaaatttgacttcaaaaaattcaaaattttgagttgaaagttttcaaatcactagttgaaagttttcaaatctgagtagaaagttttcaaatctcgagttgaaagttttcaaaactcgagttgaaagttttcaaattttatcttgcaaatttaaatttcaagttgaaaattttcaaagtttgagttgaaagatttcaaaatttgacttgaaagtttaaatcttaagttgaaagttttcaaatctgacttgaattttttcaatctattagtaaaaaaatcttcaaaaaaaggacaatcttatcttaattagtgtcattatctaaaactaacttagttagttaggcttaactactcccgtctctcgtgaaaacgctcgcgacttgctgatctcgcgcgtgcgcgcgaattagccatctcgacgtttgttactcctacttggttcctatactgatttgtatttcgaaaaggtttttttttggaaggacaaaacctagatattactgcggagagaattaagcagtttgtattagaggagaaaatcgttgtggctgatttggccacgtcttgcgatgcccacaaaaataggaacaaattgtggttcacatggatggtccgctagtagtatttctgcttgctttttgctcatggaaattattaaaggactaagcaactggacatttaaggggtggtaactagcaagcatgaagcatgggctaactcgaaggggcgcagctaattcgcgcataagcgcctctatgttaactcgcgcgcactaccacgtggcacatacagcgaatcctcccatcgcgcgattagcataacggtgattatagatctaattacggtgctacagtaatttctcaataaaaataattcatttaaaaaattcgagttgaaagttttcaaatattgactttaaatttttcaaaatacaatttgaaagttttcaaatctgagttgagagtatttcaattttgagttgaaagttttgaattttgagatgaaaattttgacttttgagtaaaagatcttaaaatttgagttgaaagttttgaattttgatatcaaagtttttatttttgagatgaaaattttgaattttgatttggaagttttcaaattttgagttgaatgtttcaacagtgagttgaaagctttaaattttgagatgaaatttttgaattttgagttggaagttttcaaatttttagtttaatgtttttcaaccgcaagttcaaagtttttaattttgagatgaaaattttgaattttgagttggaagttttcaaaatttaagttgaatatttttcaaccgaagttgaaagtttttaatttttgagttaaatgtttttaaatttcaggttaacaattttattttttttgggtatgacttctttttctagagagttttaaattttatgtatagatttttcaaatttgtagttgaaaaggaaataacctttatgtgaaaaagaaaaaagaatgattcagatcgtgattatcaaaatctaattacgctagacatgatcttatctgatatcatgcgtacgtgcgcgtgtttctaccttcccggtgttgcgtggtaggccgggccgaaaca

SEQ ID NO: 60813 - DNA, 1687 bp, Oryza sativa
atcaggctctcgatttcgaacacaattcgatttcacgtcagtgatgcactgatgcctcgtaacgcggcggatgagttcccattccgtctgtcccgaaggcgctgcgagcgccgagcggtgggtcctgggacgctgcggcgctgccgttcgggtcgtacctcacgccggcgacgacgagaacgacagcggcgggttgtaccgcacaccgggtccggctactcgtcgggatcgccgccgacgccgccgcaccggaataccagcgccgcctccgcctccgccgccgccgccttctcgccgtcgtgtggtggtggtggtgccgattcccccgggccgatgactctccgtcgggcctgcaaagaggaaaggggagatggggagagaggaggaaaaacaagagtgggaatgacatatggggtccacgtgggccccatcattttttattaatttgggtgtgaaactgacatgtgggtcgcatggagtttattagggcgttcccaacccaataactaggatagtgtccatagcattaaataagttgccacctatgacaaaaaattgatgtggcaagtgaataaatgagaaaagaaaagaaaaccatgtcttgcatgagacatggtttctatacaacatccaagacatcatgtgagataagtagcattaaattgaagtatggaatagtggtgtttacattggaagagtagtgtctagtactagtttcttgatgatatggagtttatggaaaccatgtctagtgttatgggttgggactgcccttatttttccggatcgacttgccacgtaagcgccatgtcagataaagaccgcgtccaattaaccacgtaagtgccacgttagacaaaaccgccgaggaacctaatctgtactggttttgatagctgagggacctattgtatctggttttttcggttgaaggacgaaaatcggattcgttgataagttaagggacctccgatgaacttattcccccacattgtggtgggatacaaaataaacattttccatgaattttgaccgtgttaatatctattgggccaaacggagaccccaagccttagcccatttctacgtccgccgcccgtatgtggacgcatcacgtctgatctactctctgttgttccattttaaatatagggtccgtttagattggtaccaaaataaacctttgataaattggtaacattgtcaaaattttaataggattatcttaataatgttgtcaaaattctatacatattgccaatatttggtaacaaactaaacgtagccatataattatcaattttaccaaataatggtatgattgaaaatgtcatcaatctgaacaggcccatagttgtatgtttatgtgtctaatatttcatcattcgtcttatttgaagaatttatataaaaatagaaaaagtcacgcataaaacactattcaggttttatatgctaataacaataaaaatattcatcatataaaaataaatgatatggacgatcaagtattagatataaaaagttataagcaccgcacaaaatgagatgaagagatgaggtagcacgaggcatcttcttgacatccgtcaatcctctttttcctccgacaggttgaggtggaagcctgcctgcctaccatcgacattggccatgcatggctgctgcggcaagggggtgcaggaat

SEQ ID NO: 60814 - DNA, 10498 bp, Oryza sativa
  unsure (1)..(10498): unsure at all n locations
aacaccgtacaatatgaagctaactaggagtagtaattagccataactcaatttatgcctccttttagaagtttaaaggatttgtggagggattgcaatatttctatatgaaaattttctatgtagtcttttgaaacatattctcaattcatatgacatttcataggaagggctcaacgagggtagattttttaggaaaaaaaacgagagttttgacctgttgaaaaaaattctctaaatctatctctggatggttatttatgtatttttgttgtatttttaattatctattttgcgtatacattagatataaaaactttgtgattttcctatttttaattaattgtcgcgtgcgaagggaccttattggtaggatgatgatacatacccctccatttctaaatacttaacaccgttgattttttaaaatatgtttgactgttcgtcttattaaaaaaaattaagtaattattaatgtttttcctatcatttgatttattgttaaatatacttatatgtatacatatagttttacgtatgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccaaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttccggagacctgctctcccgatcgctggtgcacgccggcgagcgggatggagtagtctacgagcgacggcgcagtacagagtaggaggcaaaccctagattgattttgcgtgtgctgcgtgaagaccgcaggtcggtttatatagagaagggtcgcttgatcagggcgcccgcacgatctctactgcgcgtaaccgaaccggataagtcgcgcgtaacttatccggactccatgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccaggccaggccaggcgaggcgaggcgaggcgaggcgagcgagcgcgcgcatgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaattccaagctacacttactcacaacttgaacaatggactacgccttgaattacaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagtcaacagaactcattaaggcatagccaacctgccttgcagctcacgagagtacatgcatcttcacttggagagggtatatatattgatactctcctctagtttactaatggtttgttcttctcaggatctaattcacgggatctccgatcacatagactgggttaccaccatagtataactcatatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagtcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccacaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagcgtaatcccattctcacctctaattagcttaatgtgtaagataacatcagctactcccaaatctttcatatcaaaattttgagacaagaatgatttaacctcatttatcacctcaagggttgttcccaaaatcagtaagttgtcaaattacaagcacaaaataacttcctcaccccccccaaggggataggacacacatttatttgccttaatgactgcaaagcctgcagaaggcaatggtttgtcaaatttttcaagccaatggttaagaggttggttcaaaccatacaaaaaatttaaccatttggaccatttgccctttttgaccttcaattccaaacccatcaggttgatccatatagatctcctcatccagctctccattaagaaaagctgtcttaacgtccatttgatgaacgagaagaccatgtgaggctgctaggaaagtagcacacgaattgtggtcaatctagcaacaggtgagtaagtgtcaaagaaatattcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagatggttggttcgaaccactatgtgtatccttcattgggaaaaagctctcaaagaagatagcatcacgagactccataattgtaccaacatgcatgtccgatacctcggatttaactactaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcatctcatgtatgatgccatgttcctcacagaataagtcaaactcgttcgagaaaaactctccaccatgatcagacctaagcctttttatctttctgtcaagttgattttcaacttctgccttataaattttaaaatagtctagagcctcgtctttcgttttcaacaagtacacatagcaaaatctagtagcatcatcaatgaatgtcatgaaatatcgttttccacccttcgtcaacaccccattcatttcacaaagatctgaatgtaggagttctagtggtgccaagtttctctcctcggcagccttgtgaggcttgcgaggttgctttgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaacacaatgagatgtcagcacaaacatgtacattggccctagtatcaacccaccaattagtagattgattaactgaaaaaacagtaggtaaattaccatacccgcttccatctccagtgttgccaatggtcacattagcagacttagaagtctgccctgcaggtgccttcatccccttgcctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacattaagagacgcaatcaacccctcaacggagtattcctgtctcttgtgtttgagtgcagtaccgaaactcctccaagatggaggtagttttgcaataatgcacccggccacaaagttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcgacaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccaaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttccggagacctgctctcccgatcgctggtgcacgccggcgagcgggatggagtagtctacgagcgacggcgcagtacagagtaggaggcaaaccctagattgattttgcgtgtgctgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggccaggccaggcgagcgagtgcgcgcgtgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaagacccattcattaattccaataacatatttcataaaattttttgaataagacgagcagtcaaatatgttctactatagtagctaaatatttagaaacggtgggagtactactatagtagctatagtagctagagtagatgtgttgacaagggattgagtgagtgcgttgtaacggtgggcatggagtggccttgtagctaggcttatcatgatgattgatgatatcggagtagaatttatcatcaaggcccaattaaggggcagggctcgatcagctgtttgtgtagttggagcgcgcggtggaagatgaacaagctcagcaacctagctagctagtcgtataccgatcgatcgatcgatgaatatggagtccctggcagcaggagcatggtgggtggttgtgcttcttctactcgtccttacaattgtggcctcctggtaccggtcatggtggaagacgaccgaagcgggggggccgctgcttcctcctccggcagctggtgcaggtccatggtgggtgtgggnntgtgtgttcatgtgttgtcgtgggaagaaaatgggtcgagacccttacctggcnnctcccaaatggcaagcggcgcgggcgattctaccacttcgtgcaggagcgctacaagttgtacaagggggagggggagggggaggcaacctgctgcttccgcaccgcgctcatggggcgcgtccacgtgttcgtgtccgcctcccaccccgccgcctcccaactcctcaccgccgaacctccccacttgcccaagcgctacgcccgcaccgccgccgacctgctcggcccccacagcatcctctgctccacctcccacgcccaccaccgccacgcccgccgcgccctcgccaccaccctcttcgccaccccttccaccgccgctttcgccgccgccttcgaccgcctcgtcatccgccactggatacgcttcttccgcctcataatcaaaaccaagtcgtcgtggtgctggacgccgctctccacataagctaccgcgccatctgcgagatgctgctgggcgccggcggcggaaagctgaggccgctgcagagcgacgtgttcgccgtcacgcaggccatgctggcgctgccgctgcgctggctgcccggcacgcgcttccgcaggggcctgcacgccaggaagcgcatcatggcggcgctcagggaggagatggcggccagaaatcaccatcaccatcaccatcaccatcaccacgacttgctcagcgtgctcatgcagaggcggcagcttggccatcccgacgccctcactgaggaccagattctggacaacatgctcaccctcatcatcgccggccaggttaccacggccaccgccatcacctggatggtcaagtatctcagcgacaaccgcctaatccaggacaagctacgggtcaactatcttcttctttctttctttctttctttctttcttcaaattttcaattcaatcaatacacttacataacatataggagtacctcacatacatgggcataattaattaattaattgtactgtgcaggcagaagcatttcggctggagcttaagggtgattattctcttactatgcaacacctaaacgccatggactatgcgtacaaggtaggtactccttctcccctgcatccccttgctaattggagtagtactagcaagcttcttaattaattattcctacttcttactgtaaagcttaacttcagctgtgagtacataatatttcatcaggcagtgaaagagtcgctgaggatggccactatagtttcctggtttccaagggtggcgctcaaggactgccaggttgcaggtgactggagtagtatcttacagtatactattattaatgtcttgctcaatacgaattcaaggaaattaattaagcttatactactactctctccgtttcacaatgtaagttattctagcatttctcacattcatattgatattaatgtatctagacatatatatttatttagattcattaatattaatattaatattaatgtaggaaatactagaatgacttatattgtgaaacggagaaagtagtacacttgacatgctgagtaattttgacattgcatgtatgtatatacagggtttcacataaagaaggactggattgtaaatattgacgccaggtctctccactacgacccggatgttttcgacaacccaacggtgtttgatccttctaggttcgacgtacgtacgaatttctttacttgcttggttgcctctacatttttctactatctgaatctgaattaagcaactgttgtagtgtctgcaggaagagggagagggagatgatgcgaagcttgggcgtgcacaaccacagaagaggaggctgctggtatttggagcaggcgggaggacatgtctggggatgaaccacgccaagatcatgatgcttatcttcctacaccgccttctcaccaatttcaggtaggttaggtactggagtaccagaaaccagatgatgctctctatctcgtcgactcttgtaatcgattacaacaacactgctgtgctgatttcagatgggagatggcagatgacgatccaagccttgagaaatgggcaatgttccccaggttaaagaacggatgccccattctgctcacacccatccacaattcttgataatgttccagattaattagattcttcatgatgacttgtggaccgtggctgcctagctactttatctgtttaattagtaaggtagtattaacaaaaactgctgtcaatttattcgaaactagcggtattgtactgtaactaatagcctagagatggaattcggaggaaggatattcctttgttatttgtaataaataaaaaagacctgctatctggagtagatgtatcaagactattcatggtaaatttgcaatcggtgaggaagaagaaagaaacaaatagttggacacgtgacgatggtggcggaggagaagaggaagcatagcagggtgcgggacgcccatggccaaaataaacagaggattttcagtatttgccatccgattcagagcactttcatgatatgctatttaattcgtaccacttttgactttgctactaaaactgcaaatttcttcaatccatatcacttccatcatttagtgtcagttctctgttctcacacgccgacgagttcattcgtccaccacgaaaggagctcctctgacttaaagttagaaggatatgagtccttgacaggtgcggcccacctttataggcccacatgttagagatgcatgtccctttgacttaagttagaggagccttgtcggtccaccacacaccaacactggtaggacagacaacaatcctccacaccgcctgcgagagggtcctcttcctgtcttcctggccatcaaggaggagagaatcaactccacatcttctcgggtgacctctttgatagctccttcggcgagggatgggtgggcggaagtcaaggaggctgttcttgaagacggaaaagagaagtaggggcc

SEQ ID NO: 60815 - DNA, 4179 bp, Oryza sativa
aaggggatctgaaagtgggagccagacttttgctactgtccccatcttggatgctcgcgagaatgtgtgggagttggtggtgtgcgacacgacattgtccctctagttcacttgcttcttccccaacacctccatcaacaacgtcaccctccgcatgcgtactcatcttcatcactaccgcttgagctcaagttttgccgccaccaccgcagcacccccttcccatccccgcggctcctcacactcctgacacgactgggctttcctgcagatagctcatgagctcgaactcgccggctccctcacctacctcctcttctcccccgtcgtggaccactggagccacctcatcactgacctcccaccaccattaccacctcccgtggatgggctcgctggccgccgcccctctccccactggaggagatgggaaagagaggggggaggtggagagatggggaagagaggggacaggttgggaggaagtccactttaaattttaattttctgattggtatgccacgttagtgaaaccagtcatccataataccatgagactgacttggaaggtttttccaaaatgggggggagggggtgaagattgctggtattgcggtttagagataccattaaactcgacgtaaaataagggataataagtggacttatcactgtgagtaatactagtagtaatgagagttgggcttgggccgcccttttctacagtactacgatatatgggcccctgctcacacagtacatagagagacgattatgataggataggagaaacaagttgtacgccacgccgcagccgcacaagacttgatcctcttcttcttcttcttcttcctccaggctccagtggcgatggcgaccatgctctgctccttcacgcccgccaccagggctccgctccttcgcacttcctcctcctcttcctctctcggcttcgccacctcgcaactcgccggcctcagcctcggcctctccgccgcagccaccaccgcgccctccgccgccggtcccaagctccaccccatcctcgcgcgtacgtcatctgcctcctccttcttctctctgtttcgagccatccacccgcagattgacattacagttttatattacaccaccaatgtcatttctgctactattaaagttgttactttatccttcgttttttttttgcgctatccaatactccactgtatatatactactactagaaccagatgacctatttgttagtaattgattgctttaatctctcgaaaatagactagctgtcaatctattaccataaactcagatctttctttgtatttttaagagaatggaagctttattgaatttggtcgttctttgcaccatgtcagtgcacaaccaatagataccacacaacaagaaaaacagaactaactcaacgattaaggacctaatatcggaagactaggttgccgctcatgtgcctgggtaaaaaaaaaaaaccttgaccacatgctccaaatgaagacaagccgaacagacaaaacccctgtaatctggcttcttgagaataatccatgatcggagccaatgtgtgatcaagaaaataacctgcaaagaagaagaaacaattttcctgtcaaaaatcacatcattcctttatagccaaatagcccaacaagtcaactcctagtagaaaaggaggcctagactctttgttttgtcgcaaactccattgtccagacatatgtgacacactcctaggtgaagaaatgttcgatgcaatctggattaaagaccaaactgatcgggctagccgacattcaaaaaataaatgctttatcgtttcttccttgtggtaaaaacaataggtcttattcccttttcaattccgtttagccaggttatcttttgttaacaccacccctcgacataaatacgatagaaacattttcactttgagagggatttttaacttctagatatgtttgttaaaattgggaactcttgtatgtgcaagataatgagttttaaccaagaatcttccatcaggtgttagattcaatttaaagtcatctttctcgtgtgacaacactatattagcaatgcgtggaaagagatgattccacgccactaacttaaggccaataatatccttgcgccaagtgaaatttaacagggttgtttagaatatatttgaaatggttgcttgtttatgtctgacaaccatctctttgtttctctaagacataagcagagcttcttcttcttactagtgtatataagaaagaagggggaaaagaaaaaatataactattctggccatttcaagttatagttttagttttattctaagtcaaccattcataactttaactatcaatttcttatttaaaaagataattgtgacttatcaatttctagaaatttgtaaagtttaacaacatgttaattgtactatatattatgaaggtacttttcatgatgcatatataaacacataaatattatgatattaaatgtttggcttatgataaagttaaggacaagtaatttaaaagggtgagattatactttatcttttgtttgcatgatgccacaaattatagaaactagtagtagtaggaacaagatggcgtgtatggtgatgttgttgtatgatgtgggggtgggtgactcaggccggatatgccccttcacggacaagaagaccaacagggcgaacaaggtgtccttctcaaaccacaagacgaagaagcagcagtttgtgaacctgcagtacaagaagctgtggtgggaggaaggcaagcgcttcgtcaagctgcgtctctccaccaaagccctcaagaccatcgagaagcatggcctcgacgccgtcgccaaaaaggccggcatcgacctcaacaagaaataaatcaaatcatcatcatcatgatgcatacatacatgtattctctcatcaattgccgctgtgctgaatagaccagagctgtatgtagtccattattaaatccattcatctcgatgatgcaatttattgtagagtactacagtatgcattcatcggtggtggtggccggcttcgtttccttaaatttccttttatcccgtgttgctgctgcaagtccggctcgaattgtttgctactagtgtttcatttcggtcgagttcctaattaatactgtatgttggttacgaattataagatggatggatgtaacttgagcagcatcaggtcgtgcagttggcatcttgcgcttttcactttagagtgtcttccagtctaagctgaaattgattaattattttatttcctttttggctattgatatttaataagagcctaaatgaaagaattaacttgtacaaaattgaaaagctgtttgttttgtacaaaaggaactcctacgccaatattgattgttctactgctatggcctgtctggtttgagatagctgaaattgatggattgttttattcccctttttagctattgatatttaataagagcctaaatgaataatgaacccctacaaaattagaaggttgttttttttctctctaaaaatgtagagacgagaaaaaggtgttgagttgtagacgtggagcaacccggcagctccacacacgcgcaacctctgtctgtctcaaggactgccaatccctcgatcccctcttcctcagtcctcactactagtctcactagtcgacgtctcctcccaagtccaaacggtgccattgagatcgaactcgaagagagatactagtagtcgatgagtatggagatatccatggagaagaatttggagaagcggtcgcgcaagaggagcaggtacctctcccctccctacaccttccccttcactacagtcactgtccaagacgacgtgtccgtatccgattccgatcagtcggaggacctcaccaatgtcgccgtggcggacatgctgtcggcgctccacgccgccgcgctcttggacatggatgctgccaatgtccacctgctccgccgcttctttaccctgcacaagaccacctccccttcttcctcctcaacccgtaagcaacttcaatccattatattcattctagtacagtatatactagcatagcataggatatctatctcttcttcttgtactcttttatcttgaatgctgctgcctgagcatcatttattaggggtgcaggaa

SEQ ID NO: 60816 - DNA, 2358 bp, Oryza sativa
aaataaaggttcaggaccacaccttactccctgaagacctattatcccctcggtgtgcagcagatgtctgcagaaagcataaacattattaagatagtagaaataattaggatagaagatcaaggtccagtaggaggcattcttccagcgttaaccgcacataaccacaacagaagatcccgcaaaaaagggcaacacaaggaagatgacaaaaatgaactaatgacattattattcatttgtacatacacaggagcatgatcgattagtgcagtcttgtttttacagagggtagaacacagttgtaacatagtaacatattgatggcagatcttgaaacttgaaagcaggtcaagttgagctattagaaatgctataaaagtatgttaaacatgagaaatatattatatttgaagatcgagctgtactactttgagaaaatctattcatctgagggttaaaaaaatagcccagtttataaaaatgacctaaagggccgcaccagctaaatacaattgaacagcttgccatgggcttagaaaggtactagtatatgaaaagaaggtatattgctcgacaaatttattggttgatgtgcgatatttggttatgatttaaaggagttcattggctgaaatgtgatactgttaaaggctagataggaaataattatttcttttgagatataaggaagtaatgtgacatgggcaccacaaaacactaaattgtgcctaaaattgatgcccagctaatttcagcaaatcttgatttacagcgtgatcagttgcctacctcaacgtacgatcttgaaaatgatccaggtgtagcttcattatgtgttgacgcaaatgaaggcctccctgctcaaacaagcagctaatggttgggaaaagtagggtaacaccagagacacaccaggcgcgcgcgcacaaagagagagagagagagagagagagagagagcaggaaggaacttgaagttttactgacctgagccaaaatcactgtttggcacaccatacatattagtttgctacaaaaagggaaatgagtcagatattcctgttatcttgatcacgttattggagtggaaaaggaacaatgtacaacacacctgagaggctctccatggagtgttaactggccctaaaagtcgcaaacaatatggtgagactcatagttatcagggttaataattacattcaatcgtaaaatgaagtgatgccaaacaatagaagaaaaataaagaatgctttcggtaataggcaaaggtagcatttatagtctcctgccagtatggttgcagcatacctagggaaagtatgtagtgcaaaccacatatgtagtggaaatctggaaactgccgttggatcgaaaaatagatgtacgagattcgtccatgacaccaaataaaatttctactcatgagtaaatctgcgagtaaaatttttactcgtgatgacatggacaaatctcagacgtctattttcaatccaacagtagtttccgggtttccactacatatgtggtttccaccatatatttttccgcatacctaggctaaccttgcaatgcgattgtatgcaaagaaacaagcacttaactataaaatgatggagaaattaggtactgaccattccttgcagcagaaggggcatgctcttccaatgcccggtactgagaaaacctatcttccctggtaatatttatagaatccctgctatggttcagagactcacataaggatttcaattcttttgcttgggaatctagtgcttgtgttaatgtcacaagtatcttcttttctgtcaacaaacatgcaataatcagaatgagtgatataagaaaatatataaaatatgaagtatgtttagatgaattgggatagccaacaacaaaggggagcactgtgaaaccttcatcctttgaagcaagcaattcttggttagttttggcaatagcagaaacagcagatgcagaagcttttacagcttcagcagtttcctctcgatcttggacttaatttgcctgccctcgttttcatcaccttcagctacgaccttgcggatccaagacttaagcctaggaaggagcaatttctatgcaagacatgcaaatttgatttatggatgaatcagtgagttgaaaagtttcagatatgtggagaggtgagcagaagataccttgacaaacacagcagcactaactccaaaaccaagcaatagccctgcagcgacaatgcacggtaccagctgaacttgggctgtgtggcaacaataatagagccagcaggtgttgctggttgccttggtgcataaggttgcacaacggtagaagagtggttctggttgttggctgc

SEQ ID NO: 60817 - DNA, 865 bp, Oryza sativa
caagaatcagatatgtgcgggggaatcaagaatcagaccttgcagctgctgcgacggcggagtggtggtagggtttgggtcaccagtggccatcgaatcgaagcgaagcgaacgtacgtgcgcgccaaccaggagagcttggcttcttcaaccccccaagtccccaacccgtctcgtgctgtcgtggacgtgccaaacacagacactgctcaaccacgtacctctctctcctatatgctgctgcactatatccgatccgaaccgaacctccttctctcactccttccttgcaaaaatgctaagattttcctaccttcaaagaaaatacttctttccttttctcattggataacagagaactggttgtatcttgcatagagatggcaacagaataggtcacggtcagattgggctagacgaataaaaccaacacatctcaacgattgttaatactacctccgtccctaaatatttgacgccgttgacttttttaaacatgttttaccgttcgtcttattcaaaaaattttgttaaatatgtaaaactatatgtatacataaaagtatatttaacaatgaatcaaatgatatgaaaagaattaataattacttaatttttttaaaagacgaatgatcaaacatgtttaaaaaagttaatggcgtcaaacattttgtaacggagggagtataacataaggggaacataacttcggagttggggatctagccgacgtatcaattgggacttgctaggctagtggaatccaaggtgtcctctccgcgtatagatggccatatgacccgacccaggcacggcacggcccgactcaggtcgtgcccgtgccggctcggcccgatagccgtgt

SEQ ID NO: 60818 - DNA, 3231 bp, Oryza sativa
atggccatctatacctctgtggccacgtccttccacaactctagctagatctggtttgatttggttgtttcaattgacatctgtgtaggagataaccaagacggctaggagaatgcacagaggcctggccttgtgaaggactagatgaaggcaagatgcgaaccaactttccaaggtgcaagcaacacctagcacgataacaagcagcgtccagtgtaggatgtggtagttgggttggtttggtcattttgtttacttcagtccacaacgtaagatgatcacactcaacgaatatatcttggtcttggagatcatatgaccgaactactgacggagttcagttttttgggttcggtctcggtgatgagccgaaggtggggaagccaacaaggtaagcttagagaacccaagtcagtcttgtgatcgtgtcgtgttcgtgcaaaatactaagccacgtaacccatacatctgatttgaaccccacctcaccttctttgcttgtttgttgcttcacaatgacatgatatctcaacctttttttctaaaaaaacaaaacatatttctatctttaggcatatggtattatagagttataatatggaaatatttcttttttcctttcctgatcacgtgtagggtggtgctctatataaatgtgacagtctgacacatcagaaataggttaggccagaatggcccaatttgcatcccattttcaacagatccgcaaccccaactagaatacacccctcctgcggttaaactattagatgtggtatacctcgaagagtagtagcttgcggaaaacaaagccggtggagttgggatcgagcttggccaacatgtcgataggggcaggaacttgtagccaagtcgacgatggtgagccatcgaggcaaaggagaacataaaagatgtgagacgacaaggggtaagagttttcatggagcaacttagaacttataagttaatgcatagaggccacgctgaccgagagatcatggccctgcttggcgtagctagctgcaacaacattagttcattttgtattgttggtactgtagtcgcagtagcaataaagctacaatagcactagcaaatgaggccactatagatactatatcataagagcttctctttatatgggttgtcatgagatgcttttgaatgcgtcatatacacggtggagaaaaagtttaaagcttgtggtttggatcggcttggatctacttgaactcgtagtcataatgggtcgaaccaagctaggctttagctagtgagcttaacgagccagcttgtgagctgctcatttagctcattatggtaccacatatcaccatatcttcacttactgcttcttaaccatagatttagcctttaattaccatatcttcgctattatttaatgtttattattaaatttatatatgataaatggtaaattaaaaatataaaggtgatataaatgcgttaatgagcctaacgaacaagctcgtgagctgagctgagctaagcttttagttctctaaggttaacaagtcaaaccgatctagctcagtatccgcccctaaatccctaatattgttatatcttcctatcaacaactttcagactcccctatttatatgcggagaagatagcatgttgagttcccatcatccgcttattgcctcataagagcatcaccaacaaagtgccaaaattcaatcccctaaaatcttttgtatgagaatctctaatggaattcaagggataaaaatatcctcccctcccaacatagtcaaatttaacttctcaaaaaaattgagtcatgcgagaaacttcgtaacaaaatcggacctcttcttgtactcccgtgtgcaactcctcctcttggtgtgcacgaacttgcaattggagcgattgcctctcccaacttgtggaaagctagatttaaggagaagggaatgagtttagagctacctttgtagattgatttttgcttgaaacacaagattaagggattggtgttagggtcatgctctaaaccgcaaccaaaatttaaagagaaaatttcttatttgccaattaaagttcacgagtttccttatatgccatcgaaaatttgttatccctttatatgcgactgcttgaacttattcttcccctatatgccatctatgttatcatcttgtgtaatagggatgtaaaagtacaatattaccctcttagtccctcgaggggatgtctactctcttttttgcatgtcatctaaataattacaaaaatacttgttttaataacatagaaataatatgtgatatatcactaaacaaatatgcaagtttaaatttcacttttacattttttttaaaaaaaaatcaaatttggttatgagcacacctatactagttccaattaaatttgttgtttgcgttacttctattttgccatgttggatcttaattatgttgaacagaaggtatatataatggcttattatatacgtgatgagataagacaggcatgtaactagctagccgcgtatcaaggaacgaatcgtattcatttgggcttctcgattgagagtcgggtcggatcatcgtataaacaatgtataactactactacatatataaatatacgtactataccgtagataagataagtcatataattaaattaaagaagagtagctagctagctagggtaccaaaatatataattaagcagatcgatcgacgagacgacgacgatgcagcagcagctggagcaggtggcaagagcggtagccgaggcggtggtgcgcatgacggcggaggtcagcgccagcagtctcgccgccgtcgtagtcgtcctgctcgttgccagcggctacttggaaatcaagcgccgctgtggcgcccttccggctgcggctgatcgcgctgctgcaccacctcaagatgatgataccatgagtatgatgaccagggaggaggcagcagcacaagaagatagcaactgctccgcatcggcattggcacaatgcaactccatctgctgcagcctgtcggcgtccacgtttcgttcaggaggaagccgcaacgacgatgataaccactccgacgtctcgacgtcagagtcagatgattcttcttcttcggactcggcgatatcctcgccagcagccgaccttcgcagaagcccctcgctatcagattgggcttgccccttgttcacccctcgcaacttcatcaggggtgcaggaat

SEQ ID NO: 60819 - DNA, 4367 bp, Oryza sativa
atttttaatgggtggcttttgggagttgataagaaaataagtaaactaatacttgttggagcttctgccatttgttgggcaatatggctgagtaggaacgatatggtttttgacaaatcaccatcattttcctatatgcaggttattttcagggtaactcattggctccggttttaggcacaactacaaaggtatgatgaagatgaagagtttctgaaggttgcatgccgaaagttggagaccacggttatgcaactatttgctaattatggttggagatttacaaatagacttcaataattgtgatctccttacgttaggctggtttcaataatagtgatcttcggtgtgttctattcatttagatttacactatgttcatgaaaactactatgtaataattggctgtagctcttttgagtaaaagccgggatattatattccattatctaaaaaaaatagatgtatatagcagtaatatgctattctattcaggccaggatctaccatgcatgcatgcattgtttcaaactttatcaattgatctgattggcacatgaaaatctctatatatatacacgtaaatgctagacttccattgttttatcatttgcaatacattgtgaataaaactaaaatcatatttatacgtgcaagcacttcattatattacttccttacaaataatggtgaaaccaaatctacacttttaaaattacggaaatgctagaggacgggatcctatcctctgggcggtatcacctcatacacaacgatgtgctaagtttgagccacaactctcacctccgtcgcagtcgcaccttgctgttactaattcgtcaagccaacgcctcctcgaatctggctcttcgctgatttctccgttggcgtttgccccgattaccactcatgttgatgtgatagatgtgggcacacacaccggcaacagcttcaccttgatgctttgctggacgagacagtcgtacatgaacaccaagagactagaacttgaagcaaccatgagctgatgtcaccggttgtctttttcttccaagcctcccacaggggtagctatgtcaatatgacaccgccatgtcagcgatcacaaacagaatagaagaaaataaggttgcggggagacatctcaaggtgtgtggtgatgatgccaagagaggtcagcgatcagaaacgaaatatgaggaaaggattttgcggggtgacatgttgaggtgtgtggtgatgatgccaaaagaggtcagctagcttctgatagtgttgatgaaaaaatcgaacacactggcctgggagatctgcttaactccagtgcaggtctaaaggttattgagatgcgggcatgccagtcagtttgatcctgcaactgacaagatatgcaaatagtagatcaaaacagccgatcggctgacaagccaatggagtagttccagccgatagccgataatagccgatgccgataccagccgatagcgatagggtttaagcaatcagctatatgtgcaatgtagataatgatataaaggcaatcggctgatgataatataatatagcaatataatccagtagaaaccaatcggctaacaataatataatagaataaatgttgattcgaaggttaaagcacacatcggctggaggtccgatgtcatgaaatccacaagattagattaaacagtgaaacatttgttgtcatcggctagatccaacttatatgtatatgcaatccttatgagccgatgcaacgtcaagataactcaccggctgaaaccccgatgaaacccttattggcagtcaagaagcaggctagagattatggttctaagcacgacttagtagatcaaacttaactgatgcagcactaagtatgaaaagaaacataatgtctagacaatcaagccgttgactgagtttttagggtggtagatgtttaagctaatctaatctagcaacgcgatttagccgataccggcagaaaccctaaaacgagaagcagccgatagagctaaattgatatgctaagactagattaacagagacatatgataaataggtaggcaaatatatcatccaaaccagaacaatccaaaaggtcgaatgtactgatgcagccttgaacgacgccgatgtagatgagaaaattgcctgggccggcggaacattggacttaccccttagccggagatcgaacaccgatgcagcctcgcgtcaagtgccaagtcccgccggacgataaaataaagtagaaaaggtaaaaggtggcgatgcgccgaattgtattgatcgtagcgataaattacatagaccccgggtgtacatatttatacccatgggttgatacaagtccttgtcggacaagaaagaaactttcctaaagataaaaggaaaagataaagtccttataggacactaaacacactttcctaaagataaaaggaaactaacaaactattcctaattaatagataacttgccatgccgcattctctttgaactcggtctcttctagataagcttcctctagtagatcaatttccttaaccgaatatagcaagaatccgataactgacgacttgacaactctcatcggctaatctcaggacttcgaagctgatgctgactctaagccgatgactactccggacttaccaaatttcactgttaacagataggcatgcattgggtgagagtaaagttggaagaggtaatttatgttttgtttgattgtgtgcatgccctctttcttatgatttatatacaactaaaatggatctaggtactagatctgtcacaacctgataccaaatttgatacctgtaagatatcgtattgtagttgtttataaatagtatcctctacaatagcatatcccatgaaaattaaccacctttatcattccaatctaaatactaaaactacccaccatttccatccgacatgattttaatcttagccacatgctccataaagatctattcctcatagaatcagttctgcctattagttttgttttgataaaatactactatacaatgtagataatttatttttttgaaaagaaaagttttttttgggggcttttagcaagagagttggtggatgattaatacagaggtgggataattattttgctattgtataaacgaatgattattcttgcactaaaattgcaatttattgattttatcttttctttaagttgctccaaaaggcgagggaggtattagttgtatttgattgtttgttttcttgaatatttttgagagagtaaattctattactagttaattggctggctgctaaaatggagtaagtcactgaaatggaaccgttgattgaagtatagatggcctggatggaagcaaatttgcctttcatatcgcccaaaaagaaagaaagaaaaagaagaagaaggctgtgtcgtgttgttcgggccgcatcttggcccttccccggccgcgccgccgccccccatcctcaccgtcgtcgctgccgcgcgtcccttcccctcctccgcccgtgtggcgccttcgcaccgccgccgtcggtataattcctctttcccttatcgtagtctgaccaatctctggaatccacaagcttggtggtggtgggggccatggccgacgccgacgagctcggcaggaggctcgccgccgtcgcggtctccgactccgacagcgcaaacaacaacctcttccaggtgatgcgcgccgtggaggacgccgaggccaccatccggcagcaggtatcctatcccattacgatttcatttttcatttttctgccccctccccctccccctcactcactctctctctctctctctctcagctggaggagaacagccgcctcaaggacgagctcatgctcaagacgcgagagcttgacagattcgtaagcggctccccgatctgcccttttcctctccgtctcttcttctccacccgaatctcaccttacaataatatggagtacatccgcatcgcacaactaactaactaactaactagtactgcaacactcgtcggaggtactagtattgatttgcattcatctgctgctctgccagaggtcagaggctaccaagcccacttctcttgccgacaccttttcaacttctccccatgggacctcaacatgcttcggtaccacttcctcgtcgctcaattccaggaccgctctagctgatcagcacaatggactctttcaccacactgaccaaatgctgcacgatgccatcaagctaaagtacctagataccgaccagtctaatggaatgcccaggaaactatctggggagcagagtgcgcccgagagtcgtgtgccgtcgcacctctctggggtgcaggaat

SEQ ID NO: 60820 - DNA, 856 bp, Oryza sativa
attgcctcttttgacagaatataaccttcagccttctgttcttgatgctcaatcaattgttagcaatctgaaggtatgtgccatctctcttatgcacacttgataatattatatccttgtttgttcttgattaagccccaagttttcaccaaaaaaatctatattatcttcaatagcgattctctatgatctgaagttttttaaatataaaaaaatgttcaacaaataaaagacaaatatcttctctaacataagatcttttatgaattgtcttaacaacaaacatggaaccactccttgcagacctcttgtcaggtgggataagagcaagctatcctttttctttatttttgttttaatgccaatattgtaatattactgcgcattactgcatatttttgttcttgtggggaataatcgttggaaaggtacacgagtgggtttgatcttgttccttacctagttgaagttgacctttcactaaacacttatttttctttttgtaggtcctgtttaagcatttgcaagagaaactcgctattactgaggtgtgccaattgattaaatgtcattgcttttatatataatagcttgtaagagaagcctgggttgtgagcatacattcacagcctggctagtagtgtgctttttattcttgcacagcttatcgctgatatttttgtatagaaaaatgaagctgcattctttgcaattttggatggtgcaggagaaactgaaagaatcacaataccagcttacaccttggcgagctgaatcttcaaacagtacaaatattcctgtgcaggcgccttctcatcctcctggaaatgcaatagttaccactgtatgactcttt

SEQ ID NO: 60821 - DNA, 1278 bp, Oryza sativa
gcatctttaagtccctctgatgcaaaagcaacttggtcaaggttatatgtttggttgtacagcatgtcacgctgcccttcgtacctgtcaggaaagcatatataagacagtatacagatgagcacagtaccgtaatagagtaagtaattcgaaggagaagcaaaagagctcaacaagatatacagagtgaatggtaaatgatgattgggttccttaactaagtaataaaatagaagtctctttttttcttataacataactgctacccttaggaaaatctttcaaaatatatatgaagaaccacatcggtacttaaccaaaaaaagaagatgaagtacacttagaaaggaaaagactctgtgcttatgaaaggacacaaacaatttacagagtcaaaattatgcctctttttatctcaaatgacttgtaagacgatgaattgtaaaaattggcgtaaccgggacttggtacaagatgcaacggtttataatgtcatcaatggcgagttctttaatttttcattcatgtgttgttgttgtccacaaggaagaaggcagtgcaacaatttgataggcaacacaagggcaggttgcaagagctcagctttggtgtctatgtatgatatttgggtgagggttggatggttggggttgcagtagagattattattattaggcaaaagtagagtaaccaatcttctaatctaatctaagagtatataagtatgataagtaatgatgatgaaataaaaaaaaaaggggagatatacattctgcgctgcttgaggaccctcatggcgcgtgccttgatggcctcctgggcggggcctggcctggtcttcttgatctggtccttgtagcgggcgagctcagcgtccagcttcttgatcttgtcgtccacggagtcgcccctcttgctgatctgcgggtttgtttgattcgattcattcgattgcttggtggatgaattgaatagaatagaattgaagatggaatcgaaacaagaaagacagaaagaaacccgatcggtggcatcctggatgctgggcgggggctcctggttcttcttggcgccgaagatcttcttcatcggaaggaatcggaggcggaggcggcgattggcttggatttcctcctcgtgttcttctttctcctccttgcaagtagtacgaaaagagcagggaagggaggggaaatttctcctccttacgtgtctgtttgtttcttctgtttgactcgtttcggtttctctctcccttccttccagatcaaagttttt

SEQ ID NO: 60822 - DNA, 977 bp, Oryza sativa
gcaaagctgattttaagttgtggggtctgtaatcattgggacggaacaacaagctaatcctggtgtcttttagtcctatcaggtgcaggtgcaaaataaagggcaagatataacaactaccaagggcagctcgatgtataaaaaagggtgaatagccaaagtggtccttcaagtttcatctgaggctcagtttagtccttgatgtttcaatctatccgtattagtccttcaagttttcattttagttcaaacttagccttgaaccaacaactctcttgataaatgacacttatacccctatcattcacatatataatagaaaaattgcatgcttgatttttcttttagataagcataataaattatgtaaaacgaaaataaattatgtactagaaagtatatatacgatagcaattgcttaagttccatgtgcacatgttgaaataatgggaagtacatctgcaatgttgtttattcatcttggttttctattttctagtatatagttgtatacaaattaagggcaaaagggacattttctaatagaaatattaactagaaatagccatatggcatattaagggcatattaagtgggcccaaggatgatttcaagccaaaacaaatatttagaggagctatgtggacaaaatgaaatgtgaaggaccaaattgagccttcggtaaaacttaagagactaaattagctattcaccctataaaaaaacaaacatatactactaacacagatgtggcttagtatgaaactcacggcgcattctctgcaggcttgagattgtattcagcaccatcagcagccaatatagaaaattcagtaggacgcccatatgggatattgatctggaaaattagaaaaaagattatgtgcagataatggaaacagaaaattctgttcaacagaatgtggctatattggaacattagagaacccagaaagtttaaacgaataatgcttgct

SEQ ID NO: 60823 - DNA, 999 bp, Oryza sativa
atgatataggtagccgaatgtccatgatatttactataactaaaaccttgaatgttcatgccaagtgtaagaacatctttagaccttttcaactctgttcataccgttttatatatagatactcgcacacaatttgcgtttttaatagtattttactcacattagggattagggatttatggttagtctttgtctattatgcaaagaatgtgttagagaacgcatatccatgttacatgtgcgtattattataaaaaaaactttagtcatttcattttttttaaatccccgtttgctctttccaaataaatgcttctactcatttattggaaacaaatgctaattctgtcacaaattagaataactcattttcccgatgcagtataaaaatgatgcgcttatttactggggttattttcttcatttttttaaacaactatgcgcatgtaaaaagataaaaagagatttatttaacgtgcagtccattacttcagtgggccgcgttctgcgcgagaaaaggattggaaaaagtacaccgaaggtccctcaacttggcaatgggatacaaaacatccttgaaccgtaaaaccaaatatgctgggtccgttaactatacaaaactagtcatcagaggcccttccgcggtttttatccgtgttttagtctacttgacggctgagtcagcgtgggacctacgtggaccccacatatcagctgggcacgtcatcaccctctccctttctcctctctctctctctctcactcttctcttatcttctggcgactgggcaagccggccggaggcgacggcgcagggcggcccaaggggcacctcttcaaccgggcgccgtcgccgcaccagaatggcggccagagcaggcgaagcggcgacggtggcgggcgagcacggttgcggagaggcggcgtcggcgggcgagagcggtgcggcatcggcgggctggaacgatgcgacgtcggcaggcgagagcggtggcggcg

SEQ ID NO: 60824 - DNA, 1451 bp, Oryza sativa
cctaaaaggtgccaaatgaacattttaattttatggaccacaggtcctgcctttttaatgaactgtgcggtttcttgaatcttgtcccaaccatttatatcagatatgaaagaagatttccatggctatttatatgtagttgacattttgcatgctgttgacaggatattagaagagagctaaaacttgatccatatgtgattcttgaaacaacactgaaggaggaagacgtaattgtcgaaagagctacagtaagttaagctttttcatcaatatatagtctgatagtattttgtagttctgcacatattcataaatccttttctgcattaggtaaataaagagtgtgaaaaatgcaaaaatcctgaacttcagtattacaccaagcaggtcagctatcgatccttgaacatttgatgttcaataagcttaattttcctttttctagctttgatgcttaactactttatgaaaaatgtgtaattgcagttacggtcagcagatgaggggcaaactgttttctataagtgcgcaaactgcaggcatgagttcaatgagaaccagtagtccccttagaatgagctttttgatcacttctacgattgtggtctaaaaaatggccatgctttgacatgacaagtgattttgaaatattttttttatgcctttgcttgaattatgacaagtaatggtgtgttcggcgagaagggtttaggaacctcttccccgtgcatggaaaacggggtggcttattagtgcattattaattaagtactttaacgcatggtttagcagtttgccaaaaacattgtatgtgcttggaaaacgagggagaagaagttggtaaagtgtagtatagaacataccctaaagaatcacattactttgggccacatgtccaatcctcaatcatgctgtttttcgcgggtgctaattgcacataaccgaagtgtttctgttttctaaagattattaacctgaaactgcattttggaccttacggtgctcatatgagctctcttacttccctcaaatcctttatgccctcaacctatgccatttcaacctgttccataaatcatacatgttcagcttctaggagatatggcattgtttgctaactgcaaaaatgaaaaggtgtataagaaaggctcgtatggtttgaggggtgtactcttgtcagcaccaggattccaaattttgcgataaatgggtgcgtatcagtagcgctgtgactcccggtaagagctcatcttgagaggttttctgttgtcgtttcaaatcattttctgttgggactttcaggttatgaccaagttatcaaatccagtgattagtttttttaaggagaattttttcttaactagttcgagatgaagctgggacaaattcgcagtcccattcctggtctaatggtctatgtgaatttctgaaaatcttgttcttgagct

SEQ ID NO: 60825 - DNA, 1271 bp, Oryza sativa
gttggatcacgcaaacggctatcgctagcatgcatgcatgcatgtagctagacgacgcgcgcatgcgcatcggaagccgatcgagagcggtagctctcaaaaacggtagcgcccgtgcgcgccgcgcggcgcgagcatcatcggcaccggcggcagagcgcgcggcggcggcggcggcggatgctggtgcctgggcagcgggagcggcggcagcgcggcggcgcgcttgacgaaccggcccttcatccgcggccgcttctcggcgttgagcttgcgcacctcgtaccggatcttcttggcgaacagccgcgtccgccgcttctccctgtaccgcgacacccgcgcctccctctcgccgccggtcaccgccgtcaccgccgcgccgagccctccccggcttcccgcctgcacgcacgcataggatagctcagaacagtacacaagctaggtcgtgaagaaaatggcagaaagaggaaagtgctttcatcatctaataaatagttataaaaaatataaataaaatagattaatttaaatatttcactttataaacatacagttttaaattcagcttctataaattttaacaaacatgaaaaaatataattgcagatgtacgaactattttcagtttgattggttcctttcgttgcaattgtaaaagttaagccttgtatgcttgcggaggtgatacatttcatattaatctatgttatcatttttcttaaaaaaataataactatttactccatccattttaaaatataagtatttttatacttcgacacggtcgtcgagatactacttcgaccaacaatatctacaaagctaagatattataaataaaaagagttacatattatgacagtttgttcaataatacatccagtaacatcaaatttacaggattaatctttttttattattatttttttactataaatagttaaattttaaaaatgttgacttaacactattttaaaaatgcttatattttttagccggagggagtaggtaatacggaataaaggagctaagatggagatgtccatcgagagatgaaaatccaattccggcagaaagctacagatctctgcgtgagagcttaccgggaagtccggccatgactcgctgggatcgaagcgagggcgctcgccgtggaaccacggcgaggctccgtcgcgggcccacgagtcgatgacgccctcgtagtcgagcttgagtatcatctccggccgcttcctcttcctctcctcccgctccggcgccgg

SEQ ID NO: 60826 - DNA, 1128 bp, Oryza sativa
ttagactggattgctccaccgcacaaccatatatactcctcgcgtaaatcaaactaaactatatctcctaggattactacactgaatgaatcgcattatggattttagatacttgaggggaaacaaaatcggtcgcgactgaaacagacgagcccagggtttcgcgcgagctagagggtagagcaatcggccgcacctcagccgtgaccgtgtaccgcgtctccttcccttcgatatctgcgccgtaaaaaaagagaacgaaggcatcagccgcaagaagaacacagcccagggctttgcagggagagagatggggaagacgacgacctttggccttgcgcttgaagccgcagagggggcaggaggcggagcggacggagtcgaatttgaggagggtgccgcacacgccgcagaagaggaagtcccgcgcctgccagaaggccatgccgccgccgccgccgtcgccggcgaagtgttccttctcctctagtctgtggttggctggcgatggtggcttgggccgatcaaaacggcaggcgtgttttagggttttttttttctaggtgggctcatgggatgggctgatgggcctacgaactcttgtttttctcgccgaatccttttgggaaaagtacaccgaaggtccctcaacttgtcaacgggataaaaaaacatcttaaccgcaaaaccagatatacagggtctcttaactgtacagaaccagaggtgcttcggcggttttgatcccggatttggcctacgtggtggctgagttagcgtgggacccacgtgggtcccacatgtcagtatatcttttccctcctctcccttttctgctgtttctctctctcacacactcttctctccgacggccgacgatgcagcacgggagaaggggagggtggcggaagggcgaggcggcggcggcgggtgaacgcggtggcgggctcgtcctccccgatcacactctccggcatggggaaaggatggcgcaggcggcggaccgcgcgggagaccagcggcaggcggtcgtggatgcggcgctcacgcggggctgggctggccgcgcggtcgtggttggcggcgggtgaggtgttggcggcgagtgcacccgggaatcgatggagc

SEQ ID NO: 60827 - DNA, 841 bp, Oryza sativa
tagagtttctatggaggttgttccttgcataagaagtggatactctagtcatctctctattctttttctctcctccacgttattatctaagtttacatgatatattgggcttgtgtttagaggcttctagtacttgctcttaggaaaatctaactcaaaatttttttgaatttaaagctgtacaaagagagcaccagttaccgcaaattatgagcctccgctgatcaaagtaaataggcactcaaacgatattgaccccttcagagcttaaaagtttttttaataaagaaaccagagattaaataaaatccactattagccaaactagtaacaaaaaaaggatcaaccagctgttgctaccacgcaacaccaccaccgtcacaagtcacgtgaaaacgaccgccaaactcgccagcatctgatgagactatcctttgcccagttgacactttcacaaaccacaaaccagatgcgaccatacgagccaattagccaaaccactttaccactcaaacaatgcttatcactgtatatattaatcctactagtatactaatcaccagctcactgaaccgagccggccgaaccagcccgatcagaccggagtaagaccggagactaagaccggactgagagggtatgtttgcagaagttttcgtagctgcagtttcttctaaaatcctcagctgctagaggctctcttaaacaatttaggttcttatttagattttaagaaattatagttgtagaattcataaaatgaattagaaactagaagaagctgagtttcctagcttatccaaattattaccaactactacatccgtcatattttaaatgc

SEQ ID NO: 60828 - DNA, 1670 bp, Oryza sativa
ttttctcagaagttaacacatgacatgctatggaattgcatagtttactgcccaaaacactgtccaggctacgacattgttctgttgtgccgcagcagaagcaacgaaaaatagaactgaagcagtacgttctaaggactaaggacttgtttagatgggactaaaacttttaaatccatattatatcggatgtttggacactaattataaatattaaacgtagactattaataaaacccatccataatcttggactaattcgcgagacgaatctattgagcctaattaatccatgattaacctatgtgatgctacagtaaacattctctaattatagattaattaggcttaaaaattttgtctcgcaaattagctttcatttatataattagttttgtaagtagtctatatttaatactctaaattagtgtctaaatacatggactaaagttaagtccctatattcaaacaccacctaacaaactataatcctgcaggtcctagtttaggccaaagttggcaatgaacaaccaatttggaactgaacagcccgcttgaagatttacaacacacagatcatttgctactcctaaaaggagcataaacaagtatcacaattctttgttaaccaaacaatcttaaggtgatcaacattgtgaacatacagtgtaacaaaagcaagcgtggacggtgacaatcacaagcaacagaatgaacaaaataatgcgagaaagtagctcaataggatgacaatgaaagtaacaccacgacaaaaaatttccaagagtgaaagtaatattggtacatcaattgtccaggggtaggcgcataggccaccatgagatgatcaaaagtccatatatgacaagtgtaacagctgcctcaaggcaaacaaaaatcgagggaaatgagggggagaagatacaaaaacacgaccatgtatacactcctcaatcagtaaacatgcagctaaaatgtgagatagagaatccctagaattttaagagactaaaagaaaatgggggagctctaccttagcaccacttatctcaactgtgtgggcgagcagacgaggcctgaagcatctgcaccaaccacggcaagctcacatatggtacaaagctgcccttcgatcgaaggaacaaaccgggatccacagtacgggcaggaaacatccttctggccacggtagattggaacatatgtggcgccacagacaacaaatggatttctgtagtcatagttcagctcagagctatccttcttgccactgcactgctgctgcacctgtcgagccctccttgcctgggcctcattagggttgttctccagaagcatccttgcaaagtgctctgcagtagcgaagttcttttgcttgtagcacagacccatagcgcttccaagcacaagcctcatatgaactctgctgaagcttgcagttagtgaaataagcagccaattcttgttggcggttgacatcatctctcaactccttcctcttaagttccatcctcaggccaagaacatactccctcacaatctcgatcaactctttcacttcatccacttccctcctcgagtctaccacgataagagggatggtatgcaagatgctaaggaactgcctcagggcttctgggaacttaccatctgtggtggccttataggca

SEQ ID NO: 60829 - DNA, 986 bp, Oryza sativa
tgcacttcggccatttaaaagcatgtctatgtgattagatcttggagttgttagtggagatctaggggtcatacttcctgctgaagatgtagccattccatgatcagattttggcccaaaacgagtcttacatgtcatggaaggaaggttttttatgtcatccagtgaaatagtgctatcagcctcctggaggtagtcaagcatatcagctgagcctcttctagaccaatcagagagttttggagaggggccatcagattcttcattgatgcttgaatttgatacttttgcaacatctggactgccaacagcatttggaaggtctttttgtgtataagattctaccaacttttcaagtgcttcagcaactctaattagacgttcatcaacgcttacacctttttgatcacatctgtcagcacttgcacatattgctgagtgattttctacataatgagtagggacatattcttcacatatgcgacacattattgaaccttcttcagaaatatttggctggtcagaccagtgaccccatgaagttttgtgttgatgcttgggaggaagagattgatgtgatgtagattccactggactgttcaattcagcctggctactaactgcagggggtgtatctgttttcttattaggtgattcctctttaataggggtagggtctttagggggttttgggacaggtgatggaaaaggtttccaggaagatatacgctccctggttggagactcaacctcctttttaacatctgttgtatcaagcggtgaaagaaacttaacaggctttatctcctggcttctcttccattttaaattatgttgctcttgactgtacgattttcgtacatcacttttgctgcctctggttgtagtgtcatcacctggttgagccaatatctgcctatcagcagattgtatgatcttatcacgttgatccataacaacttcatcctccgcaaagccactctctt

SEQ ID NO: 60830 - DNA, 1748 bp, Oryza sativa
gttagctattgttatatgggataaagtagaatgtgctatggacaaggctacaaaaagaaatgcattttcatatgagaggagcagaaactattaaacaccggaagcacatattatagaataaattcagccagttgtagcaacaatatgaatctttatagtaaaacatttctcagcaaactactacagagtttgctgcggactccaagaagttcgttttttttaagaactagcaaattaaactgaaggatatagctccgatagacataaacaggtatttaagtaagtaatctgccacaagtcaaatgaacacctcactccagtcatatatccaatgagctgtgtatatagaattagaagctgtgcgcacaattacattaacttcaatcatgaaatcgcaggaatagcttatgatcaactgctaaaaatagcaaccaattactagctttgaatttaaattgtctacaccttttaataactaggcgggcattccttacttaaatggtaagaatcattcttacgttagcaccggtggttccaagtttagcatctagacaccatgcggcaaaatgaaaatcatgggcgccaatctccttataactcaacacatctaagttgaaattattatgtttttactgtttttaacaactaccgtcgacacggtaagctctgaagggagcttgaattgaattgcttaatgctgttctccccttactatcaatgcaagagcttggcaatgataagctaatccccctatcttccaaaaacctgtagccggcttgcaggatcatgatgcaaaaacctggaaaacaagtttaaaggatgttcagcttgcaggatcaacaaccttttgcagagctctttccttccaggctcgttgctgtggcgccccgcgctggatgttcggccgctttccctttcccccggctgccactggtcgaatctgcccatgagcttccagccttcctcccgccgccgccgccgccgccagccgatgcagccgacgggtccgcctgcgcctgcccacgcgatagattactgctcccgagcgcggcagcgatgcggtgcccctcctgcggcaggggcccggatctcgtcttaatccggttgaggcccagcgaggacgccaggatgggcgacagcgccgccgccgacgccccgcccgcgcccccatcccgaagctgcgccgcggcggccttcctcccgtccgccgacgggctcgacgaggccgacgcaggcgccgcccccgcgccgcccttggaggcggcggacccggacgcggagccgccgaagagcttgtcgcgcttcctgggggtctccgatttgggcttcttcttgtcggatctggacgacgacgacgacgacgccgccgccggcgaccccgccgcgggcggcgcggaggtgggcgtccgcgggctgttgctcccgtccgtggggctcgacgactccgacgacttgtgccgggacgagaagaacctccccttgaacaccatctcctcgccgcccgccggggaggcgttcggtcgaacaggtggtgggggcggccgagcgagcgagactgcgagtccacaaggagagagagagagagagagggagagcgtggtagtggggacaaggccgcagatgtagagagaggagagaggagaggagccgaggaggaggaggactcggccggtcggtcggggcgcgcggcgcgtgctctccctcctcatccccttcccttgcggctcacggctcgggcctctgggtgg

SEQ ID NO: 60831 - DNA, 1837 bp, Oryza sativa
aaaatatatatgtgggatccatttgtcattcaaaaaaaataggacccacatatcatcctctctctcctctttcctccttcctctctctcctcttcgaccgtctgcaaggggcaggagttggagcagccggtggactttcgtccgcagcacacgtatgctgcatccggcctacttgacctcgccatcacgctcctccgcctcacgctggacccaaccaccatgttctacagctccgccatccacgtccacacctcccacagtctccagctcgccacactcgcgctgctctctgagatgctgggtagggggctcctcccaacctcgcacacctgcgccgccgccgctgctccagccctgctcctcgcatacggccaaaggtggaaaaggggagacaaagggagagataatggagagagagggaggaggaagaagggggaggagagagatgatggcatgtggcccgatagggttaatggactcttctgtcagatatggatcatgtttgaggagacgaagattctaaaagctagctggtttggtaggtagctatagcctctaaaaacatgaaaaaaaatggttcctcagcttgtaattttcagttattttctaaatagattgtatagttatacatcacataaaatatgtacgctttaaattggatcatgctttaaattgtaagtgagtttctagtaatggtaacttctcttacaatttctagctcttaaattggatcatgttttttttaaatattttcagcttctctatataattcaaattgtcaatcatactctattacaatgtcaaaaatctaaaacgacagagtagtagtaatattgaataaaatatgatacatttgaaagggtatagttcgaaatgtacatttgaatccaactcgggacaattcgtcggtatgctgtgtggacgggattgagagagacctgacgagtgggtttgctgttccggcgtgggggccgggggagtttctggtttccagcatcgaggattcgagatgctgccattgtgccatgctgctggtagcctgtgctagtcagcctgttcactggtgcagtggtgctgctgatgctcagctcagggcccggtctgggagagtcaaagattcccggtccatggtttgaatttggaaagagagaatttctcttttacttttctagtagatctgaaaattattttaattttgctaaggtgaaccggtgtgagctgagatctactccctccgtcccaggaagaagggattctggaagcccaaggtagttttagaataaagagtaaaagactaaactaaccttagtactagtacatccaattattagttacaaataaagtattactactgccacacattaataaaatataattagtactccatactcaaacacacatggagatacagggcgccaaggtgccaaataatttgaatgaagagttaagcgccactttattggcgggatgtaatacaaatttagcacaccccaccacaacaaaccctacaagtttcaaatctgaagtttccctcccactttatcacttcataactctgcaaaaacacaagtttccctcccactttatcccttcataactctgcaaaaacacatccatggctttagatctaaatatagcattagatgatggagatgaacatgctatacctaacctcaatgaagcagtggctgaagaaacagcagcggctgatcaggaggatgaccaggttggaggtgatctccatggaggtgccaaccgtgagcttcctggaggtgatttccaaggaggtgccaaccatgtgcttccttttgatctcaacttgcatgcatctgaccaa

SEQ ID NO: 60832 - DNA, 943 bp, Oryza sativa
ttgacacctccaattactgtcctcaatgtggttgcatggttgctttaaggggatttatgatgctatatcttttagattactttataatattcttgaagatggcatcttaatatattctaaatataaacaaatatgccatattgaattaaagttaattgaagaaatgcaccaagagttctcttgctgtagctgaaagcctgaaaacacccctaaagataaacaagaataaatagattttgaaacagaacttgcatgacaaggaaaaatgggtagaaactgttgtctgagaaggtagcagctgaacgcagcaagaaccatacctgtaccaattgtgtaatttctgatgataatgccgagtttgtgggaaacctcataatcattgagaatgcaattcgaggatcaacagcaaaagcagttctggcatgatcaatccatttatctgagctaattttaccacgaaatgttgctgcatctctgccatatataacatgctatacatgtaaatttgaactcaaagcagagtcaagaataaataaaaaaaaatcacgacgatagttactttgtatttatcggttgtgcccacacttcaagtctgtctgcctcattctgagaaagcataagaagtaattgtttacgcttttcccgtacagttgtatagttatccactgagccccagacagggtggttctgatccagctgcaaataaatgaatgaagcgacaaggtgagaaaagttttaaaagtagttagtgaagatggatgagaagtgattttcatggcaattattttaggtcaatgcacacggagggcagcgacagcagcattaggcatcagcatgtgtcagcagactaggcatattcatcccttaggttacctgttagttctctattagttggattcaataatcaactagttatcaggactctcctatgaatcaagccatt

SEQ ID NO: 60833 - DNA, 6990 bp, Oryza sativa
  unsure (1)..(6990): unsure at all n locations
ggacactatacatggagcagcgaaaatgctctacagctcattcacgtcgtcgtcgtctccggcgccggccgacgcgtcgccgctcttcttgtagacctgcttgatgatcgggccgcacacctgctccacctccttcagcttctcctcgtagtcctccttctccgccgtccgtgcgccgccgtcgttgtcctccagccactccagagcctccgtcagggcggactccatcctctccctgtcgtcgtcgccgatcttgccggccatgccgccgtcccgcacggcgctccgcatgcggtacacgtagttctcgaggcggttgcgcgcgtcgacgcgctcccggacgcggcggtcctcctccgcgaactcctcggcctcgcgcaccatccggtcgatctcctcctggctgagccggcccttgtcgttggtgatggtgatcgacttggaccgccccgccgccttgtccgacgccgtcnnnnnnnnnnnnnnnnnnnnnnnnnnnnnnnnnnnnnnnnnnnnnnnnnnnnnnnnnnnnnnnnnnnncgcaatcccggacaggtcgaaccgccccagctcgcggcagtccttcgtcaagctccgctcgccctcgaaaacctgaaaaagaaattcagagcttcgtcagtctcaagaactgaagaatcaatgttatcaggtcaatgcacgagctgaaatgtgcttaccttgatcgagaccgtggtctggtgatcctcgtaggtcgtgaagacctgcgacttcttcaccgggatcctcgtgttccgggggatcagcttggtcatcacgccgccggcggtctcgatcccgagcgtcaatggcgtcacgtcgagcagcaagatgtctggtcaccaagaacagcaatgtgtgaggaggactcatggcgtgaccagccgaacacgctggtaattcaaacgcatttgcgttacctttggtctcggcgccgccctcgccgctgatgatgctgccctggacggcggcgccataggcgacagcctcgtcggggttgatccccttggttggctccttgccgtcgaacatctccttgaggagctcctgcaccttggggatcctggtgctgccgccgacgaggacgatctcgtcgatgtcggacttcttgagcttggcgtcggcgatggccttccggacaggtcccagcgtcttcttgaacaggtccatgttgagctcctcgaacttggccctcgtcagcgtctccgagaagtcgacgccgacgaacagcgcctcgatctcgacgcggacctggtgctgtctgctgagcgcgcgcttggcgcgctcgcactcgcggcgagccttgccgagcgcgcggccgtcgccgccgatgtccctgccgtgctgccgcttgacgaggcggatgaagtggtccatgacgcggcggtcgaagtcctcgccgccgaggtgcgtgtcgccgctggtggcgagcacctcgaacacgccgtggtcgaggctcagcacgctcacgtcgaacgtcccgccgccgaggtcgtacaccagcacgttcgtcatctcccccgcccccttcctgtcgagcccgtacgcgatcgccgccgccgtcggctcgttgatgatccgcggcacgttcagcccggcgatcgtgccggcgtccttggtcgcctgcctctgcgcgtcgttgaagtacgctgcaaatcaagcagagcacacttagcataagtcgtcgtcgtcgtcaacctctggagcggcggccagaagctttcgcattacaaaccaggcacggtgacgacggcgtcggtgacgcgctggccgaggtaggactcggctgtctccttcatcttggcgaggatcatggcgctgatctcctcggggctgaacaccttcacctcgccggccttgacccgcacctcgacgtacggcttcccgcccttgtccaccaccttgtacgggagatacttcacgtctcgctgcacctcctcgtcgtcgaacctgccggcgacaggccggaaaaatccacccaaatcaatcaatcaaccacggctagcttctccatttgcatcgagagagctcaggaagaagaagaaaagctagtgaggaacatttacctacggccgatgaggcgcttgatgtcgaagatggtgcggtccgggttgagcgccgcctggttcttggcggcctcgccgacgaggcgctcgtcgtcggtgaacgccacccacgacggcgtgatccggttgccctggtcgttggcgacgatgtccacgtggccgttccggtacacccccacgcacgagtaggtcgtcccgaggtcgatgccgatcaccggccctttcgtcttcctccctcccttcgccccatctgcaactccgcacaaacaccctacaggaaccaaaaaaaaaaagaagtaaaaaaccgatcaaatttgagcacattgcaaattttgaaaacaaatcaaaccaagcatcattccatggtgcttacctgaacagaggagtacgaacgctgcgacgattaaagcagattgcttatctctcgccatgtttcttgctctgctcatgcaacacttgtctctacgatgtgcgatttggtgaagctgtgtaatggagtatctagtcggtctgtgttcggacgtccattttcccaacttatctccctcgttttccgcgcgcacgctttttaaactgctaaacggtgttttttttgcaaaaagtttctatacaaaagttgcttaaaaaaatcaaattaatccatttttgaaaaaaatagctaatatttaattaatcacgtgctaatggatcgctccgttttccgtgctattgggaacaacccatagcgaacacagccttaggcttggagaatgatcgtgatcggtcgatgcttgctgtacatgcggggggcttaaataggttctggattatggtgaggagatcggagtaggactcgccggagtgttctggccctgtacgagctccacatcacaaggcaccgtgaaaacggtccacgtgaggggtccaatcgtgggtggacacgtagcggggtggtcttggtcttggtttggtcaggtccagcgatctagccagaacgttcgtgtcgcgagtcaccgacaagtctcagctccgtcatggcatgggctgttcagtgggttggctggatggtctgcctaactgggccaaggattttagaccgtggaaaggaaggaatctctttttgtctctctctctctcttttgactcacgccactgcgtccctcgtgttgtgtcgccccttgggagagagctgaggagaatcggatgtaacattttctgtagatgtccgtggatatatcatttgcctgattccgagtccgtatgagaaagttacgcctattttaagaaatgacacccgaatgacgcctaggcatgtcggataagttcactttgggtccctctatttgtcacccagtctgattttcgtcccttgatcgcaaaaccgggtacaacaggtcccccaacttacgaaaccgtttaaataagttccctcggaagaatttgaccccggttttggctgaggtggcacctacgtggctaatttgactcggtcttcatctgacgtggcattgacgtgacgcttatgtggcaatttgatccgaaaaatattaaaaactatgggatccacatgacagtttcacacacaataattaaaaaaaatggtggggcccacgtggaccccacctgtcatcctcactaccctctctctctatatcctctctccttcctctctctctctctcctcttctccgccaccttcttctccgtcgcttcgccactatccgtgtcgccgccgccgaccacccagacaccctccgcgcaccgggacggcatcgccgagtgcctctacgccgcgctcgtcgtcctccagccgccgctccacaagctacctgccgcctctcaagtctcagctccgtcgccgcccctgtgcgccttccgtcgccactcaccattctcagggagagagaggggggatagagagaagaggaaggagagaggatagagagagagggatagagagaaggggatagcgagaactgcgccggagaagaaggtggcggcgggccgcggcagcgcccggggcggacccaacaaggaagtcttcctcctcgtcgtcgctggactgcacgaaagcgaggcgacgaggccgaatatggcgagcatctcggcaagcagcgccttgggcctccccatggcggcctacacgaatgccaccgccgcggtgctgttcgacgacgcggcgtccctctaccccactgcagcgtccgccgccgctgagacggcgtccccggcggcggcgaaggtggccgccacggccctctcgacggctgctctgatggcgcagaggaggaggcagctgaggtagcccgggagctggaccagcatgagcaggagcacgacagccatggcggcgcccttgaacaccaccgcggacgagtaggcgatcaccgtgctcagccctgtgatgaacagcttcgccatggccattgccatcgatcgcctcttgtctctgttgttcttttgcctgaacacgacgtgttcttgagattttttgatgaaaatttgttgaacacataatgtatgttcttgagattgagcagggagaagagatcaaagaggaagagatatgaatttgtttggtcgattggttgtgccatcgatttggttgccactttgagtggtagagcacgcattagactggtcgtttgcgacgtttgtttatgacaatgtactacctcgtgcagaatggttcagagttcagtgttctagtgttcctctcaagctgtctttgcagtttgtatcatcattgaatgtttattatatgttcaagtcaactccccatctctctgcgctggcgggagaggagggagcgactcacgcgcgctcgccggtagaccagggagctcgcctagccatccgccgcccttctagctcgctggcgggagaggagggagctcggcatggctctagcgcggcgtaggcggcgggaggacgacaagcgcggtgtagaagcgctcggcgatgccgtcctggcgcgcgtggaggtcggcggcatcgatggcatcttccagggcgccgaccacgcccaccgccgctgccggagctcgcctgctccaccgtccacccgcgccgtcctctgcccgggaagaagagagagagaggaaagggaacaagagagagaagggagagggaagaagagaggagtgatgctgacatatggggcccacatggccccaccattttaaagttatttctttttgcagctgacatgtggggccacactttttattattttgctgagatatagttgccacgtaagcgccacgtcaatgctacgtgggacggagacctaatcaacaagccacgtatgcgccacgtcagccaaaaccgcctttaaaaccgccgagggaccatgtttccccggttttcgtaagttgggggacgggtcatacccagttttgcggtcaagggacgaaaatcggtctgggcgacaaatagagggacccaaagtgaacttattccggaaaggaaacaatggcccaagccaatggttcccttgctttctaagaagtccgtttgaacgtgaaatttttgaaggattttgtacgattcgaactatttttatataaaataatcttaaggatctctgcgtttcaattatcaaagaacctcccaatttcatttttcgaatcgaactatttgaaatctccccaaatctgtaagctcgaagggaggcctcaccgcctcaatcctcatccgtgtctaactcgaacggtctgctccaatcgaccgttcctcctacaaaacggtggccgaattgatcacgaggggaattcgttcccgggctcgatccgattccttcttccaactccaaaccaacatacccttcctcgccgcggcgcgggatcccctcctcctccgtaccaaaccctagccctagctggttccctcgggtctccatggccagcgaggaggccgcccgctcgcacctctccccgcgcaagcaccgccgctcgccgcacgacgacgacgacgcggaggacggcgcctcctccccgaagcgccacaagcgcggccaccatcgccaccgccatagggtctcgccggctgcggcggatccggcggagggcgaggccgaggacggtgagatactagaccaggccaccgcggccgtgggtgtgggtgtggggagggggctggatgctgatgccggtgagacgggctcagtgcaaggtgttctacctgctccggtctgttccaagccccccatccattttgttgccgttggttataggttattttcgttaccccttgatcctttgttccggagttcttaattttcatgtgaatttgggcgaattttgctctgttttgttctggacttaatcgtacacaaagcgcgtagggtatggcggtatgctgttgttagcgataggaatacgagtcataggacgaacaattttggaggtagagtttatattaaggaagcaactaacaagcaatgaaggcatgctcgatcacctattcatttgtgttttgttatcatttgtcagagcacaggcaagaccaccctaggaaataggaactaaaacaatcaaatttaatttaacttttgtgaagaacatgtctgcatttgttacttatcaacgaagtcttttacttataacttttattagtaacatatgcctcagtctttgtgggtagatggcatgcacttttttttgtcctgagttaaaattaaacacaattgttaatttaatctaaactaatttgtaagcaataagctaatctagcttgccatgattgttaattcacgtcctgtatgaactatgaataagggaataacttttgtgtaacaggaattcaaagtactgtatgtctcaccgcagcctattctgttcttctattgccacattgatgcaacttttaatattcactggtttgcaaaaaaaaaaagtaattttaggcatgtctgaattattataga

SEQ ID NO: 60834 - DNA, 2274 bp, Oryza sativa
  unsure (1)..(2274): unsure at all n locations
tacattttacaaagcacgtgcttgtgaagttgtgagcatataagttgactgacggattactagtatgattcataccaatagcattaaatatctagcgaagttattccaatggtttgagctatattacagtactgtgtctagcgaagtagagatgtgactactatgatttgaagcatattgtaactgaaaaaggtgttattactgcttggtaatgcaaatactgaggacctgttcgtgagtaaatacaagggaaatgtaaggagctgtgggtaaacttttctgcccgtaagtgaaggacatgcattacacattacacgttcattttaaaaaaggatccatcatggttactcatgcttcaatcaatcacattatgaacatgaaacaaaataggtggactgtgaagccgtaggcttactttgactgagaaattgtaaagaaaaaaaggaataggttatccaccgtgataacaccatcatgcttcaattattttaaggatataaatatgtgaaactgtaggattaccttgaatgagaaattgctgaaagaatagttgacatttgagctagattcaaactcagtgaagccactagactcatccccctatttgcacaatttgcacaattgtttagtaaaatgactgaagaataaaaaggcagacaaacaaattgtagttttcttttcctctacttatataaatgctgatgattcataccatatcatcttggtgattgctcacacagctactgctgccactaaggcttccattatcactggaatcctcaaattcgtatgcttcatagatgttttcgtccgatggattccaagaataacggctggtgaagtagctcgtgtcaaatgcactatctgaggaggggacaaaggcagcctgcatatgattccgtgttatcctcggtacacctttacaatggagatgcaactatgtttaaagaantaaatagttaaccatttatcccaccttttgcctagcaagggtattcccccagctatatgntnnctttaaaaaattgatgctgcttaactctgaagggaataggaatttaaatnntaagctatcaatcatttatgtatcataagaagttttgaattaattcnctattacnnaacggatgaaggtttctaaaacctcaaagtcaaaatacctcagaggcgccatttgcacctagccgttggtgagggtcttctgtcaataatcgtgggtnnaaagcagtcataatatcacattagttacattacaaacaaaaaagaaaacaataannaccacnnaataaacttcacaaaggattttgaaattgagcatgaagtagatagggagtattgtaataatatgcttaaattgcatgcgtaaagattccaaaaatacaaatcatattgaatagttctacctttgagcaaacagatgctataaaccatagaacacaactgaacacatataatatagcagtgtgctactgttaccctataagctgaaactggaaaaaagatagggactgacctatggcaatataaaatatagcgagtaccaagttatcaagcaagaaaatgtaatattttagagcagatgtgtccctgcctagtttgacccaaaatcctaattaaccccaacattcatttgtgttatttggaacctgaataatacagctaacaatctgacgtacattaattcacaatgctgatacgagcaacttttgggtggtgattttacagtacaaatgagggagctcacttcaattgttattgatggtgatgatcatggcaaaaaccctattgactttagtatagaaatttcatgcttgtcattgggataacacaaaggaaaatgcagtataaagacaacaatttattatataattggtccattgaccctaaaagtgacgtaaaagctgtgcaatctagcataatcatctatcacattaaaacttggaagcaagaaatagtaacatgcaatcctgtaagactgaaacatgagttactgtgtattcagaatactcgaaacatttcttacttgtcaattagatcctgagcttcagaactcatctcttctgggacatgtggccaaggtattttgcggttcagaatgttgtcgaaaattgtctacaccaaatacaacaagaatgtcaagttgccacagtttcaatacagcaaaaaacaacattgacttatatagcgacattttgcattaaatagatgaaaacccatgtgttttctagcagaccaaaacccatgtattttctagaagacctctttctctcatat

SEQ ID NO: 60835 - DNA, 946 bp, Oryza sativa
ttctagtcatcagagaacagaaaagcgcttacctttgagaggcatgtgaatgattttttagtttatcatgtactccctccttccaaaagtctaagtcctatttcattctttggtttttccaaaagtctaagtcctatttgtagtcattatatgctatattaatttttttatcggaacccaagaagtcattttagtactttataggttgcatgttcattggttttgtcacatgatgaatgagttaactacatattggtcttggtgcaaaaagaaataggacttagacttttggaaggagggagtatctaacattgaacataaaacaagaaaaatggagagaaaacttaacgatcatgcgcacacataaatacctttatatgcccgtcatgagctatcaataagttgtcaggtttaagatctctatgaactatgtgcatagagtgcaaatattccaaagctagcacctgcagaataaaatgattatcagacaaaggaaaagtgaaaatggaagaaataaattgttagtaaaagaaacttacaacttctgcaaggtatatacgagcaacatcttcatccaagcaccctaaatttctcagtagagaatacaggtcccctccattcaggtactccatgactagatacaaattttcccgggaggtaaaagaatagaagaaacgaaccttaaaagaacataaccaattcagaaccacagtatagctttcaatgatgaagggtcgcatttgcaagttcactcaccacaaaaggattcctcactgtaatcaagatatcacgttcagccaatatactctcaacagcatttttccgaatcatatctgccttccttaatacctgtttcaaaagtaagcaactattgttagaccacatggatgccccatccatcccaaaccgaaaaacaaaagctaataataaagggagtttagcagtc

SEQ ID NO: 60836 - DNA, 953 bp, Oryza sativa
caatttccccatggccccatgacctcgccgatctctctcaccgatgtccaatctggtgtatgaaggggggaggaggatgaaggacgccttagggttaggaacgacgtcaattggttctccggtgaccggacatgggatcgatatgggttggaggagtcggggaagggagggaggtggaggatggcgatcagctcagggaaagatggggaagaaaacggatctgagaaatggatctggaaaacagtcgtgctctattatattgagtcattccgttagaacgggagaccgttctatagtttttctggtatatttaaggaaggaagaatgaactcttcaacgtaagcactatatttatattatggtaataaatctatcctctccaatcataaatccttgatgttttgaattaggtctagtcaaactctaaaatttttaaccactaatgaattttacagtagtttaaaaacataaaaataacatgttagatttgtttattgaaaaatatttctattgggccatcttacaaacttattgcattaaacaaacctattttgataaaaaaaattgctacatccgtttcatattataattcgttttaactttttttttaaaagtcaagtttctttagctttgatcaatgttagatttaataaaattgatttggtggtgtatatatatatatatatatatatatatatatatatatatatatatatatatattctataaacctggtagaagttttaagaagaatggtttaaaaataaggaaaaatgacttataatatgaaatagagagggtactttaattatacaagtacctaaatcaccgaatgtcatataattttgtctcttttgaaatggagtaccagacaaaactagctcatgattttttttcggcgaaatctaatgcagtaacacccgagtttcttcatggcttttagcgctcctgct

SEQ ID NO: 60837 - DNA, 1876 bp, Oryza sativa
tttggtatgaaagttttcaaattttatttgaacgttctgaattttaagatgaaagtttttaattttgatttaaaagttttcatacctgagttgatatttttcaaatattgatctgattttgtttcaaatccaaaaagctttcaaaattttagttaaaagtttttaaatttgagttaaggtttaaaatcttcacttgaaagtttttaaaactaagttaaaagttttaaatcttgacttgcaatttttttaaacctaaggcctagtttagttcccaacttttttcttcaaacttccaacttttacatcacatcaaaactttctacacataaactttcaactttttcatcacatcgttccaattttagcttattatatatatatatatatatatatatatatatatatatatatatatatgtatgtatgtatgtatgtatgtatgtatgtatgtatggtccaaacttcaaagagagcagcatgcaatcaattgctaaagttgggaagttagttttcttgacgttgggacgtttgaacctccgtcacgacgcaaaacaacatgtctaattaaagtcactaatcctaatcctctacactgaagctttggtgtaccatcaaaaatctgtcttaagaaatcattgacacaacagaagcatagggtgtttgcttaatttctactatactttcctaactttttaaaagcagctattcaatcatgccatggtttaatatttactatcttgcctaagacgtggccactctttaaacaaaattttggcaagatggtgggcttatttagtttgctaccatgacaaaatattagcaatgtcaacacatgcaaatttcagtactgccaatttgtttttatctactaattgaatatatatgttttgctacggataaaagaaaatacattacaatattttctaaaataaatttttcatgaaatgtgttactcattccttttctataggaaatattccccttattttgattttatatatggatattgtcaacgggggatacccgtagaccagataaatagggtattagggtatgttggtacgatgatctatacgatacgacattaaaatagacaaaatacaatgattatattggttaaggcccctcgtaaaataataaccctaattcagtttatatgggattgatatggaagaccacagaatacagagagaacatacgaactcgttgagaccgacgagaccctagtcgagattgttcgatgagatctcccggcggcttcagcttgggtccttcggcttcgaaaactatggtcggcgtgttggcgctatgattcgataatccagaacccctccaggggtatgccttttataccgtggattgccttagtctccaagttgaactcggaaacaatgaaccctgcacgatatagaatagtcctagtccttcccgagtaggactctagtagtctccagctcataaggatatttcctataatattttatatatgtccttatcgcatatagaaacatatcttgggatatgaggtataccgatctaatatacttggttaattgtaggatacgagatatgtcttatccgtaatcctgacagatattcatttagatttgattgtttcttaatattaatacatttaataaagggtgttttgtaaaatttataatgagagtaggtgatgtggcaagttcactacgagcactaacttttttaaaaaagcaatatagacatgtgttattggaacactttaatagcaaaccaaacactaaccaaagtgcttcttaataggaactaaagtacttttaagggatcaataatttggtaaggcatatatttttttgaaacacagacaaacacaagcattataacgtgcacacgg

SEQ ID NO: 60838 - DNA, 3206 bp, Oryza sativa
ttataatgagagtaggtgatgtggcaagttcactacgagcactaacttttttaaaaaagcaatatagacatgtgttattggaacactttaatagcaaaccaaacactaaccaaagtgctttttaataggaactaaagtacttttaaggtatcaataatttggtaaggcatatatttttttgaaacacagtacaaacacaagcatttataacgtgcacacggcactcaccttacctctatgagcacctccgaaagattgggtcggtaagattgacgaagtcaccacgagcatttcattgttggcgggttcattatctatcactggaaaataataactagccataattataagcactaacgtcaagactaggacttaaacttagggggttggttttaccacaagaaatttagccggttgaactacaataatatcaaatcaaaatgggccaactacactaatatcaaatcaaaatgggccaactacgctgatatcaaatcaaaatgggcgtctggccaatttgattgatacaacaagcattcttttcatccaaaaataaatcaacataggttcaaagtggtatttcacctgataccaacatactgagtgacattttatccggtgcatcatattgagtggcattttatcgaatccccacgtatagagtggcatattgtccgttctctcggttctggtgtttaggaaaacagggaaatgcatccgccgttgattgcaccttgaacggctaagatcggaagtgactgcttaagtggcaatctcacaaccatgccatcctctctctctctctcctccctccaccccgccccagatccagcgcctcccctctcctccgctcgtctccgcctccggggctaggggttcgcctccgccgccgcgcccgccgtcgccggagacgacgatcaggggcgggagggccaagcgaagatgctgaccaagttcgagacgaagagcaaccgggtgaaggggctgagcttccacccgcggcggccatggatcctggccagcctccacagcggggtgatccagatgtgggactaccgcatgggcaccctcctcgaccgcttcgacgagcacgacggccccgtccgcggcgtccacttccacgccacgcagccgctcttcgtctccggaggtgagtagacccgctagatctctctccctcgcggggcggcgggcatgggcttcgtggcgtgttgcttgtttcgctcggatcctgccctggatcggaggacgtctcgaggcctctagttgtctctgtgatccgattagatcgcgtttgatttggagtggtggttggttgtcaaggatcctggttggtgggttgggttagtcggatctagtgcttgcgagctttatcatatctgcttacgctgaactgttcggtggattgttggtttgtaaccttcaggggccatttggttcatgtttatgaccagcaggatggcaggatctccatcgattttacaatcttttcaaacatgagagtcgatctatagctttaactgaagagtagcagcttccatggttgtatttctgataccatagcaatggtggggttggcaatcatggaacatttggattgttggaacttgaaactaagtcacacaccagtttcatctgtattgttggcataacagtggcccatatgatttggaactgtcataaaataagatcgaacaactcctgaactcttctacgttttccgtgatgcattgcaggtgatgattacaagattaaggtatggaattacaagacacaccgttgcctcttcacgcttcatggccaccttgactacattcgcacggtgcaattccaccacgagtgcccgtggatcgtaagtgccagtgatgaccagacaatccggatctggaactggcagtcacgcacatgtgtggctgtgctcactgggcataaccattatgtcatgtgtgcatctttccaccctaaggaggatctggttgtttcagcatctcttgatcagactgtccgtgtctgggatattagtgctttgaggaagaagtcagtgtcacctgcggatgacatcctgcgtctcacccagatgaacacagatctgtttggaggtgttgacgcggttgtaaaatatgtgttggaagggcatgatcgtggggtcaactgggcttcatttcatcccacgttgccactaattgtttctggggcagatgatcggcaagtgaagatatggagaatgaatggtaatactgctactacatccttttttttccttagataaacaacttcattatttttgtttgcatccatcatttttcatagaacagagctacagaattatgcatctgcttttattatgaattattttgtgttccttgatttgtctttctttgacagaagaactaattagcgtttcccccatgtctacattaatctgaactaacttgtcagcaaacaagcagaatgcaagagatgtttccagttagtaaactagtgccagtaggactaaaggtggttattgttgctgtatagcactttacttttctgtatattgttcaaacttaaaaaaaataaaaagtatatgcatgccagcaatcaaaatatttgaactagctaaataaccatgcattgctacttgcaacaggcaagatgaattgtacatgtgctaatattgtttgaaacaaatgaattatgactttttcattcaacacacccttcatctttgttattctaggtacaagtagcactaatgatttttacattactctacatatatatgtgtcagttttaccaccgtagacctttctgtgataaacttgatttagagatgagaataagatattaacaaactaaagaacttcaaggaagtaaaaaagatgtgctgcaaactttgtggggtgtggaacattcacttccactatcaccattgcattatttaaagggataataggtgatgcaatctaaatgtgctgttttttgacagacaccaaggcttgggaagttgatactttgcgggggcacatgaataacgtgtcctgtgtgatgttccatgcaaagcaagacatcatagtgtccaactcagaggacaaaagcattcgcatctgggatgccacaaagcgaaccggtattcaaacgttcaggcgggagcatgatcgtttctggattctttctgctcaccctgagatgaatcttcttgccgctggtcatgacagggtatg

SEQ ID NO: 60839 - DNA, 1241 bp, Oryza sativa
acactgcacgaaaccattcgtgtgaaaagtggtgcctgggatgagaatggtgtgtttatttacactaccctgaatcatatcaagtattgccttcccaatggagatagtgggattattaaaaccctcgatgttcctatatacataacaagggttattgggaacaatatattctgtctagatcgtgatggtaagaacaagctggtcacagttgatgcatctgagtacattttcaagctggcccttctacgcaaacggtatgatcatgtgatgagtatgatcaagaattcccagctgtgtgggcaagctgtgatttcttatttacaacagaaaggctttccagaagttgccctccactttgtgaaagatgagaagacaagatttaaccttgctcttgagagtggtaacatccaaatcgcagttgcttctgcaaaagagattgatgacaaggatcactggtacaggttgggaattgaggccctgaggcagggaaatgttggtattgtggaatatgcataccaacgtacgaagaattttgagaggcttgctttcctatatcttattactggttacatggacaaggtggggttcatgtgcaaaattgctggacagaacaataacctgatgggtcaattccacaatgctctgtatcttggtgatgcgttgaagagagttgagatcctagagaatgctggacagctacctcttgcctatattactgctaccacccatgggctcacagaaattgctgataggcttgccgctgagctgggtgaaaatattccttctcttcctgaaggaaaagctcgctctcttttgatcccccctgctcctctcacagccagtggtgattggccattgcttcgggtgatgcgtggtatctttgagggtggactggatgctactgggaaggctgaacttgaggaagacgatgaagctgctggtgctgactggggtgatgagggcctggatattgttgatgcaagcgaagcgatggcgaatggtggtgacggttttgatgctgaggagggtgaagcaaatgaggaggatggcgaggaaggtggttgggacctagaagatctggaacttctgcctgaagcagagaccccaaaaaatgctggcaatgcacgctcagcggtcttcgttgctcctccaccaggcatgcctgtcagcctgatttggactcagaaatcttctcttgctggggagcatgcagcagcagggaactttgacactgcaatgag

SEQ ID NO: 60840 - DNA, 1203 bp, Oryza sativa
cgcttagtgttgtaaatttcaatccagacgtgtgtggattgtgctcgggcaagaacagtttatagattagtgaattttgcagttattgaggataagaaatggatcagttgtcctcttctttggtaaagaaaagtcccaaggagataaaaacaggtgcataaatctacatgtttggcttaccggcccgttgcatttggtccaacaaaaattagtttgccagggactaccatagcaattttattggtataataatgcagtacatatgcttatttacacagatggttttgaaaatttgaatggttcattctcttgttatgactaaccttggatttgaggctttgtttttaattatttactggattgttgaatgggattatttgctccacactaaaaaagtacagtttctaccaaaactttcttttattatattaatgagaccacttgattttgttaggtttatttattaaaatatttaatttattccctataatgaagtagattattcctaggaaataatctgcttacataatctatttccatattgcccgtagtcagatttccactgagactacaagagtgctatgcgtgcccatttttcacctggtatttacacatgtattgttttgcctatgtatatatcaaatgcatgatgtggtaattgtatagtattgaggtattcattccgagataaatataacagtttgatatgttgattaccttaactagatatttttttatctgcctattatagattgttatgctgagaggatggttttatggttgcttatttttaaaggtatagaagattcagttgggagtcaataccgtagtgctttgttcatggttgattgccaccaatctacgttgggggagagttgtacaacacaatacttacgggttgggtgcaccaaagcaacccgggactctgtggtcactacaaaagagttggcgctaaatttgaatcagcctttctacccctgcatctacgttgagcaggtatctttaggtaaccgcacaatacctaacctaatttattgataagagtgcttattatatgttgataccggcaagacccaaccaaatgatgatgtctgcagattggtagtgagaggactcttagtacccgcaaaaaaagggcgctggtgaaaaaaacaatcatttgatttagtttcttgctctcccttagcagcgggaaaggagtct

SEQ ID NO: 60841 - DNA, 1154 bp, Oryza sativa
gcattcattttttttcttttctgcagggaatgttcgctgtatgatgctgctacgacagcttacgggcaggtttgcgcgccgtttcacagctgggcggtcaggaaggctgttggtgctgggatgtacactcttccaagcagggagcagctgatcgtgaggctcaacgaaactggtacgcaaaaatgcgacatccctgaatgttgtttgtcaggaatttaaatgagtatttctcctttgggtgaagatctttctgcgttcttgtgattttaaatggtgctgtgttgctactgcagattgctccgtgcagaaggagatgaggagatacatcgatgcctctagccctatcatagactacatcgacaaccttttcctctcgaggagcattagcctagactggtgaaactgaactggagttcatatttgcagctgctgacaaagctgtcgttgatgccattgttttgttcttttcatagctattatgtagccttgggtgtggttgtctggtggatgctcaccctgactcccttcgcagagtcatgtgtaatgtataactgtatggtgattcagtacgatcatggataacctgttttgccagcgattgggcacagaggaatggtggttggatggtgctatgtgaaaattatgtgtgttgcgattatctctttttaaattaagtggtatttgagaaactattgatgcctttttttttcttgaagaagtttatctaaatcttatcataaacgtcaaatataccagagacaaaaatatatattatcagggcatgaaactaaaatattatcatgtctagggcttctttggaacacattgtttttatagaaaattcgtaggattaaattcctataggaatttttctgagcccttccatttggaggatttgctagaaaaattgcatatgaatccttttttcctctatattttggggaatttcaaacatgagcccaaacctcttggttttggtttccttttggaagtccaatgcatcatctctcctttcaagtctaatcttgataatattcttcctctaaaattcctacaatacatgttcgacatattcttgtggattacatatattatcactttctattcctacatttttaaattattgcaatttaaaggagcccttagaatcacaa

SEQ ID NO: 60842 - DNA, 4523 bp, Oryza sativa
gtggatcccccaatgtgattggtgctcggagggcatcgggaggatcatctcttctattgagcagaaggaggagagccggggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtattgatttctggtgtttcaggaattagcagtagctaacagtttaccttttttgtgtttcctaaggtttattttctggttttgaatgtataggtaccttgctgagtttaagtcaggagctgagaggaaggaagcagctgagaacactcttgtggcatacaagtctgcccaggttggcctccgtgtacttttgccaatatatatggtgtatagcggtgatatttagtttgctatatcattatatttttcttggagtagctttataagttctgatatttttatgtcattcctaccagtgattttttatcctccatgctgtatcttcttcaccgtaggaaaatacttccagtcttgatttattttataagttcaattttcatttatgggatgcatatttgctcatgtttgagacatacgctgctatttatggcatgtatcatgtggcaacgttgagttatttattgcagcttcatggattttgatgcatatttatcagcagaaactgcacacgatgacacttgattgcttttttaggatattgcactcgctgacctgcctacaactcacccgataaggcttggacttgcactgaacttctcagtgttctactatgagatactgaactcaccagaccgtgcttgcaaccttgcaaagcaggttagtttttcatttttttcccttttgaagtttgtatcttcttggtatcttgtattacttaataacctgaatatttgaaactgaaggtgcttgattgctagtttttcatgaatagttatgcattttttttatgtagcaaaattcacgtgcaagcatagaatttaattttgtttggtaaattgagggaaaataactgatgattgcttatagtatgcctgttactaagtaaagtaaatcttctgtctttgtattctgttcaaccttaagaatgctgttcactgtgttttattatgcattcagatcagctgtgatgcgccctcttgatttgttttcagtatgtatttatctactccgctgcgtgtgttccatgtttcttctagtttgttgcatgctttttctagtttttagcacatcacattaaattagctactgctcaaattaacatactgaacgggctaatccttcagtttttcatctagttacctctgtgaaaaatgttgatcctgtcaataaatttctgttcatatctgaattgttttgtcccctagctttgatctggataatactgctttttttaaaaaaaatctgaaagatcaccaattaaagcttcgtgtcccttgaaactagagcttgttttctcacttggtaaagtctgatgccctcttgtctaggaatatactgaaagatgctaacttcatgtctttattttaggcgttcgacgatgctattgctgaactggacactcttggcgaggagtcttacaaggacagcaccttgatcatgcaacttcttcgtgacaatctgactctctggacctctgacaatgcggtatttgctctaatatgcttattatttttcctttcattcatttatactgtaattgttatcaaaacgattttctggcatctaatcttatgttcctctgttcttctcccttcaggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtcctttatttgtaagctcgatgtggacacgttggaattcgtgcttttcttattgtcatgagagttgagatgatgtttggattggcggcatcctgtccgtccaagggtcaatgttattttgaaggctagttcatttgacccatgaactcttcagtttatctaaatacaaccataaacacagtttatctaaatatacccataaatacatttggccccctgacgcaggatgccaagcttacaaatctgtcatctcagcagcccggaggctttcggtgggaggagtcgatctttgaactttttttattttaaaaataaactcccctaaaacttatttttaaatagaactcttttggcatggcaaagtaatgctaccatgccagctagtaaatacgttatttgatcacacctgatttggctatcctgataacgttgtttcgtcgtgccactatggttgacgtgtcatcataaaattatcatattacatgtgacatgactattattttgttgtttcgtcgtgccactatggttggcgtggcatcataaaattatcatattatgggtgacatgactattattttgtcatgttaggtggattggcgttaaaaaagatttaaattttagaaataagtttttagacggattatttttaaaattgcaaagacaaataaataataaaatttcgagtctctacctttaggctaatcggatctatatatcagctaggaagcacttgaataaaatgcatataaaatcatgacgatggcgatggttgtttttgctcaattgctccaagcagaagcgtcgatcccatacccaatcctacacctcttccctgatagcctctcgtcttctcttacctccattgacatagctattgtatgagattgaatttttcttatgcttcttgcttcgtttcaggttgaatcacaaacatgatgagtcgtacgctgttaatgattatattgtagtactagttcataccccatgcgttgccgtgagactttatggttataaacatcttcataacttttagtttacagaaataaaaataccaaacatatatatctaaatataatcaggttgcgaatatcaagtgcataaaaatgcttagttgcttctcatgccaaatgcactatgggtgtatggctcatcaaacagctaggatggctcaaataagagaaatgatataatctaatagtctatatttataggtgatgtgacttcttgtatgataagtttacatgagttagggggtgtttagatggggctaaaactttttagcccatgtcacatcggatgtttggacgctaatttagagtattaaatatggagtaataaaaaaactaatttcatgaatgagagctaatccgcgagacggattttttaagcctaattaattcataattatcaaaagtttactgtagcatcacattgtcaaaatcatggcgtaattagactcaaaagattcgtctcgcgaattagtccaagcttatggaatgggttttgtaattagtgtatgtttaatactctaaattagtgtccaaacatccgatgtgacagggacttagaataagtccctggaaaccaaacagccccttaatgctctaatgggttaaactacgtaggaggaatagaggatttgctcttattgacaaccaatatttactatttattcattttatgtagacagagttccaccagagccctagttttagttaaaccaaatcattgaacttctatcaagccaaacattcaatttagtcacatgattattaagctcattgctcgcttaattctgtctcctctgataaactgatcccacaacctgatcgaacaagttagccaaagaaccgaacgagacatgtctcgtgccctcacccacaattggactcatcgtaacgctattgtcaagtcaccgccataaccatggctgcttcctttccttacgaaattggggagatggggattcaaagtatttacaccatcacatagctatggctgccggtggtggatgagtcttctggatcacttgaccttttggttgtgaggctcgtatgcatgtcagccactcaaagttagagaactgtatatcaaagaatttgttttcgccaacgtcttgaacctatacgagtgaagatccagccctcgaataggtggagagtagccaaataacattttatatattcaattttaggtgtggtatatactactcctctgtacttaacatagttataactacactactttatagtataattacatctgaaagtttttggagagcttttctgtcgaaagtcatatacatagtttttgaacaaa

SEQ ID NO: 60843 - DNA, 2420 bp, Oryza sativa
tctctacttcctgtattttagtaagactcgcgatatgcttaacaataagtgtgggaagcaatttcagtagcataggctttgaggatgcagttatcatcctaaactagttctgtatagccattcgatctagcaacagcctttgtacaatgagttagttatgaatgtaaactttcaccatttgcttaatgttaagaggttagtaggtatgatttgtgagggtagcatgctgctttcctgctaactgtagtttctgttagggacttataatgtgaaataactaccgagtatgaatggccgtgcactataggagaaaatcacggcgagtttgttaagttctcttgcatgtcgatgaaggttgatacaatgtaaacgttatgctatctattgcggattatctgactcttgcttactttgcactttagactttgatctggagaaggaaagaggtggtttggatgagcagggtttaaagattgcagagaatcaagagaccagccagaaaaacagacgccggcttgctgagagcactagggatttcaagaaggcgtcttcagatgataagcttagtttattcaattctttgctgaagagttatcaagaggaagttgataatctcacaaagagagcaaaatttggagaaaatgcatttctcaacatctaccagaagctctatgaagcccctgatccatacccagctcttgcttctatggctgtatgttctatctatcatctactgtagcttatttctaatccccccttccgccttagtatttttgccaaaaccacaaatttccaccaatgcttaacattttgccttgtttgttttagccagtttccatcttgttatttcctattgacgcctaagtacatgcctgaagaattgtacttgtagttgtatgtgacataaatggttatagtaactcttattgttctgtaactatgtacaaccgagcaagttgttgcaataatatgtccagttacttatttgaaactataatagtaattttgtcagattgcaaaatatagataacagttagtttgctccagcatagtagaagtagtaaattgttgaaattacaaagccggatactgcaattttgtataacaaagccagatgtctcaactttaagtgcttccagaggagagctttcaacttcattgttttgtactgcaatttcgtgtaacaaagcaagatatttctaactttaggtgctttcagtataatagataggcttcaattattttatggcactgacatttctccccaacctgtcctgtttatcatccaatccattcaggagcaagatcagaaactatctgaactggagactgaaaatcggaagatgaaacttgagcttgaagagtaccgggcagaagccgcccacctaaagaaccaacaagcaacaattaggcgacttgaggagcgaaaccgccaactagaacaacaggtctgttctgattctactcagttgcttgctctcttttcttagctagaattaagtctatttcttgttctttccatgaaggaagtaaaaaaagataagttcggtcggatactattgttttttcactcgtaaatagtgacttattatatccacatactgtatacctttgaatggcagtccatttttctgacaatttggaacctttatctgtagaaattattttaaatctagtttcagaaactcacaatgagcaatattttagctattcttttgcatagattctacattctagagacagaaatgaatattttacctaatagcaatataagtatgtttttgttctgctgatattctgacctattaataatgtacttctgagcataacacagtcaatcaaaattatgcgataaacatgtctctattttacataagtatgtttttgttctgctgacattctgacctactaataatgtatttctgagcataacacaatcgatcgaaaataataaaaatgtttctatgttatttaatttgtatgaaaagtgaaatatttttttttcaaatatgtgtgttgcggataattattattggcccaataacttttcttcattaaattcctgctgatttcttccaatttatttcaaacgccaaacttccattgttctcaagttcttcttttctttttgcaatattctttcttccatttaataattttagatggaggaaaaagtcagagagatggttgaaatgaagcagaggagtttggcagaagatagccagaaaactcttgaagccctgaaagacaggtactgtgaattaatggtaactagaaatataactgctctatgatcatcatgtttccaatgcttttttttttgtctgaagcatattttttttaccttttagtttttcatggttgtagggagcgggcattgcaggaccagctaagacgagcccataaaaaacggggatcca

SEQ ID NO: 60844 - DNA, 942 bp, Oryza sativa
gctaatggcaaggagcaagaaaaggggctcgaaatccaataaatcaaatacctcctagcttcaactttgagagataactctagggtaggatgaagactgagttgaattcagcggaaatgaaataacattcatggattgagttgaggcaaaacctcctgctctcaaaagtttatgattgaaattcaacatcaaattccactcatttgcagcttaggatcaaacagacacaatagttttaaactaaactctttgcggatatagggaagagcccatacacaacccttaaaaaatgagcgaggccacatcatatatttaattcaaagctgcatgagggactaacaatgtggagagattgagcgtgggttcttaatgatttcattttaggagtgaagccgttgttccactaaggatgtgtttaaatcatccctggcgctattaaattgggtcgcaaacgtttgaattctttactttaggcaaaaggtggtacacctctcatgttttatcaagtaaaggtaataaataaaccgtatctgctagctaatccctatatcttggtactctactctcccatttatatgatagtggtaattatcaccggaagcaggtgaaagtcgtgagttgagtaagtcttggcaacaatgttttgcataactaaatactaacatattgtttacttattgtttacttatgtattccaccgccaaaacacaatgactttggatgcataggacgccgaacgctgtgaaggaaaggaggcggggtcatgctactattgggcatattatctattgatcatgcttacgtaacatttcaattgtttactagttcaaaattcatatatcaatatgagccatagcattggagtagttttgaaccgaagtactacctccaccgtcctaaaataaattcaattttatctattccatactttaaaaaaacaaa

SEQ ID NO: 60845 - DNA, 5009 bp, Oryza sativa
aggatcctgatggaagcttctacaccggggatgatcctgatagaagcttctacgacagggatgatctcgatagaagcttctacaatggcgatgaccctgacagaagcttctatgatggagatgatcctgatcatctttatggaagtgatgatgggcagccaaggaagagatctgaagatattatactgtcaagggctcagaatggctttgcatgtagagaaagcctagttaaggagactaaaaaagtatttcgctcagaggtactatcctcttagatttgaattctttaccactgttattctattttcatttccatttttcatgcccatatatagaggtatagtcttatctagtgcagacttcttttacaagctagcccgtgcatgagaaactgtcacacatggaccattgtattaaagacaaggttagctcagcggttagactgcgaaataggtaaatgtcgtagttcagtcttgttcgagtgattgaatctccatcatgcaggaatgcaaattttggcgcctctgctaggttttgaacgtggcatcttctacgacaacatcaatgctaatgccgcacattatgccactttccttttggaacaattaataattaatccatccttgtagaataactgccatttgtcctaattttgtgcgtctgctaggattagaatgtgggacctcctgctaggaaagtgacaacctgaagcccactaaccaatcatggaaagtctagattatttggttgttgctatgtagtatacgattttggaatgattggtaattaatctatccttgtcgttatattatttagtagagtaacattgtttaacttattatagaaaattataactgtgttataaatgatcggttaaaacatcttttgcattatacgtataagatgtaaactttaattgtttaaggcgccatgctcagatgatctactgtttcaatcagtgttgtcgtgacctttgcaaatccataaagctgtatgcgatctattacctttttgcattaaacagtacaataacttttttcctttcggcacatttaggatgaaaatggcagcaagatggtcaaccaatatgtccacctggggaagattggttctggaagctatggcaaagtggtaagatagctcacattatgttatgaagtgacttcccacggtaaatgtctaaatctttttttttttggcttaaaggtcttataccgaagcatgaaagatggaaagctttacgcagtgaaggtagggtttttcgctgtccttatgtgctgatttctttatgttagttactaatttttatttcttgcatctgaactcattaataactagctgctagtctgagtagttggttttactcgttcagcaccattattcttatggttacaaggttaaatttatgttgcgtgcacagtgtctgcatctaactgatggaactgtagcctttgcccttctattgtaggttttgaataaatcttacatgatgaaagtacgtgttgtgcgatcagaaactgccatgacagatgttcttcgggaagtgagtaactttctcagtttacttgtgattgtaatacatgtttttttttcttttttgtcatgacacgacttaagtgctctggaaaagtagtgctgcccattcagcccttgacccagttaggatttgggtcagtgtctgcacattctatttaaatgggtaatatgtaaatgtggtgatataattagcatagctcttgcactcaatatggacttacataagtttctcagtacaataaataacaaaccaacaagcccacttagttcatgcacaatgcattgtgcattatttttggctatttcttaagctgggtttatcgtctggctcatgttgacttgttcactcttaaactagccagttcaaacatggtttctcctgatcgaaatggatgattatagaattgtctaaggaaaaacagtctaccgggaggctcacttcaggtcctttttggtcaaactattgggctgggcttggtatgataaccttggttgtgtgcactttgaggatgcatcgctaccataacactgacactatcgggccaaccacatacatagtaaccaagttgtcatggtccgaaatcatggtgggtaaacaccaccagaggatagctggggcggcgatggttgctgcagatgaggagagaacttagacttagatgatgaacattagggagagactattaacgaatggacatacagcccatccttatttaaataggatggcttgaccttgaaggagtttatctctaagattttataaatagctagcaaatcaatctattctatacacccatgtgaacaataaccatgcgatactggacatgtccatgtgcacctcttcctcctccttggcctagggccttggccctgagcccaatacccaagttgagttgatacaagttgagtgtgctcactgattttgctctgttcaggacatgaacacaataaaataactggaataaactttgcttgcttaaagaatctctatgtactgtttaacgtctcaattatctgacagcatcaccttttgtattggtgacaggtatccatcatgaaaatgttggatcatcctaatatagtaaatctcattgaagtgattgatgacccaaatgcagataaattctacatgggtatgtaatgacattctcattttttttaaaaaaaatagtttccttttgtttaattgtagcatgagatttttcttgctaacttttgagcatctttatttaattctccatattattctacctaacattgtccattggtattgccagttcttgagtatgttgaaggaaaaatggtctgtgacaatggtttaggagaagctacctccagaaattacttgcgcgacataatctctggtgttatgtatcttcattctcatgtaagattcaaatttccttcactaaaagatctgttaaattgtggtgaacgccatgccatatatcagaatctacagcctataaacaccaattgtatatggatcaaactattcatggtaccatgaatagtttgatccactagcagtcatatcaactggtcatatcaaaggaaattcaaatttgccagtgtgttccactagcagtcatatcaactggtcatataatgatagtttctctgtacaaatatatttaagcagcttcaagtttgtattgtgcagattaatgcaagcaacatattttaacttccacattttctaaaaaagtcttgcttaaacttggttaaatcggtgaccaggttgagcagaggttgagatccactgttaagttatcgttatttgtactatagtcttagtctatgcttgtaggctgaagttctaattgcatgttactttccttgttcctttagctacttaactttctgtctttgaggtaattattgcatttgcatatgccaacttttttgggcccagctaagtggtactatttgaatggttatggtttcataaagaaaatattaaatcccattttagttctagattaggattatttgtgcctacacacacatttcttctcttatccattgtttgattgtattggaaattgagttcattaggaccatggttaaatttagctagaaatatgatactagttaaacttcaatcattaggaccatggttcaagaaagcactaggcgctagttgggtggctggggggcgcctagtgcctaattggcgccaaggcggcgcctaggtcaggtcaactagtcaaatccaaaaaaatagcacgcatattgcatagaaattagactatataacactaaaatagcaaaaaaaaaaaaaacactagccaagttagctcagctgcctaatacaccatcgaatgcctaatggcggcggctacccggcgcctagagacgacttttagaacactgattaggacagtgatatgcatataagaaatcttaatttatccatgctcttatgtgcataatgtatcttggtaacatgttacttgattccttaacatctggcaattcattacttcttaagttggtccttgttgatgtttctatttccccaatttgtacatacttctatattataatcagatacatgttgctctagtcacacatttatctacgttatgcagtctgcactgtgttatgtgcttcctaactcatcatgtcactgaatgcttcctgtcattatacgcagaatattattcatggtgatatcaaaccagacaatttgttggtcacaagcactggcagtgtgaagataggggatttcagtgttagtcagatttttgaggtgggcctttatcctctaacctctgtattgtagtaatgaatgctattttccttgtcatggcataaagggctttcagttgaatggatccccagaaaattgtgtgcatcatgatttagactgtagactgtatcaaaaatgcaattttggggctcaatttctaagacaagcattttttaattcaaaaacctcaaaagatattgttcatttccttccatcctgaatatttttaagattactcaagtagatgattgcatgccaccttttttagttaagcaggcccatgactttatatagtaaaacaggatggtttcataccacatttgattatctttaacttgatacatgatcttttttattgtgtgctaatgtagaaatgcctattaacatgtactccctccgtcccaaaatataacaacttttagccctcaggatttgtcccaaaatataacaacttctccaccaacattctcttcccaaccaatcacaaccctccaccattcacttttcccacctacctccactactcatccaatcgcaaccctccaccattcatttctacctactttcttaataaccgtgtctaactctaaaacttcttatattatgggacggagggagtaagtgtttttaggcaatttcttcgtacaattgtggagtctaatggcttagtactttactgataaagtgttatgtgattgtattgcaggatgatgatgat

SEQ ID NO: 60846 - DNA, 4087 bp, Oryza sativa
ggctatgaatgttatgccaatgattaaaaactaaagagggcaaagaccatgactcttttgccgttggctcaaattgcgacatatagtctttggccattggtgcaggctggctaaatatgaccaacctttcaatctaattcacttcaggttcagcctaccatggtcgggcagctgatacatgggcagttggcgttactctgtattgtatgattactggtcactatccatttctaggagataccttacaggaaacttatgataaggtacaaaaataccccccttccatttccttttgctttaccttttcattcaactcattcaagacattgctgtggaatagattgtcaatgatccggtgcaaatacctgacaacatgaacccccaacttgctgatttgctggaaaggcttctctgcaaaggttcttttttcaaaataaactgtttcaccgccttatgattctggcacattttgtgtcttagtgccagatatattattctactaatgaacattctcttgtgtttccacatgtggttgtcttgcagatccagcaaatcgtatcaccctgcaggctgtaggtgagcatccttgggttgctggggaccaggggccagttgttgaatacttctgtagatgtgggtttggccgaagaaagagagatgatcttaagggagaagtacaatagcaaaggcttgttcacagtttatcatccgatggtttactgtagataggcgatgagtgtggctaaacaaagaaagtgagatgatcgacaaaccgtgttactcttttttgtgttcttcctccctttaccgattgacctgttggttgctcgcctcaccacctctgcaagttttgttgcctaaccgagggagcccctgtttccatttttctgtagatcaattttggctgctgcaacatgtaagcttttttcatttggttgttgaatccagtatagcaaccattcatagaaaatatagtgcaaaattctttgtgaaggctgtagtcggtgttagcaattcatgagcaccgagtacagatgggtgcaggctgatctgcgggtacccttaaaagtgagatttagtttattttagttttagttgaactatggtgggttggaagatgtggccagcaccatcctatattagattttacttaagactcatccattcatggtgagtgaatctcttgtcaacggaaattgctgtaagttactgcatattttccgtaaggaagcttactgcaattacaggcttacagcagttgatgtgtttatgtgtgtaattatgtattatacacagtatacaccagttaatggagaggtaagacggcatacaatacacgcagaatggtggcatcaacgccaagagatcagccttttcaaagttgaaacccaagtttaaatcgatgagaacgagctttgttgctttggcttcctcttatatgcaataggagtaaagaagatctaccgatcgatttttaaggttcaaaggatctactgaaattacttggaacaattgctctatctaagacatcgatgatactacaaggaaacgagcaagatctgctttacaactcacgtatagattttatatatgttcaaacaaaatctgcagtataaatttatcaacaaatccataattacatatacggttaaggatttactgctggctttcgtttatttagacatatgtcaagcagatataattatagatgtgtgttgcgaatgaagagccatgaacaatgtaattgtaaactagaaaaaatgctacgaaaatatcgtagctactgtctgcttttaccagttttcaccggaatatttaaactatttttcactcttacatgtaagtctgtaacaattaactaaaaccagacgtcatatatccgagaatgctcaacgtggggcgtgcggggggaggggaaaaaatcggtcgcttccccctccccccatcacgtgcgcacctgggtccccaccacatatcccctgtccccaccggccacttatccacacacgcaactccattgcaacaaatcacctacatattttagaaaccctctattaaggaaatttggtttattttttgtttcataaaaaatgtttcacctagtatactcacaatgtttcacaatgtataggtctaatgttacagtaaactgaaatactccattgcaacaaaaaaaacctacatattttgaaaccccctattaagggaattcaatttatttattttttgttccaccgaaaaatatttcatcttgtgtacttataatatttcactatgtatggatcaaatgttgtagtaaactgaaacattctttcgctatttgctgaaacattgtttttatataaggtgaaacaacacccaatttaaatgagtgaaacattccgatatatctggtggaacatcgtgcaacatttaaaaataattcaataataaactatttttttcccgtcgaaatatatccatgtatggtcttgttttgaagatttaattgcaataaatttaatggtgcaatcggatcatgatttggataagtaatttaagagaaaaatcagtttaaaatagttttgcacgtaaatcatacgctgacgtcagcgcccgatttttttccaaaccaatcgggtgcccgagccgtagactcgtcctcatatatcaacacgtgtgtgacaaatgattaaacattaaatttaaaattgcaaatagttaaggccttgtttagttcctattttttttccaaaaacattatattgaatctttgacacatgcatgaagtattaaatataaataaaaaaataattgcatagtttgcatggaaatcacgagacgtatcttatgagtataattagtctacgattagccataagtgctacagtaacccacatgtgctaatgacagattaattaggcttaataaattcgtcttgcgatttcagcatacctcatctcagagttgacctatgaaaaagaaagcttctatgaaaacattctctatttccttcctcaatctgatgcctttagaccttactcggattcgcggctactccccgaaaatgcctcgccccttgttcgtttgtcgttggggattcattgctcgttctgcgattataagtaacgtagccagccaaatttatagaatagggctgcgggcagaagggcggctgcggcacaacctgggtgtggagacatgaatgagtcgaaccctattcatcatgatgtattgtcaaagaagtggctcggcgaggggctttatgctgattcaaggccgaaggacaaagctcttcctcttcgtgcttgtcctaaataatgatattcactaaggtgtgctggctctctgcttcaatccattttcttgctccatgccatagtaccaaaagctgcctctgatttaaaaatctaatttgtaaaattggctatggagattttgtgcggtaagagattcatacagaaacaaaggggcccccgttgcttgttgggcactgaacactttttaagatccggttttggtaagacgaagatttttcactttcatgaagatcgttctgaggtagaatcgaaccctcaatctccaaaatggaattgaaaagctccaatttaaataatggtaccgggcccagggaagaatcattctttgaatcatccagatctatcaatttgcgaattcaataaaaaacggactgatcctcagaatacaccatcatctttcgaagtgcgctgtttcaacccttcccggtaaaattaaagtatccgctgataccggatcggatcacgaagaaacgggaacaactttcgcactagcagaatgggtaccaccgtcaaaacggattgagaggcctgtttagtgaaacgagaaggcatgtttggctgccttcgaaggtaaggtgatctatcatgagtgggtctaacgggttttgtagggagcacacaacttctcttcttccctctctagaaaagctccaaccggattcaaagtaagatggtcgaaaggaaaggaagaataagaaaaggaaaaaagcaatttcgagaggagaaggacgagctatgaaattagttttttcattcgtgtccgaaaacttcttccgacattcggtcaa

SEQ ID NO: 60847 - DNA, 1567 bp, Oryza sativa
atttgcattcgccgtgtacatgctggcgagttgggtgtatcatgtatgcttacttgctgttacttcatgattgatgtgatggtttgcactccgcagattaggaaacgggactggagagagcagggggcacagctaaagacaaggataaataccaaattactctgttgccaggctgcggtagtggtgctggttcggagcgtttctgccatggatgttgatagcaaggcttccaaggatatgctccagcagactctagcttggtttatcgaggccactaagtcatgcatcctctcatcctggcgcaaactgaagatctgcgaggagctattttgcacgctgctcaatggtatcagccagataactgtctcacgagggggccaactcctgccagtgctgctgatccctttgaaacctctcgtcgtcagcacttgttcccaggcatgttcttttgcaccactgtcgcttggactcctgaaatttatgtgtttatagagatgctttctgatgtgaaaccggccacgttggtataggctgacatgacaggtagtagccctggggctttgttcgatgcagtggttaagttgagctgtgaaattatagagtttggctggacaaaggatagggctctggtcgacacattcattatgcggttagctgcatatgtccgtgaacgaaatgattatgaggaggaggtattcctttatccttttggaaattttctagttaaataagatttgctacaacacaagtgtcattatgctgggcactagatgaacatgttgtaccatatgttaataagcattatatgagcaatctcactatgtgttattcatgcatgttttatgaaaacactgttactgttttttttaaaaaaataactgccagttaacgtatgaaagttatagctaagtttttttaatatatactggtacttgatagttagtacagttgccaccacactgaaaaagcttcaacataaaagcagttattatctaccttacaattgttgaatggaacatgccccaattattccaacaattgtcacttcagcagtctttcaacatgctaagttaccatgatgcatcatttttagagaaaaggctttacgcccagctttcattaaaaagccaaatagttcatacaccatgatgcatcattggtagccttataggtttgctttttaatttcatatgagtaaggctgtaagggtgtaagagaagattagcttggtctttctataagcaattttcatccatgatgctgtggtaaactcatgattatactgtgaaaccagagattcaggttaaaatcggagtgtttcttttccttttcacattctccaaaataaaattctgactgttaacatccttttattttattgtagtaaaaaaaaatggagtttgattatcagagagcatttctggctacaaatatgctggcatcattttcttgcggaattctagttgtttatgaatatatgctaatgttcaagttaaacttgcttttgcctgcctgcatacaaagacaatatttttttaattagattttaattgctggtcgttttctt

SEQ ID NO: 60848 - DNA, 3013 bp, Oryza sativa
  unsure (1)..(3013): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagaacatgaacacaacgacttgtttattcaaccacctgcccaccatccaaattaccaatccaacgaacacaagcccattgatcatcgtactcgatctaagcattacactactattttaaatgtctgccatgtttccaaatgcaactttagccatggataaacgtcttgtattagaagagcatgacgttatgagaagcagaccagtgtttattaacttctcatttctaattaattttctagattatacttcctcaattttaaaatacagtaacttaagatgagattagatcattctataactatgagggcatgttcactttaatgacattttcaaccttatcaaattttggcattaccaaaattttggcacatgatttcttatatagttaccaaaatttggcagcaaactaaatatatgcactttttagcaactttaccaaaatttggtaaggttgaaaatgacatcaaagtgaacagaccctgaatcttaatataattatcttcagattcacatgttgctgtatattaggacgaagatagtagtaaaaatctaaattgtttgaggagcttaagaagctgcatttgctaaaacttccacagataagaccaatttatatactatgaagtagtaccatattgatatgatttatgtgcgtccattcttaaataacaatagtcggagttaccctcgtttggggtacagtaacccctcttccccggtaaagcaaaccccagtgcacgacatgccaagagaaagcagcagcagcgagaaaccctgtccgcaacgcaatctatgcgaagcgcacacgattccggagctcaacaaaccgagatggcgacgcctagccccttaggcaggtagacgacgcttgagcttgacatgagcacattagcatatggatgcagcgacaaataacagatgcatcatcacgcatataccacacctcgcttgccctctcgcaacccctttgcttaagcaagaggagattccagacagttgctccccacctactagtcgttccagcagaacaccacaaatgttaacttctcccccatacatacaaactatgtttgtatgcttagggtgtgtttagttcacgtgaaaattaaaagtttggttgaaattaaaacgatgtgatggaaaatttggaagtttgcatgtgtagaaaagttttgatgtgatgtaaaagttaaaagtttaaagaaaaaaaatggaactaaactcggccttaatgtgagaaaaatatactgtgcaaatctaaaaattactatagaataaaaaataaacgtctaaaatttatccatacttatctaaatttgcattacatatttcccgcttaatcatatataaacaacaatttttactgctactttaatttctttttctttttgattcgttcaaaaaccaaaaattggatagtgcttgagagccttataaatatctctctgaatttcttaatcgtaacgtggcaagctcgtgctacctgtacagctcactgtttatgacgtggtaacaatgttttgccaaagatttgtcatgccatattttgatttttgaacgaatttgtttttgccacggtgacatggaaggccctgccgaacggtttaaattaattacctgagcgttcatttctgaaacttattgaaatcttctttaaaagaacatcaaattcgcagcaaaggggaacccggtctcaataattaatcgaaggaataagcacaaatgcttcgcattacaggcgcgtatacatatatatttatcgtattttttaatctgatatatatataattttcttcttctagtctactacggcgaatgaatgccatggcgtgcgtacagcgagaggagagaaaaaacccaaaaaaaaaaagaaaaaaagaacgaatcaaattgcgccggcgatgtcggtggcggcggacggtgagctcgctcggttattagtcgaggcgcatcatgtcgttgtggaaggcgtcgacggcgtcggcggcgacgcactgggtgatgaggcgggcgccgggcttgtgggcggaggggcggacgaggatgcaggtggcgatgtagtcgaggttggtgagcggcacgacgtggacgggggcgccccacccgtagtccacctcggcgaaccccagccgcgaccagtcggagaccagcagcgtccggtagtcggaggtgatccggtacgggtcgtcctcgccgccgccgccgccgccgctccaccgcgcgaactcccccgggagccgcttcttcccctcccggatcagcctcaccacgtcgttcaccgacgcgtccgccaccgcccccgccgccgccgtcacccgcatgatgtagtagcagttgccgtagaagccgtccgggagcgcgcgccggagcacggggcgcgcgttcatggcgaagcacacgtggacgggggaccccggggcgaaccccgccgcgcgcgtccgcgactgccacgccttggcgatgagcacctcgaacgcgctgcaccggtggcccgtctgctccaggaacctcgccttgaagtggtcgatgtagtcggtggagatgtccatggcgaggtactggaggcggagctccgtcgggacggggagcgggcccacggcggcggacggcgggcacgggatcgcgtcgcgcccccacgccggcgccagcgccggcgccgcccgcccgcgcgcgatctccccgaccgccgtcatgaactgcgccgcgccagggccgtccgcgacggcgtggctgaaccggaacccgaccacgaagccgccgcacgcgaactgcgtgacctgcattggggaacggacagctcaatcacacgggctgcaggaat

SEQ ID NO: 60849 - DNA, 42300 bp, Oryza sativa
  unsure (1)..(42300): unsure at all n locations
gtgagactcggaggcggggtaggtggggtgggggaggagctcgtccttgtccaccatgagcgggtactcgaggtagtccacatcctcgagggagcagctcgccgtggcctcgatgaaccacacaccctcgccggtacagtcgacgacgagctccccaccatccccgcgctccgccagccggccggcgatggggtagtagctcacgagcgccgccgcgagcgcgcgctcgatcgccgcggcgggcgccacggcggcgtcggcgcggcccttgaagacatggagggactcgatgagcgcgcgctgcgtcgggtagcggtcgagccaggacagcgggagcgcgcccccaggcgtcgccgccgatggggccaccacccgctgagccacccgcgtcacggtcgccgccgccgccgccgcggagccccgcatggtggtggtggcggcgaggtggggatctgggtggtggtggtggtgggcttcgctggctgggctcggcttggaagcaagcggtgaccgttctcttggattttataaggtctttcctgtaaattgtagtgtggccgctacgactagttctttagtttttttcttcttttttttttctttttctctgcgtgtgcgtgtgtgtgagggtgtgtgtggtgttgttgatgactggatgtgaaagggattgcccaccgcacgatgcagagatggacgaatcggatccggccatttaggggctctaatcacctccagaatttagggtcagaataatgctacagtgcttgctttacaagaaaaatgctactctcggtttgtcacatggtattgtcaggtcctccctccgtattaggatgtcgttttggacagtgacacggttttcaaaacacaactttaacttattatttcttaaaaacatttattgaaaaatgatatatgtataattttatgaaagtatttttcaagataaatctattcatttaattttcacatttttaaactcaacaacttgagagttattcatgatttatattctcaaggtttgacttaaacattatcctaaacgactttctttacgagtacggagggagtactaatcagtatggaaaatctattaatttattaaaggaatagaaaaaaagagcttccacgttcgctttcacggcttagaaattctcatattaatcggagaaaaagaaacagagtctacatagaaatacaatttagaaatagttgaaattcggaattaaaaaataaggaatattgtaagagaagactagagtccatatagaaatacaatttagaaataactgaaatttagaattaaaaaataaaaaaatattagaagaatagtataaagtatatatagaaatacaattaagaaataatagaaatttagaattaaaaataaagaatattagaagtagagtatagagttcatataggaatctaaaacaaactaaaattcggaataaacataataaaattaaaagtagagtttagagtccatataaaaatacagtttacaaataactaaaatttgaaataaaaaaacatgggaagaagagtctaaagtcaatataggaatacaatttagaacttagaagtaattgaaattcgaaattaaaaattaaataatattgaaagatgagtttagagtacatataaatacaattagaaaaaatataaaatttcagaattaaaaataaataatattggaagaagagccgatagtctatatagaaatacaatttcaatttacagataacgaaaattcggaattaaaaaataagaaatattgaaagactaagtgtagagtccatataggaatatattttagaaataactaaaatttgatataaaaataattaataagtaacacgtatataaaatacaatatgaatattacacattagtagtttcataaagttagtacaaaatttaaaattatgttgtcattttaatatattttaataataaattgagaaaacatatatgctattatataagagaaaatataatgatactatctgcgcaatctgcggaccaccatgctagttagtactaaacagacagtatgaaaaatttggtgtactagctttttaaggcactgttcttttttttcaaccccaaacttcaattttctcgtttttcgttatcacgcttttcaaaccattaaataatattttttaaaaaaattgtataaaagttcttttaaaaaaataaatttattttaagtttataataattaatatttaattaatcatgtgctaatgagttttctcattttgcgtttacaaaaatttttcctccaaactaaggcaaagaatgtaaccaagagtgaatgtttgttgccttgataaaatttggtattaataagaggttggtttcgtcaacgaaacaaacagtcttttactttgtactagcagagtacatcgtacttgtgcagtgtatttactgtaaaacaaattgaaataaaattgtactgagtttgataataatgcataaacttactgtccatgatgccaactcttaaccgtatgagctctgctcaggaagcagtaagcggggtaaagcgcgtggcacgaatttttcttcagtttaantcagtacaaaccgtgtaattaaccttttctctgagttcaatttgctgctattttttcaggccagtgtacgtacggcaagttgctgtcgacgaccgtgtgtatatattcagtgttctgaacgcgaagttgtcgttggacagcaaccagtgtcttcttctcaccctgattaagcaatcgtttctctgcctgcgaaatggacttcatcaaagattacaagctttaagtgtaaaaaaagaagatcattggtcagtagacctaatcaagcgtgacaattgggctgcaacttcgctctccttttattttcttttttgcttttgttattcatactcactttgcttctttattcagcttggaagcattaggtatttgtcacagcaaaggtgtgcaggtgatacttgaagtgaactaatataatccctttcctaaaccagaaatcgctaaatccccagacggctggtgatcaccagggggtggctggctacactacacgtacacgggaagcaactcgaccccactgtgatcaggatgatcggtctcaattgctttaggccttgttcggttgcttgggaattaatccccaagggatcctatccagggagggattgagagaatccctcctatctcactcaaatcatgtggggttcgaatccctgcccgtttctaatccctgtcatataaaccctgccttcgtttagcacagggaaatataaagcagcagctgtacgttcccaagcaagcaatgaaacaatatgcattctcccagatcaaatccataggacgcagtaaaaaaaaacattgttttagcacagggaaaacacacatgcatgctgtacgttcacaaatgcatacatgaaagtgtcacaaagtaataaaaatggttacagttcagttgtttttttagaataaatagaagtagccagctaagagctaaactacaaattgaatgcaagtgtttaagcttagcactaatgccaccatgagcttcagtcacccagctgcagtgttcccatctctgaaaaaaaatggagcaaaattggatcaattccaaaaagaaatacaccatatatgttctttcctgtcaaccaaatatcaaattgaacaaatgtagagtacagattacataagagcaaacaagtaaagcaaagagccacactaatatccaaactaacgctgatgcactacatggaatgctaacagtctgatagaaccaaagatgaaaagagacctaaaagttcaggaactaggaagctaacaaaaaaaaaagctaacaattcagccttgacaacatagtaataatgaagtacataactagagccacacggtaccttaaaaaacattcttttatcaggagcaaagcagatgcttcaaagtaaataaaattgcactgctatactgcttaagtttagctttttcagatgctaaaagtagtatcagttcagacttgagtgagctcatcagctcaagaaaataaaagaaaggtgagtagcccataatgtaaatcctggtttacagccctaaacaacatgcatgtaactaacaacagagagtcacacaggacagagtgaagcccatcttactcgcctagcagaccaaaaaagatttatatggaagagaagcggtacctttcaagccatctcacttcttaaccaactcaaggcagattctggatcctcatcacaagcactcacaaaaatctctctgttctctgaattcttgaagacggtatatgctttgaccttttctgcctttgtcacatccatcgaattcagaacagatatgcacctcttgattgaaaaatcattactttccttttctcttgctaaatgagcctccttttctcttgctaactgagcctccttttctcttgctaaatgagcctccttttctcttgctaattgtgcagcctcatcttcagtttgtttggtcctcatatcaaggtacctttccataagtccttctacgccaacactcttcttttgcctcttgggttctttttcttctttgtttcttggtacagcaacaacccttctatgcggcatctctttaagcctttcagcatttgcattatcatcttcagttgcatctacatcatcttgtacttgataagccaaggtgtcctcataatctagaaatataatctcagtgttaccaagatcatcttgatcactctcaacttgagtaatgattggatgttgcaatggctcagttgaggtgaaattgtaggttccttctgcagtatatcctacacaagaaaattgagtacaagaaagggtaagcaagaaagcatgattataacttgtgatattgaaaacaaggattacagcttgtgatagaactaaccatcgtaaagttctcccaaggcctcaaatagagggaaagatttggtgcgaaacttcttggctttaggaaatgactacacaataaaaggaaaacactaaaaagatgcataatgtaattaactacaaaattaagtaatggtcagaaataatcttacgatgattatattgttccatatagcaggctcagcctcaatgatgcatctctggttattccatgaagctccactttgttttctagcctctttcagcatcctatattctctttttagctctttctccttttcttggatttgggactttgttaagcagacatatctgtccttctcatggaattccttcacgattttgttccgagcttctgaagtccatccattctgacccctatactcaggagtgttgtgctcatgcaataactcaacaagaatcttctctagggctgggttccaagaggttcttgttttttctacacaagataagaattgatgtataatctacatttaataatttcaaacatgaatttcacatgttctataattgcatacctattggagaacctccatgcttttttgtaggacgacctttcggagagttcttcttttgtgcagctttcgctaaaagcatggtcaaccttggagaacctcttccaagcatattaactgagaaaggatgcataacacaatattcataacaaaagcattgtagcaaatgtatgtcacatgcaaccaccatagttcatttataacataatatttgtaatatgtcgtagttattacagctcacaaaacatcaaaaaaaaatcaaatatactacttattacaacccactaattcctatgctgtcgatagtcattccacatttgatgtgctatcgtgtccctcaaaagattcccttgattagtgctttgatcattgccttcatcaccatctggcaggtcaacataattgcttggatggatattatgtggttggttatttaaccattgctcatccccattcagtgatcgaataatattatggaacactgcagcaaccactggtatcttcacttggttattgattttgtggaaagttgcaactttgaggatagggaagcgcttctttacaacccccaaagtcctttcaacatgattcctcaataccgcatggcgatggttaaataactctttgtagttttgaggtctacgccgacctaccccatactcctttagatgatacctgactttacgatatggtgcaaggaaagaattggtgttggcatatccaccatcaaccaaatagaactttccagggggtacttggaagcctttgtttactgcagaggtaagaaccctggcatctgtagccgacccctcccacccagtagacatgaaagtgatcttcagatcaaaatcacaagctatcatcacattttggctaagagtatttttcctatttctaaatggagctgctttgtcagatgatatagatatgggtatatgggtgccgtcaattgcaccaaggcaattctgcagcaaaaaaaaaaccacatatgattttctaaaaatgtaaaacagcatattaataaggatataagtgtttaggtaagaaccttgaaatagggataaaatctaggatctttttctattttccaatgaacttcattaggatttggaggcttcagaaaccgcttcgagagcgaagggacaactgagttgaagaaatgctttacgtgacgatgaaagctatccccactgtgcccaaatttctcttgcaaatcctcaaatgaagcattgtgactaagcatgtataagaagaacgccaacttctcttcaactttaatcctagtatcatcgaccaacttttcagttctaaggtaattggccaaagatataaatatttccggctccatcctgaatgctacccggcaattttttacatgcccttcaagcaactcccgaacacgctcctcgcatgttatctttgatgtatggcatcgcttcttttcccttgctccactagaactcaacaaatgtagtgcagggaaaataaacaacatcatatcatcgtcctcctcttccctcctctttctagcgcggtctcttgctctcatatccatagtagtactatagatagcacacaaattatttacaattttgcacttagcacagcaacaaaagatctagaaagataatcacaaaagaatcactaaactatgggaattaatcttaagaagatccaagttatgaagcatatttaaaaattgatgggaaaaatgaaaagaacaataagaatctttttttcttaaagagtgcacagtgcaacaataattgatggcagtagcacttacagaatgtatgaaaaagcagattacatggcagtagcacttaccaaatttagttgtcaaatttagttacagatgatcttttattagttagcgccgagcatgttcagaattcagaaatctgaaaaatctgagaacttgtatattctctatgcttttttatacaaatttaaccgtatgttgaaaggaaaagaaattttggtctacattacaccacttcttttattttttatatttacatcacaaaatatagataaacaacttaaagcaaagggaataaatagatctagtacctcttggagagggtacaaggtcccaggaaggagagggtacaaggtcccaggaaggaggaggttggtcttctccaactctaatgggtgcacgtgcaatctacaaaacaagcacaacttatacacatcactgacaactcaaattcagaactagaactagagttacataaaacccagaactagagctagctagcatcaaagtaggagctgctgtttttcaatcaaatagaaggatctcatcatcaaatacattataacatgggtacagaattaatcacccaatcagctcatttaacactagacatattagtgcttgaatagctatgataaacatgttttatacaagtatcatgttgaggaaaacaaatctgttagtctaatgagactaaaagctactgttgttagtttaaaataaatcagtttaagtatacattactgtatatactactgcaatttgttgctagtttgtttgtgaaacaatgacgatagaattagtttacaattcagaaatgttaaactaattacagagtacctccatagctctacaatcctcaagattaggacacccaacccttgtaatttccaaacagaaatataaccaacaaccacaagttgggactccgaaagcaccaagaactgagtacttcactgtaaaaacttgtatagtcaattttacaagacatgctcaggcaagcatcacagcatcagtcacactaagcaaaactaatcaaggcaagcatgtttccatagccaccgtacagctctcgctctcaccatctgctgcctcaaagccaccgtgaatcaagaactcaaatcaagaaccagagttgggcggtgcggtggcggcggcaaatcaagaactcatccccacccaaccaagaaaaaaagctccacgcccaaatcaagaactcaccagatcgagcaggatacgaggaggaggacgacgaatcgctaagcgctcactcaccaaaaagctgcacggcgagaagagagatggcggcgacgacaggaaagggagaagagaagaaaaccctaaccctagctttgcaagaggagggaagaaggggaaaggcagcgtgctcaccggagagaaggtggcggccggaggagagagccgtgttgtcgccatcgccgtcgccgtcgcctccgggtcgcgccgcgcgccgccccctccgtcgcgtcttcgttgcgccgccgcctcctctcgaggaaattttccacgccccaggagtagatgattttttcccaggcctagagaagagggaaaccccatggtgggccgggctaaaattcacggtagggcttaaccaaacgcacaatttcgcatgggccgggattttttcctcgccggggtgatccacggggattgggccccgatcccggccgggaacagcccaaccgaacaaggccttaggaggttcgatagtcttgagtgttcgtgcgtggttcacacggttgtttttggtgggcggaagtcatagaggacatgtgtttgcccttggtaagttctgaacaatcgatcggaggcatggagtactagtgcaaggctttcttcttttttttttgtggggtggggtgagaggttggtgtctgttagatggatctctctccccttgagcccaacggctcaagggggccttgaaccacgctctgatcgggggcgcccaacccaatggctggtgggccccgtcaccctgcgccatataaagaggggtggatgacgggacggcacaagacacgaggttcgtcgccgccgccactccaccccacaaaccctaaccgatcgagggggcacagccagtgacgggaacacgccaccgccgcgccacgcctcgtcgtcgacaccgccgctgcatcaccgccatcggcactgagttcactgtcaccgccgtccacgtcaagcccgcgacgacaaagacgatggccggccgcacatcctcctcctcaacattgaccggtcacatccctaaaccctctcactccctcttttttaattcatctattgttgttcatccatccaaagtgttctacctgactagatctaaacctaggtgatccaatagacaaccctaacaatggtatcagagcaaccctagggcttagatcggttcggggatagacatccacatataagaaagaaaatccaaagatcaaaagaaaagaacagcacacgatccgtacgggtcgaaaagaaaagagactcacctaccgccggcgccggctgccgacgcgcgcgggagagaaaagagggggcggcgccgcgccgccggctcgccgggcgccgctgcacagccgcttgacggtggcgcactcactcttgggtgagtgcgcatgtcggcgaaggggggtgcgacagcaccgccgcgccgtgccgccgctgcaccgtgccgccatgccgccgcgccgtgccgccgtcccgctgtgccgtgccgccgcgctgtgccgccgtgccaccgcggctagggtttcggccggtgaacggctagggttttcggccggcggactgggtggtgtgggtgtttttgtttccccgaaagtggcgctcggccgtccgatcgaaaccctagcgatcggacggtcggtgatggctgggctgattttggcccaagagggcgcgcgccgggggctcctttcccggcccaggcccaggttgtggcctgggggggggggagggggcacccacgcgcgtgaaagcatgccgtgggccgaccggctgcgccgcaataagtttattttaggtccctcggccgaagaaaaaagaagtttaacaaatgtccctatttcagaagctttttcaatatgtttaatgattgtgtttatttctaagcattttgaaccaatgtgaaaattgtttagagaatagataaatgtgagaaatgcttccgaacatgtattttgtatattttcatgcaaattacaatagaatttgaattgtttttgcatgttttacctctgtttaaatttgaaccaacgggagaatttttacagagtaaataatagagtttttttattgtttatatgaattgtatatagatcttccgctgcaaatagatgaaattgatgaaaattagtgtttctaaaattaaatttcgaatcaacgggagattttaattttaggaacattaactatatgctatgatgttgtaattttcggaccaacattgataattgcaatgttatagttatggctctatgtgttatgtctattttctgcccaatggtgatgtagacttaatacataatattttttattgttaattttgttctcacaatacatgattatctcaggtggctactccttgatgggttacataaaagatattccgaccctaacaggagataactacagagaatggaaaagagaactcgaccttgcttttatcttgggagaggtggactgggtgttgactaccccatgtcctatagaacctgctggtggctactccttgatgggttacataaaagatattccgaccctaacaggagataactacgagaatggaaaagagaactcgaccttgcttttatcttgggagaggtggactgggtgttgactaccccatgtcctatagaacctgctgaacttttcagaggtgaaaatgagtcaaatgcggaacggcaaaagagagagagggacaatgcttccctcatcatgtcgtatgaaattgaacatgcgaaatggtccttagccaacaagaactgtttggctgcggtaaagaacacgattgagccaagcatattgggctcattcctagagtatgacactgtctctatgtacctcaaaagtataaagagcaagtttactggttcttcaaagttttatgcgacacagctcataaagcagcttgtaacagagtggtaccatggaggtggtgtaaaagaccacattcttaggatgagcaacatggcttccaagttaaagtaaaaagatttgggcatctcagatgactttctggtccatctggttatgtcctcattgccagagaactttgacaactttgttgtcaactacaaagtaagtctagaaaaatggaatcttgaagagctcatctctaattgtgtgcaagaggaggaaagactcaaagagaccaatggtggctccattaaccttgttaaagataacaaggaaaagagccacgggtcaccctcctcaaaagcaaaacagcctcagcatctgcctcagcaacaacagttcacagttgagacaggatcagtgtctccactgcaagaagacaagacattccaagaaagatcgtcctgacttcctgacagtgatcatggcaaagaaaggtgagaacattattacatttataaatgaatctcattatgattggttattctagatctacatggtggatttattctagagcaactattcatatatgtaattgtttaaagggattctgttcgatgaggactacgcaaagaagcgaaagatccattagagttgcaaatggagttgaagcaaaagttgaagctattggagatcttctcctagagctcgcgaatggcttcacacttttacttcgagatgttttatgtccgttctttgcaaagaaacttaataagtgtatccaaattggattttgatagatatgattgccattttggaaatggcaaatgtgaactatggtataataatgcatgtattggtcttgttgtgttgcaagatcagctttatttgttatctctttctgagaatgtgaatgttgtgtccttgttgacaaaagaaaaagaaagcgaattcctgatgtctcatcaaaattatggcactgtcgtttaggccatatttcgagggggaggattgagagactggttaagaatgtaattcttcctccattggagttctcagttttggaaccatgcatacaatgcatagaatgcatcggtgcccaaaacactgtatgagctatggatcctccttgtgtgggggagtcctgcagaggctaaagtatttaacccaaatattgggaaattggatcccaaaaagtaagctgccattttattggctatcctgaaagatcaaagggttatcatttctactgtccaaacagttaaacaaagtttgtagaaacgagatggaaatgattaggggggagctcggtagtacgagaaattgatcttgaggagaggcgggtgtctgtacccgctcccttgactcaggaacctttcttctctctacctgctgatgttgtgcctgcaatgcatgatgttgcggtaccaacacctattgttatctctcctgtggcaacaatgaatgaaagtgaggaacctgttttacaggattcaacagaaattattgccacaccagaggaggagctgcaacagcctcaaacagataatgtgccaaatgaggaggcccctagaaggtctgaaagagtcagaagatcggcaatccgtgatgactatgaagttataatatagaagagtcgcatatggaggatgatcccacctcatatgaagaggccatgagaagcgctcgctcatctgaatggttggaagccatgaaagatgaaatgaaatcaatgaaattaaatggtgtctgggattttagaagaaattcctaaaggtgtcaaaatagttggctgtaaatgggtctacgaaaccaaatatgactgcagagggaatatagaaaagtttaaagcgcgacttgtggcaaaaggcttcacgcaaagagaagggattgattacaatgagacattttctccagtctcttgtaaagattccttcaggattataatggcactggtggcacattatgatttggaattacatcagaaggatgtaaaaagggaatttctaaatagagatttggaggaaaagtatacatggtgcaaccgaaaggttttgtcatgaaaagaaacgaaaatacgggatgccgtctaaagagatccatttatggattagaacatgcttcgagacaatggtacttgaagtttgatgggacaataaagaaattttgggttttcaagagaatgtcgaggacaactgtatttattcaaagtttaaaaatagtagatttattttcctaattctgtatgtagatgacgttctactaactagtagtgatgtcagtctattgcaggaaacaaagaaattcttgtcctcaaactttgacatgaaagacctctgtgaggcttcatatgttttgagcatagagattcaccgagatagaacaaagtatgcattgggactttctcaaaaggcatatatagaaaatgtgttgaagaaattcaatatgtacagatgcagtgctacacctgctcctatagtcaaaggcaaaaagtatggggcatcgcaatgtcccaaaaatcagtatgagctcaatgaaatgaaaataaagccatatgcgtcagctgtaggaatcctacagtacgcgcaagtgtgcacacgacctgacttggcatttgttaccgggatacttggcagatttcaaagtaatccaggcctagagcactggaattagtaaagaaagtcttgcgttatttgcaaggaacaaaaggcctcatgctgtcttacagaaaatcagaatcgctccagatagtggggtattcagattctaactttgcaaaagataatacaaagtcaacatcgggatatgtgttcaccctggcagtaggagctatttcatggaaaagctcaaaacagatcaccacttgtaacatcctcaaattttaaactaaaatttgactgcatcatgctggcttttgattaaattagtgtgttttaaaaaaaatctatttgatccttaattggttcaagtgttacttccttagaaccttgccaatttaccctaattatttcctttattccaaaccttagtgaatttgagcaaattctctcaaatttcaaactatagattatttctttagtttaccctaatattagtgaggattttctttactccaaaccctagtgaaacccttccaaattcatagtttaaattcaaatcttttctagggaaattttcaaaaattcctgaaaacactgttcattgcacacaaggtgcttgatgaaatgcccagcccacctagagcagcccaatctacccaatcttttacaaagtttagaattgatcctagggggccacaccccactcaaaaaccgtggatttctttgcttcttcctccccttcacgcgcgccccccggtcatccgacttagccgcgcgccgtgtcgccgcgcgtaagcctcggggccgcttgcgcgtgcccgatcgccttggcgtgccgctagccgtccgacgccctcagactgccattgccgcaccaatattgatgacgacaaagccgggatgacgaccgccgcaagaaatcgccgctcgacaccgtgcgctcccatccaaagccgccgccgagtccgattttgattctacccagggtgaatcgcaccaattcttggattaaagttagatggtggtttcccctctcacaattcaaatcattcacccccgagccggccgttttcaccctcgccgccgccgcgcgtcgcgcccggattggcgccaacacgtcgctagccgtttctacttgcggtcaagccaatctttcaccggtaagtattcaaacgtggcctcccgccactcaaatttatcttggccgccctctcacagcccttgccgccccagccatatctaaagttcgagctcatccatggcgatgacggtgcccgagctcatctactccttctagccctacaaataggacctcaatcccttccttgttcatcatcgatcatcaacaaccatagtcccacaaccccgaagctctgcttcaccaatccatctcatcaatcactttcgcccgtcggtcgaacaccttgtgcgcgatcgacaccacacccctccatccatcctccgccctaaatatcccttagaacaccttatatcaaccatgttctagtatagtagaccctaaccgaagccctgcgtcgagttttacctcgccgcaccaaaccgagcaccgcctctcccgcgttgctctgttcttcaccgccacgaagtttttccggccgcaatccgtcgtttcaaccgatctcggtgagttctttcgtttcaaccatctacatactacctagagtccatttttgcaatcggtttgcactagcatgccaccctctgggctgccgacgtgagcacggccgccgccaatggaggcgctcgtcggcaagtattctccgtgccttgccaaaggtcggcaagctgttggaatccatctaggcactccgtagatgctctagaacccctcccctagccatatctaactcacataatcccaatcgccttcacggcctaaccatgtcaccgccgccctagccgctaggccgctcgccgtcgccggagaaccctagctccctcccctcctcggccgcaacccctttccccctctagcaccgccgcaatcccaaaccctagcgccgccggctgcatttggggatcggccggaggttgaagaagagaagagagagagactgacaggtgggacccgcacatagtaacatttcacatttaattgattttcaaactttagaagcccatatcttttaaaatataaatccaattccagtgaaacttggaccaatattcttctaaaatcattctctatcttttgagcccctttttgttatttttctattttattttattttctctatttttcttatttttggattttatttgaattccttttgaatttgaattttatatgcttaaccctaggtcttgaggattcttctgacacattagataatatcaatcaatctcaggacatcgagcaaggcaagttaccatataccttttgatcatttaagcctattttttacaaattatttatttatagccttctattcaatattctattttatatgcataaatcaaccatagaaacccagataatttagtgttgcttactttgcttacaatctggtttaaataccttatacttagattggggtagtacgtaagatttggttgatttccgtgtggctagtactgtctcgatcaatatagtttttaccaggtacttatgtcgaacgaacgagtacgaccgcagtttctagaatggggacagacctagttattatgttaattagcaatatggcacctctgtatagtggttcttatttttaagtcctcgcgtaggaggcaactatagccgcgaagggcaactttaaccattaccatgtacaagtaaatggtttgtgatactcgagtataaactatatggtatatttctaaaccctgatcgagatgacgtggtgtcatacgatcagttccccttaaatacctcgggaacgccagaactcctcttgctgctgttaacaatacgttcagggcatatgaggatataagtttatggaataggtgccacaattgttaataacttaatactgagctatgactaaagccgatgattatcagcaagtcgtggactgtgggtaaagcgtacatctgctgcagtagaatatccttgaaactattcgaatagccgtactcatggagttgagtaccgggattcatatggtaccctggttagaaatctaaagtctatatgtttataaattcttgctataactcttccagattgtttatttctactttttgcaaagaaccctactatatgccaatgcataacatattttcatgataacttgctgagtattgtgaatactcgttcttgctctcataacccctttttcagatctgggttaagaggacccttatgactattactacgatgaccccgataatttagagaatccttaaaggttatacctccctagtcagaatgtataaaaacttccgctgtgtattaattctagttgatcaattagatgagtacctattattgtaaaacccttagtattgtaaaactttatcgtatgcaatgaagaaccggttatattgtatgtatcgatatctactgatccagggattgatacattaatttatgtcggatccaagttgttagttccgagacccgacaccactgcagggtctactatgtataccgagtttatagcatgctatgaggcaacggggcaggtgaactggctaaagaaattcacacccggtttaaaggtggttgacagtattgagaaacaactaaagttatactgcgatagcgaacccacagtaatgtactctcacaacaatcagtcaagtggtgctgccaaacacattgacataaagtactatgttgtgaaagacaaagtccgggatcaaacaatcagtctcgagcacattagaacagaaaggatgctcgcggatccgctcatgaaaggcctacctcccaacatgttcaaggaacatgtagcatgcatgggtttaagggaagcctaatgaatcctggactatagggcccaaaagttaaagtatctgtttctgaatagagatgtgtatagtgaatagagatgtgtatagtggctgtcgaatccatcagtaattaaccgtgacgatgaatcatgctctatatataaatctgtgatggaatagaaaaagctaaaagaaatagtgagatcaagggggagaatgttagatggatctccctccccttgagcccaacggctcaaaggggccttgacccgcgccctgatcgggggcgcccagcccaatggctggtgggccccatcaccctgcgccatataaagaggggtggatgacgggacaacacaagacacgaggttcgtcgccgccgccacttcaccccataaaccctaaccgatcgagggggcgcagctagtgataggaacatgccaccgccgcgccacgcctcgtcgtcgacaccgccgctgcaatcaccgccatcggcaccgagttcaccgtcaccgccgtccacgtcaagcctgcgacgacaacgacgatggccggccgcacttcctcctcctcaacatcgaccgatcacatccctaaaccctctcactccctctttgttaattcatctattgttgttcatccatccaaagtgttctacctgactagatctaaacctaggtgatccaatagacaaccctaacagcgtcatccaacgtcatcgattgtttgttatttccttgttaaagttcgcgaaaagaaattttttgggtgtcacatcggatgtttgaccggatgtcggaaggggtttccggacacgaatgaaaaagctaatttcataactcgcctggaaaccgtgagacgaatcttttaagcaattaatctgtcattagcatatgtgggttactgtagcacttatggctaattatggactaattaggctcataagatgggtctcgcgatttccccccctaactgtgcaattagtttttttaatctatatataatgcttcatgtatatgtccaaagatttgatgtgatgtttttgggaaaaaaatttgggaactaaaccaggcctttaggtgaaaatctcgatctatttttggatgataatgttggacaaacaccgtgtccttcttaaaaggtgttgttccagagcacgtgtctagctcttttgttgattgttcatgagttagttattagtctctctgttgtaaaatataattatttttgcacactgtatatctggacggagatatatccaggtatatttcaggaaatatgtaaaaaaattgcttatattttagaaaagagataatacaagacaacatgatgtgttcgtgtgtgtgtcttaggtttttttcattttatttatctttgtttttttttcttggctatgtattgtagatgtagagaccgtgtgtaattttagcgtacaataaaattcttccattatctaaaataaccaatcctgaaagtaccctcaccccctcatcataaaaaatgattatcaagaaaagttccaaaaaaaacccttcatcctctgttttcctcctgattttttccttcctcattttcaaaaacaagatcttgtctgtgatggctcaaccaagggaccgacagaatatgggaaatgaactggtaaacctgcagcatcaagctcgcacccattttcaccccacaccattgtcttgagtagggctgtaaaaaaaaaacctcgaggctcgtgagctgctcgagctcgacttgttctaggcttgattcgagctctagacgagccgaatctgagcctctccctaagctcgtaagctttgtcgagtcgagctcaagcttacaacgagtctaataatatatgatttttttgttgttatttaataaattagaagatcaaatatgttatttgtatgtcttgtattgatatcatatactccatccattccaaaatataaggcataaccacccttaatccaaagaccaagaaaataattattatcatcttgtagtttggatcatcctaataaatacaatgcatgcatccaatagaattagagaacatgagagtggaggattttaaaaagtaataatataatgaagaaggggtcatagttaattgcctacatgcgcatgtcttatattatgaaacatctagaaaagtggttgtgccttatattatggaatagagggagtatttattttattcttttttcctattctattaatacgataaaatataaattaattattatttttaaatattatccttgaaatatatatcgttttaattaaaaatcatgctcggtagtcgagctcgagcttttgatcgagctcgagccgagcctgctagacagctcgaacattttataggcttggcttgagcttatatcgagctcgctcaagcttgacttgttgacagccctagtcttgaggctaattttcaacaccattctcaccctagtcttcgtccttggtgtcactatcgtttctcatgttatcaccaaccttcctatttcaaatgacaaagggaatgatgactattaattagaggggcattgtttttttcttgtgcttatgccaactaacttttatagattctttttctgtctctaccattgccatgatgatatggcaatttgcctcaacagatcaaaactcctcttaatgtattcttttaggaagggcaacacaacaatattgtaatggacaacatatcgacccaccacaccttttcgataccaccataatacttggtcctttccattaacaaaatatactccctccatccacaacaattaggcatatttcatagtttaattttttaaaataagttgtttctatttgtaatctttatatattctaaacttgaatgtagagctaaattaaatatttgatcagaactcgaggaatcatcttaatactcattagttacatgtgtacatacactacttatctttgttacatataatataagttaattttttattagttttggtgataaaaataatatgtgtaacttttatgaaaggaggaagtaaattacaagactattaatagcaaagacatctccctttatttgtagcactttaatgaaagcatcatgtatcatgaatatattggttggttgaaaggagcttttcaccttaccctttccctaactcaagtttcatgctgatatggacatgcgaaaaaaagtaaattacatctgtggtacacacaactcgagattgcaaaaaaaaaaaactagaaatttaaggtagtgcatgcttgtgaggtagttgcacgattaaagccctgccttttgttttagaaaaatatatggcacaaataatggttatagcttataaatttataattcagaagagatctgaatcgtcggataatggacgcaaacaatatttattgtttccaagtttgttagtagtaaactacagttggcacgtaggagtagcaggtacgagccaactatgaagtagttgtttccaagttggcaggtatgagagccttgcttcgttgcatttcaaagcaatcctatttgtagtctagtcatcactcatcagtgcaatatatccatggatttgtttttctttttctctggaaatctggtgtttctagaattctagtttattgtctcaataatattaggggcatttgcaaatttgccaccgttttttcaataatattaatatgcctgctatgacgctatgatattcaaggtggaaagcaatgggccaaggccatttatttgggagtagggatggtgctttacactcttgagtggtgcttctgtgaatccctcatcaaatattatgatgcaatggagtggtcatgaaaaattcgtagaaatatattttggttttttgcaggggtaaaaaagcaagcatcctaagaaaaccagccgaaaccttgaccaatcctattgtttcgcctattcgtggaataaatcaaatggtatatttgcaaacgaaaagtaatttatgaataaaatttttatgtacgtgtttttggcgatttaaaagcaaaagctgaaaaataaaaactttgatgaaaaaaccctaaaatcagctccaaatttaaggttgaaaattcaaattttggttgataagcataagcataagcaaacagatgaggcccactaatttattttccgatttcatcatgtacttctccatgtgtgcatataatatatataaatgaatactttatactagtgtgaatgtatgattggttgattgactcgattctgcgtcaaagattgcaaatttatcaacagtttcttattagcgattgtatcatattttgatgaagtaaaacttaaagcatgcaccttcagagtgggacacacgaggtattctaatagtgatagatgggagctctccaactacttagggttagctcacattttggcgaaaaagatagaagatgacattgactttctcaagacaatggtttgtcatctgtaatttcgtcagcagaaggtactaggagcgatatgaaattcagacacatcttctgaatctttcttcgcatgcgctgccgtggcaaatttgctgatgctctccatgcctggatctttctcaagtgctgcatcaacaacgaacagacaatgtcagcaacaagnatcccagtctgatactactgatccctttaattaacaaattggaggtgtcgaaattgtttttatcagagtaattttgcgtggcagattacctaactgaaaatgctctctcggaactcaactaaagtagtcggaactcaactctcacccagctttttctgtgttggctaatggttgccatgaactttcgcatcacacagagagattaagtgctcttgtattgatcgtcaacgatgccaacagcttggctaataaaaagaagacagcaatacatttttctcagagctgcttcaagaaactgtcgtgttgtccacaatcatgaggaggaccacattagagcattatctcttttattttcttttttaaaaaagaggccaaagctttgctattaacagagaattatcaacaggacagactttgattgtgctcagttgccgaaatgttgatacggactacggaggttttataaattgctgatctctaatttgatttctgagccaaatctgcatatttcggtgatttacatatacgtatttatatcggacgcggaattggggtctgatggtgcccgggcttcagaatttgaaatatccaaattcagctcgaattgaaaatgttcttttttggaaatttttttcatcttctgcgtataccacagcttgtaaaaaaaaacagctcaagttcaatgatatttcacaagctcatattacattgttcggtaactatgtttacatggcaacacgcctggaataaaaaaatagccaaaaaaggtatatgtcggttcaaatttagttcaaacatgtttaaactagtatagttagtaaacaaattattcttcataccttttttttcataaccgtttaaattaagcctaaagttttttttcataaattagctatagcattaagtttttctttacgatacaatgctattaattatgggccaaattttaattctttcgcgagtccataaatttctttgttcccgacgtcactatgaataagtccccattgactccctcaagtattggttcaatctgattcaaatccctcaaccgcaatacctaatatcttaatccctcaactgttgaaacctgtgtaatttaactcccagggcagtataaatagtggtatttgctgatgtgatgtccatgtggcatcccagtcatcaaataaattttaaaaagtgggacgacgacggggagcgacaacgagacgatggcggggctctcctctctctcccactccgaccccttcctccggctcccagcgctgctagcggagtggccgccaagtagggatgcggggtggtggtggagtacctcaggttctcaatagtggtgggctcggggaatgatgctagccgacgtcggcgacaagaccgagccaagtgaccgacttgagcttcccgtcaccccaaatggcgacaatcccgacaccctccttcccacggtgctgtagcttctgcagcccgaggttgcacagcgacattgcgtcggggtcccccatgacctcgaccagcccacactcctcgcacgggtggtcgtcgaagccgtcatcctcctcattgcctctcccatagaatggagtgacccggttgggcaacagtggcccgaccaacaacaaaaggcgagaaccactagagccgctaccgtgatgcagcagcaatagagggagagaagatggcttggaggaatacctaagctgttgttgcttttggtggtgctcgcgttcgatttggcggtggtggcgtggtggtggtggaggaggcgtgatgttgatgcgatacggccattagtgagtgaggaaaggagcggcacaagggattgggtcaagcggtggatgggttccctttcaagggtgaggtcaaggggcatgatttaaagagggttttgctggtcattgtgtgtccatcgtcccgccaccaccgccgtcgctccccgttgtcgtcctagtgatctgctgctatcaggccgagaagaagaaaaggggagagagatgtgataacatgtgggctccacttattatttttaatttatttgatgactgggctaccacattgttgccatgtcagtgaaaaccgctcttaaaaacaatcgagagagacattttagacagttttaatagttgggggagtcatcatatctagttttgcagtttagagatacgagtcagatccgaccactaggtaagggagtcagtgtggactctttccacatcactatgtgtcggatctgccaacttcccatagtgaacgagtaggctaataaaattgggaataagtctagttgccgtctacacgtcaagtgttcaaaatcatgcaaacgatgcatcctagtcagcaaggagggaataaaaaaaatatgtggggtccacatgtaattcacatgaaaaatataaaataaaaacttctcccccacctctcccccaagcacacggccgtgacgggcaccttcctctccatcctgagcttcagtcgcgaggagaagggaagcagaggttgaggatgctacagccagcgaggtcgagacggggtgcagggagaccgaggccgaggccgagtccaaggcctcccttcgaggccacgcacatgcattaaatcccttgatcaagatggcctctgttgatggttgttatcgatcagtttcgaccgtcaatattaccaaaatagaggagaactagtgatacttgcaatgcataaatatgttagaataataatattccactagtagtaggtatactaatcttttgtagagaacgacaataaagtggaggagaatcgacatcaatacaaacgataaatcaatcggacgatgtcgagaaccagacttatgtatgaatgggccaagaactcagaattgacacgacaaactaggccaaaattcaaaagtctggagaagaataacagaggaggccgccagccaaaccatgggctggttgggccggccccaggttcggcccaaccagggggttcgaccgaacctccctcatcgccgctggatgcagggtttcttctggacgatgtggattagctcccaatgatggttggagggtatttccgaccattccaaccatcacaatcgtcattgggaggctatataaaccccttaccttctcacttcactcacacacctcaagcaatagctctctcatttctctcaatttagtttggtagtatctagctggtggaataggaatagagtagaaatcaggagtccggaagccttcggaagagttcgggtatggctctagtagcttttctcttctcttttgtaagctttgtacttttattagaatactcttctatatacatttatggtattgaaatattttccgagtatatgagtacctattttacattatgttcatgttatagtgaatatacggctagcctatctgggagatgctttggtacgggtataatatttgcttatgcaattactctatgtcatgacgatgatattatagtagtatctagtagtttagacgtgatgtctagattatggaatatcattatttggggttatatattgcggatgagaggtgggccgctaatggtgacagctcagtacgggtattcctccacgctggtatataatcctaagttaattccctggggagggtattcctctgtatttagctccggttgtatgatcatgacaggctgtcgtaagaaactcggcagtcaggggtggcttctcgaagtaccaggagggcatcagatagagggtactccctccattccataatgatcagcatattttgttgtggcatcaagaccaaggagagacccactacccattttctatttaatccttgtaattaatctccatattaatcggcttggagaaacgaaacgacgttactgccgctgcatgattgcacatgcaagggatgttccgtgctgcatgcagctcaaaaatcgcatggccaactcgatctctgtgataactagttaatccatccgacatgcacatgctaccagtgttaatacgctgatcaaatcggaatatctctactttcgttatgcgctgatcattatggaatggagggagtattagctagtatatcggttaactagaatatatgtataatatgtatattagaagtatagaaatagattttctttctctttctttccacttagcttagataatatattatgagaatgagtagttaatgcttgtgtgtcactctacccttggattatcttaacccctgcttagaatatgattatcacaagtaatatataaattattagttgagttctctctacatgatcttttcacgggataaaataaatatgatacccttggaatactctcgggtgaaatgctacaatggtatatccgtgcgcttgcggatgaactctctaaccataatataccagaagtatttctgcggcattgctggaaattatatttctagtaatgtcgttaagaaataccaacagcctccactaccaccgccgctaccaccgcccgcaatgacagcatcctccccacccacaccatcatcgccatggtcccacccttcataacccacaaagacgtcgaactggaggcctccaggaggacgcgccagcaatgctgcctatgctgctgttgatggtcattagcgatcagtttcttccgtcaatattaccgaaatagaggagaactagttttgcttgtaatgcatatccatgttagaataataatattccactagtattaggttcactaaccttttgtagagaataatcattaaatggaggagaatcgacatcaattcagacgatcgatcaatcggacgatgtcgagaattagacttatcaatgaacgggctaagaactcagaaatgacacggctaattgggccaaagttcagaagtctgtggagtggagaagtccaggaggctactagccaaattatgggctggttgggccggcccttgtttcggccgaacccccctcatcgtcgttggatgcagagcttcttctagacgatgtagattggctcccaatgacggttggaggatatttccgaccattccaaccgtcacaaccatcattgggaggctatataaacccctcttactctctccatttcaatacacaccttaagcaaaagctctctcatattctctcaatttagtttagtgttttcaagctagtggaataggaatagagtagaaatcagagtccgtaagctttcggaagagttcgggtatggctctagtagctcttctcttctcttttgtaagctttgtactctatttagaatactcttctatatacatttatggtattgaaatactttccgagtatatgaatgccaactttacattatgttcaagttatactgattatactgctagcttatctgggagatgcatcggtacgggtataatgtttgcttatgcaattactctatgtcatgacgatgatattagagtagtatctggtagtttaggcatggtgtctagattacgtgatatcattatttggggttaaatgccgctgatggtgacaactcagtacgggtattcctccgtgcgtgtatatagccctaagttaatttgtcggttgtatggttatgacgggctgtcgttaggaactcggcagtcagaggtggcttctcgaagtatcaggagggcatcggatagagggtattagctagtatgtcagataactaggatgtatgtatactatgtatactagaagtataggaatagattctctttctcttttctttccacttagcttagatatttagtatgagaattagtagctccctgcttgtgtgtcactctagattatcttaacccctgcttagactatgattattacatgtaatatataaattattagtcaagttctctctattatgatctttccacgggattaaataaatacgatacccttggaatactctcgggtgaaatgctacaatggtatatccgtgcgtttgcggatgaactctataaccataatatagcaggagtatttatgcgccattgctgggaattatatttatagtaatgttgttaagaaatactaacaactcctacatgctcatcatccttgtggtgctcctcatcctggtcctctttctcactatgttccacatctacgaccccaccacccacctcgtctccacccgcctcgtcggactgtccccgcacactctccttcctagccatgttgctcgaacccaacatcacactactcatcaccatggcaatctacaaccccaacccgaccttcttcacctaagccataggggacacaccgatctcacctacatgggcacccacatcagcggcataaagatcgaccaggggaaaagctcgagctagaggagatggcaacatgacgacggtgctcaccatccataccggccgcttcgccggttacatcatgcagcttgtccgctatgtgatggccgtcggtggcgctcaacgcgagcaagaggatcaccggcatcaagtccccgaattcctcgcctccgcagccgttggtagatgcctcttgctgcttcgtcatcgtcaatcgaatttgttgctgccggagtgcagccaacagaggtcgatggaggaatggctgccatagtgcggcatcgacgaggcgcgatagctcccatctcccgggcgcgacatagactatagaggggattagcggcggttggccgcctcaactcttccctcccaagcgacgcgcgggaggtgggagagaggacacgaggcgaaggcggtgaccagtggtgcgaaccagtcgtcgtctgcctcaacctcgctaatcgtgccaccctcgtccttagcttccccgtgcccacccgctcccatgccccctcttctccttgcccttgtctttgatgtcatgggccacactgtcctcggcctcggcctccccatgccgaacctcgacctcgctggccacatcgtcctcagcctcagcctattgccaaagcttggacggatagaaaggtgtgcgtcgccgccatgcgcttgggggagaggtgcaagagaagttttgcttttatatttttttgtgtgacttacatgtgggcctcacatattttttttattctctcgttactgactaggatgacacgtcagtgaaaccactcatgcatactgccatgggaccttctttgcacggttttgaacacataaagggtagaaatttctgatatcggggattagggatgtcatacagattcgacgtaaaattgagggacagcaagtggacttattccgtaaactagtagaagcccttggccgaacgagaatatcacagtttgggccattaaagaagcccactactgctggaatacaaagccagccatcaatataactacttgggccaaacccagttaattatgtaagaaaatgtgaactccctatgggctcagatgggccatatttcctgcaccaaagctgattcataccccatgtttgactcctttggaaagtaagtccactttgacttcttcagtttcaggtgcaatctgattcataccccctaaccaaattaccaaatattttgacccatcaactattaaaccagatattttgacccatcatctattaaaaccagtgcaacataactcctttggtggttttaaaggcggttttcattgacgtgtcgaattgacttagtctctgagtctgacttgtcattacaataacaaaaataataaaaatagcatgtggacccatgggtcaggactgtttcctctctatatactccttgtttctcctctttctctatggtcgggacgacgacgatgccaacaagctagagtgggcaaggacggtcggcagtttcgacgagcacagagctaggtgccagcgtggcccgaggcggagtccgagcagctgtgatggctgatgagagggatccgcgacggggcttcacccaagacagagcgacggcctcgaggcacaacgatggtgcgccctcaagacggagcggcggcttacactgatctacagctcattgcccttgaggcgcaatggcagcacgacttgagatggagcggtggcggcacgacctcgagggaagggagctcgtcaatggcatgacctgcagggtggtgagaggttgaggagatggcgtgccggcatcactgacagcgcaatgaagtagctggagaagatgaagaaggaccccatcacccactggatcatagcattcccctccacgaagtccagcgccaccgatgccgctgcaaagcacaccaccaccgacccccttctctccctcgaccatctccgttcgtcgctacaatcccctaagtccgcccatcgctagtcattgccgcaatccactccgcctccatatcgcctcgattccctcagtccgcccatcggccatcgccgctcgctgcctgactggctgttgtgtcgcgtgtttgctagcggtccggcaccggagcgtgtccatggagtcgatggagaacttgtggaggcgagcaaacagtagagggtgtcgatggtgctgctgccccaggggcgtcgtgtggggaaaggagaaaaaggagagaataaagaggacatgacactgacacgtgggatccgcatgctgactcagccattttgactttaggtcaacatgccacgacggcaaaaaccgatctcaaaacagccgagggagtcgaattacactagtttcaatagttggagggttaggatatctggttttgcggttgggtgatacgaattagactggagctataattgagggagttaaagtggacttattcctttctaaacgaggctagaacagtattttcccgagtaaattgactttggttgaggcatgcttggattcggcctgttttggggtgtatcaggtattcgggccaaaccagcgtaaaaatttgtggtttacagcccatccaagcgtgattttgagcccatgtaagaaaagtaataggaataagtccactttgattcccttaaaaagtaacctgaatctaatccgtgaccctcaaccgcaaaaccggatagaacgactccccaaactattgaaactggtgcaatttgactcccttaacggttttggatagtggtttcgctgacgtggtgcttacgtggtagtgttgatctagcctggtcttgatgtggcgcttaggtggcatttaattaaaaacatatatgtgggacccatttgtcataaaaaaagtggggcccactgacatgtcatcctctctctttcttcttcctccccctctttctcccttctctctttctctccccttccaccgtccacggggagcacggctggagcggcggcggggcagggccgaagtgctggcggccggcgggagctgaagcggcggtgggttggagctaacgcgggtggaggcggaggagaaggaggcggcgacggaggggcttgagtggcggcggcggtggaaaccgccccaagccacatacctctaacgaggcggctgcggctgcggctgcctctgactagcgcgctggattattcctagcctccgtcagctccagcccacttccaccaccgctccagctagctcccgtgtcagctcccaccggccgtcaccactccggctcccgacggcggggaggagcctcgacgacaggaacaggtcagcaacgccgaacctagtcgccttcttctgcgcctctcccagcgtctccaggaactcctcacgccaccggaagccgcactcccacatgatggcgcgcagtgtcaagtcggtcagcgtcccggtgatctgcctgctcacgtttagtgccgacagcggcggcgatggtgccaacgagcacacccgccaaagagtatccccaccgtggtgccgatggagtccctcactgtacgctcagccatagaggtcgaagcccctgggccaggcgccagaaggaggccgagctccatcctcgcctttggccatgatggtatgcatgtagcgatgcctgccttgggacgaaggcgaggcatatcatcaccttctcgacatgatttttgatgagcaggaagtaatcgagctatacagctatacacatcctcttgcttgctcgccttctcctatgctgctacattggtgtgtttgttgtactgctgctcgactctgccgaggctgacccgtggagcattgtgggggttggccggattgccgggctgggttcgtggactgcatcctcgaagaccgccgccatcacgcatgcggatacgccgaggtcgaggtcgatggcgatggggaagctggcgcccgcccgctgctgccgcgtcagccatcgccgccgccaccactccggctcccgcttgccgtcgccgcccttgcctgcaaattacactacgagagagaaggtgaagagaaaggggggagagaacggggagagagggaaggggaaggagagagtgaatgacatgtaggcccacatgtcagtggggcccacaatattttttatgtgtgaatcacatgtgggtccatagattttttttttaattctaatgccacgtaagcgccacgtgggacgaaaactaggtcaacattgccacgtcagcgcaacatcagcaaaaccacccatcgaaaccaccaagggagtcaaattgcactggtttcaatagtttagggagtcgttctatccggttttacggttgaggatcacatattagattcgagttacttttaatggagtcaaagtggacttattccaaagtaatattacattcatgtaatttgttctaagaaaaaaaatagggttttgaaccaggcccttattctcgacttttcactaatgtatatacccctcacgtgatggaacaagtggcaaggaagataacatcaatccaaactacaactttttctcgtttttcgttaacacgtttcctaaactattaagcagtacattttgtaataaatctattttctagttttgtaatagaataaactaaacgtactgctatatgttactccaatatagagtttcaacccctcttgggttgcaggcttgcagctgcatagcaccgctgttcggttgcaattgttttgaacaatgtttgcttgtaaaaaaaatgctgctgtagaaggcaagtgtttctgattttctggctacctgcagcctcagttgacgcttcagagtacagtacagttacagcactgctacagaacgtgcttccaaacaaacccatttctgctaatgcttttccaacaagcattgcctacatgcatatccacctactaggtacgtagcagctctcatgtcctccatttctttacttcccgaagtagcatatgtagcatccaatgcgacaaacaacactctccaattcaacgggcaagttagcgctgcatgttctagagcatatcatatgctttatactagctcgaactaaaaatgggaagaataaaatcgattttcgagaagccaccttaaaggcttaaacgatgtggtggtaaagttacagttacttcctccgtttcacaatgtaaattattctagcatttttcatattcatagattcattaacatcaatatgaatgtggaaaatgctagaataacttacattgtggaacgaagggagtacatgatttacgattatttagagtctgagtttagatcagctgtacgttggacagaaactttaggtggtacttaaaacgagataagattatataaggcgtaataatgtgcacatccaaagtaatataagaatatagatttatttgatttctaggaaacttttatatataatttttttgctgcttaaagcatcgccatttttcagctgcagagacacgtgcccaaggagaatgagtaagtagtcgccgaattaccgactattccctccgcccaaaaaaaaaccaacctactattgaatgggatgtttccagtataacgaatcttgtcaatactagattggtttttttagacgaagggagtagaacttaaccgaaatgggtggtaaacaggatgcactcgttggtgtgtgcctatataagaagtacgcgcgaagtggtggcattatcctcataatcacaaaagaagaagaagaagaaaaaggttcgaagtggagctcgatcagctgctccatgcctttggtcaacccttgtcccatgcatatgctccgttttcgagcgaaatatcaccaactctaccaaaaacgatgaaatccaccagccaaacgtccaaaaaccaagcagtaccattttgcagtactgcacatcacatgctccgatctgcgtcctgaatcaccaaccaccactacaaccggctggcctttttgcctgcttgatgcagaactaaactgccttttttcatcgatctcaatcagccaaccgaactctgcaagccattcaagcgaccaggctaagtacaagaaccgtttccattatatagagagatgattaattaacaaccaagtaatgcttattttgctcggtcggtacgggaagtaacaaccgcttagccgtgttaacctcttttgcgcctgcttgcaaattaaaccaaactaatctctccatttcagattgattatcattcgatttaacattggcagtgtcttataccggttcgttggattttcttttgacaatgtttgctaccatacactcaaattttatgtaatttgctagtagaaatgacaaaaccgtgttacggctgaaaaacacctagtaatttgctgaaggatactttcaattcaattggagagggaaattcttcacaaaaacgagaatgccctagggccaaaagctttcaagctaaggcttagagtgaagatggaatatgatacatactaacgatgtatttaggatgatgataaatttagagttgtataattcccaaattttcactctaacgccatatttgaaggggaccctatttgaagtatgggttctaggggtgttcttatccttcttaagaatttatctctccaattgagttcaaagtgtcctccagcaaattactagttttataatatgtctttctgctgtgacacgtttttcgatgtctactagcaaattacacaaattttaggtatcctatagcaaaatttgtatttttttatgagttcataaaatttaacaacgtgcacattatgtatcatgaaagcatttctcaagatagatataaaaacataggggcaattgtgttcttgcccttgctttgtgatccaattgtgattttgccccctacttttagggttgtttttgcccctactttttataagtgaagcaaccattttgccactggttttgaccgtggttatgtgggactagaatttttgagataaacaaagggaaaggaaaattaaaaaatgattttgcaatttgtcaatgactgttatacccctggtgagtaaatcattaagcagtgtgtgaatcagattgaagccgtgtattcccggaaatgcttaccattggccgtccagccagaaataaaaaatcagatgtctcaatttaaaagaacaacagtgtaggtgcatggtgaaacagttggttaggtgtactgataagccaacggagcatgcatgcaaacatgtttcaaaatttaaatgattttttctcttaaactattagtccgaatttcaatctaattatatcattggattcgttacaattaaatctttataacaagatatcacatgactacattccgatgagttttaattttactttttaaatattgcacacattgttactgaaatgttccaaaaagcatttgttgatgtttcactaatgcattagcaatgtttcatgctgtctttttttatatgtttcagcaaatacattttttatgtttcaacaataattataattcgatgtttcaatctaaatataaaaaatgtttcactggtcgggacttaatgtttcatgtaataatgattattattgccatcaatactttttatatgttgtacctctttggaacaatttgtgaagagggttgaaacatctccacaagtgatgaaagaattatttttaaatagttcaacataagtttgttttttttctagaacacatatatatttttatcaaaatatattcatgtgagatcttgttataaattatagattgggtatatattttagaataaaatttcgtttaaagtttgattaagagagagagagaaagtaatactgcctcaggccaccttggcaaccagctctactcttgcatgcatgcatgcgacaacctcgctcctccaacgcgtccctgcatacatacagacgaggagcagcattcgatatttgaaaaaaaaaaatattgaatgttcgatttgtagcgtcctatttaaaaatatttcaacataattaagtatttgtgcaaaaatctaatggtataattgaaatttagatcagatatataattttggagaaaaatatttacaatttgaggaaaaaattaggcacgtgtaatgggagggagagggagagggagagagagtatgcaagcagcagcgcaagcaacgcatgtagggcaggcaagcaacgcagcacggaagcaacgcgggcatgcggcagtgtgggggcgagcgttgaccaacaagtaaaacattaagttatatatggtgaaacaaagaaaacaacaaccgaaacatttaaatatgtttatgaaacatggtgaatatacacgttgaaacatgttgttgtcacatatgaaataacaagtattgacggattgaaacatatgtttttcttttatcaaaatataatcatgcgatatcttgttgtaaagagttaattacaacgaatacaacggcgtgatcggatcatagattgaataagtaatttaaaagaaaaatcattttgaagcttgctaaaatacatgcatgtatgcatgcatgaggtggagagagagtagtagcagttaatttcaggaattttgtgaaacacaccgaagacacatattgaaacctatctctatcacgtatgaaacatgttattctaacggtttgaaacacatgtttttcttttgacataatataatcatgtgatattttattgtaaagatttaattgcaacgaatataacgatgtgatcggatcgtagatcggataagtaatttaggagaaaaaatatttaaagagaggagaaaagaatgaaaagaaacagctaggcacatacgttataggacagggttcattctcacatgcgcttgtttagacatccgatttttggtgtgatgccggatgtccgagccgtagcgctctccgtgtattccccatctccagtacggcctagcgagtggcggcagcggtgcaacagcagcagcaagaccaggcagccagcagggtgggcgcggcggcggcggcgacgactgcgggtcgacgcggctcaacagcgggccagcacgacggcggcgaccgttggccagcacgcaggaggcgcggcggcaaccgtgggtcggcgcggctctgctgcgggccagcgcggtggcgacaaccgttggccggtgcgcaaggaggtgcggtggcagcgtgaaggagaggcgtggccttggtcaggtggcctgttggcaaccgcgggctagcacggtccggcgcgatggggtgctcaggactgggtgagtacggttggggaagggaaggtgcaaaggggaaggttggcgcaggggctgctgggggccgacggtgcttgaggaggcacagatgcagcagggcgacggtgctagaggagatgcaagggtggctggctggcgctactggactttatggtgtttgctatagctgaaattgtgttgaaattcagtgaaatctccttgaaagtatgttgaaattttgtgaaatgaaatcttgtatatttattgctgaaatcatgttggaatcctgttgaaattttgtgatatttgtcaagctattgctgaaatctagtcattttttttataaatttcaagtatagcaaagttcacttcgaaacatttgtaaagttcagttcaaagctgaactcaaaaaagggcaaatacacaagtgggcacatatttgcataagggtatactcggcgttgtatctccgatctaacaccattagctagttttaacagaacagggggcactctgctccttcatttcaaaaaagcatgggcaaaattacaaaccctaaaaagtaatggcaaaatcacaattgaatcataaagtaagggcaagaacataattaccccaaaaacataagtcttgagatgttaaactacataaacttttaaaaattgatgataaaaaaataagtgcacaactgaaatgacaaatactgtctattccctcgatccccatcaccctaccaaacttcagttcagaaaccattcgagcgatatgatttccgtctcaaacagatcgtgcaactacgacgcatcggtaactaacaagttaaccatttccatcatcgaaaattaattaagtaacgatcaagcaatgctgatttaatttttctctgtactccatgatagaaaaggttgcatttcttttcaccgtgcaattaacatggtgagtgttgctcagtagtcagtattcagtatgaaaggacaagtaggcacgcggcataggctgggcgatgacaaaatgatcgttcatctgccacattgaatagtttgatcgatgattcgacgcaaaatgttgcagattttccgggctgattcagcatttgctaggtgattcgttgttgtcacatagacctcaagaaatttaaactttaatttgtgcatattgttgggggtaaattaattagccaagagtccacacctgcatgtgcacactgagctatattattggaccgagctaacgtgtttcggttcgtacaaattaactagctaggctgcaccactagcttacacagtaaccttctcttttccggaatcgacgggataagataacacggcaaacgccattgtttaagtacggttgttactacccttcagcactatttcactactctgaatatatatttaatttcatctcgtgattaattactgagctaatccgggctggtgattgatgagagggttggtgggaaattaaccaatcaagctagctcgaggggacgttttacctccatctttacttgtaaacatactgtatcgaggttgtagctgcggtttacggccaaaatggaagcatgtactccattttaatctctctctctctctctctaatttattgggtcacttaacccttaaacttgactcattttatcgctaaattattaaaaatgtttcattttggccgtaataacatttctttttttactcttcatataagttgcattttaagctaaaaattgttagagttatagatggtaaaatatgaattatgtagagagaaaaaaagggggaagaaatagtgtaaggggagtaaaagtgaaccattttcaatatttcaagctgtaaaatgagtaaaaatagtttaggggatcaagtgcttcgctgaaatatggattttttactttttaaaaccagaacaaataatccatgtcaacccagtagataagcttaaaaaaaatagggcaaatctagcttttgaatatgccatgccactctgaaaaagctgatccggccattcccacagaaattgcagttgtaacatcccattcccacagaaattgcagttgtaacatccataggaaccgtagtcgtaacatccttagttggatgctaaacagaaaaaataaaaagatactccctccgtactaataaagaaagttatttaggataatatttaagtgaaacattgggaatataaatcatgaataactcttaagttgttgagtttgaaaatgtaaaaattatatgaatagatttaccttgaaaaatactttcataaaaatatacatatatcattttttaataaatatttttatagaaacaagaagtcaaaattgtattaccgtgttactgtccaaaacgattttctttacgagtacggagggagtagtcagttagccatgtgttttaccaagaagtcaaagtgaatacaacacaacgatttgatgagcaattatggcatatccaagtttaaatatctccttcattcatgaatagtaaattttaagtgcaattggcctatcaaagtttaaatgctcctttatactcccttcatctaattttgatagtcatattttatcttagcacacagaccaatgataagtaattatacttatcatccatttaaatatgctactagtcattcctagtaaacaagcgattcattaacatttacatttctcaatacccatgtagccaatcatatgtggaaaaatggagagtcatgcattaaatccgagaaagtcattaagatgataggttgttggattgaaatatgcgtatcaaaaataaaattttcagatttagaaatatgactatcaaaagtagatggagagagtagtatttagaatttattggtttgtattctctccgttgacgttaaaattatttggcacagccaacgaggtccacgacatggtggcagccagccagttggagtagtatgcgattaatcaataaggttagtctgctctcatatgttttaaagaaacattattatctgtgcaatgaaattattcaagtcactgttgatagttctggaattatatatattggtgaaagagaatattagaatggcataaagagctaacccatttcatccttgatgtcccatcgatcaacaaattaaagcaaataaatttcaggccctgtttattcatatatatttttgttttatgtattgatttataccacgtttaatgcactacatatatgcatttttaatcgcagctcggatttgttatggtaatatatatttcttcgaggattaggaagacactattaatttataatgatgtatgtttccactattttccttcttcgaattgctttggtgaataggcatataaaacatctcacacatttataaatataagtttggtatacatgtcttgatatcttagcgcagatcaaaattagcgtacacacaccctctacaaatttatatcttagcgcagatcaaaattagcgtacacacaccctctacaaatttattctaacatgttaatttcaaagaagaagaacctgaccaaccacatcagtttatcaacatttcctttttaatttatggttatgtgcattcctagtaggtgcagagtttagatgtatttattaattattatactcctttatgatctttaaaaaataagtttgtcaataagaagcaaatgcgctctaaggaattcatgctccagacatgctagaaaggcatttgatattttttttagcgttgttttggtacttgctatttcttggatttgtagtttctcttaaaagaaaccttcacttggtaccatttctttcatattaattgactttgacgtctaaaaaatcttacgctttttgaaatacaagtttgagaaaattcaataatagaaaaaaataagatttaaatatgaataaaacccaaaaaatatattttaatagaccgtggaaaaaaattaaaaggagagataaaaactcaaatgaagttttatgaggttaaacctcatgctaaaattcctttaaaatcttcttgtcttaagccattcaataggaataatataagattgttatattagggtgctaatcctatgtttcaaaggatcaaagaggatatttttctacatgatttaaatcatataaatctcctatgtttttccaataaataaatgtgttttgtttgttcctttttttcggtgtgcacaacaccgcacaaggtatataatcttgttaaaaaaaacacctacatgcaaatataaattaaccaaacaacatttactatacatataaaaagtagctgaattatttaccgatcatctggtgatagatcaataatgccaccacgcctaatgaaagctacatgcacctagctgacttcgtac

SEQ ID NO: 60850 - DNA, 6630 bp, Oryza sativa
tggtagtcgtggtcctaatcatgcttatattgtcactcgattaattatatatgtaagatatatacgcattgttattagcgtgtcagctttgcatttctactaactttttgtttgtacgtactttgcttttgtataatttctttgtcctttctcgtaactgtgctttgcttttgctgtttctctcaaaaaaaaaaactgtgttttgctgcctgtacggcacctacctcttgctagtttaatccggctggttgcaaatctatgggtgtgtggttgatgagaccatgcatatgtatttgctgatcaattattctaggtgcagatgtaattaattaatattggaagcggttcctgattaattaatgaagtattataagccaccgaggaaaaaataagctagtgagggagagtattgcagttactatagcaggtgttgcatctgaaaacggatgagatcatacattattttatcagttttcagatgcaacgttctccggtgactaagacatttacctaggaacagtgacttaggcaatacaacaactctgttgtatttggtcaaatattgttaaaaattggtgttggttaatttctgctaactgcacttaattattagcacataaatccagatacatttagctatatctcgaatccgacgttttgtacagcactacaactccggagtcttaattttcactaagtcaaagagaatctattttcatattctttttctttttgttagaactatattactccctccattccaaatagatctatatatttcatatgtacaccaagaccaagaaaaactaataactctctcatactatatttactctagcaacaaactcgatgcatgcaccatccccaatattttctagccaatagcaaatcaagatattgcatgtgggttataaatacttatgtgcatggatgcatgcatcaatgtccatttactccaatgcacaaataacgaatagacttaataaatgaatacaaatatgcagatcatttaggaataatctcaaaataactactccctccatctacttttgatagtaatatttcatcttggcacacagaccaaggataagtaattctacatatcatctatttaaatatgctactagtcattcctcgtaaacaagcgattcattaatatttacatttctcaatgcccatgtagccaatcatgtgttgaagaatagagagtcatgcattaaatccaagaaagtcattaagatgataggttgttagattgaaatatgcctatcaaaaataaaattttcggatttagaaatatgactatcagaaatagatagatggagggagtatatttttcttcctcaacattggtcataaactagttacaccggtaatggtctgctatatgatttctctgcacacaaagtgacagagaagttgattatcatatatattttcatgtacaatttgtaggcagaatgcattacccgtacagctaaaatagacgttgcaacctatacatagattccagcggcgccgcagcagttggatgcaatcacaaacggggtgacagctagggtcaacaactcaagagaaaacaagggctagatagcctatagaatgcatggatccaaatccatccaattcgcatcccacaaattgaaatccatcaaattaatctcgatactacaaaatagtacaaacgaacccaaatattttttttataaacaaaagctacgtgaacacacagctaataaaggaattgttatttgttcctatcacaagtacttttacaataatctctacggtaatattctagctgctaccacaaagtaatattaattaattgttgatttacaaattatactcctccattccttcaaaagaataagcgtaactagtaaaacttattctactaccagtagttttgatgttctaatataaatgaatatgatttattgatgggaaagataaactgtctatatatatataaattgtcaagtaactgtagtttgtgtctctaagttttcgctcgatctcttttatgtcccacaagttttttttccttgaaaatgattatgttgccactctcatacatgcttgctagcttaataattaagaaaaacacaattatcaaatgaaaaaaagattcatttgtaaaaaaaggggcataggattatttaaccacaaatttaactgaaaactgatatttaaaatttaaactaatatcaaattaattttgattcagtttctacaacattttcaccaaaatttaaatccaaacaaaaataatcttggttctcaatttctcaatgaaactcttgtatggatttaataagaacttaaattttgtttaaaaatatatatttaatttttaacatttggcatcaaatgattcagtctcatttgaattttcataatttgatatgtttttcacattatgatttatgttattaaagtagttatcacataacacgtacgagaggtaggtaatatagcccttttagaaaaaaaaacattcaactcatgcatggtgttagttaacggaagggattagctattgagctgtcgacagtttttaagggtcaaaactttcaatttttttcaccttaagatctgtaatcaacggaccataggaaacgggtctgaaccaactgaaagcacgaaaccaatccgtttagagcgtgtgggcacattaagaaaccctgaataactaggcacactgtaactaaatgtaactgtaactgagctgtaactactctataactagattataactggactgtaactagtgtgtaactagggtgtaactggactataactagtgtgtaattaggttgtaactggactgtaactagtctataactaacttataagctctatttaactggaatataattaaacatttttatgtaactaaatggaaaaacatcaacgatggaatttatataactgaatagaaaaacattgacgcctccatcctcaagatgaacaacaatacatgcgtgcgaaaatcaacgaatcgtttcccctagaaatctaggagaagaacaccaaccaaacatacaaaggatttatagggcaaacatgatgcaggatctgaacacaaaatatcacatgaacgcaccaaaaagtgaaaaaatcacatgaaattttgagtagagagcgtgaggcagagaagatcgctgcgacagcgaggaacacgagcagctgaaggggaaaaatcggcgaggaagtgggcagcgagaaacccaccggccggcagcaaaaaaaatcgccgagagctgcatctggcggggtctccgcctccgcctaggccacctcgcctccaagaaatttctggaaaaaggcaacatgcagctatacacgccaacgggtagcacatctattggtcatcaggtttggatccaatagaaaaaaatctcacacgaatcatggcgccagatcgaacggccataaaatcgaatgtttctggctccaaaactgtcgacagctagctagcaaaaccgtaacggaatggacatagaacaaaaacttaaaaaacatgtagagaattgagacaaaatttagcggtacataaggatgaagaaaaactcaggagcaagtaattaaagaattttctcaaaaacacaaacgaacgagccttctattaactgtttgattgtatatcttggttcatatatatatactgtccttgatctgtggcctttcccaaactcgatcgttttcgagcttttaagtatatatatacctactaagccttgtaaatgtccggccacgtccgaggttaatttacgtacgtgtggttgatccatcccgtcaggacgtcacctaccactggacactatactcgtccaaattggttaatttgggtgggttcggcagcacacgtacggttggtgatggctatccaagtatgttaggtaggattcatctatatttgcatggtgtatcacgttcagaatgtcagaaatgtgaatcctgtacgtctttgtatacgcgtacgcgtagtagctagcaatatggcatgctaattattctcacaagtagtatacgatgtatatatataatcctaatgtcaggggaacgtacttaattatgcaaatttgtgagtttacctgagagattcctcactcataattttattatggaggccggatgagatagaagctgatgcccgtgagaaaggtcttgtagttggatacttaattatgcaaatttgtgagtttacctgagagattcctcactcataatccagctccgaaacgcggcggcgaacacacataaaaaaaattatcgaggatataatacatacttattatttaatatattaattaatatagttaataattgaatagcctatatgggtttaattttcgcgttcaccccaagaaattaaatgtaggaaggccactgtcaatactacaaaatatcaaataggtgtcagcactatatgcgctgtaagtgctaaaaagacacctgtaggcttttttccactttcgcatgttgaaatcctaaaaaattggcccctttaagcaattataggtgctagttctaaataataaccgatacctattttataggtgccattttttaaaaaaaaaaacataacctttaatgttaaaaaccgacacctataacatattataggtgttttttttaaaaaaaaatacacttctgacttaagccgagccagtgggccccaccacgaatgacgaaataaggcatcacgaggagataaggttcaatccatccacagacttccagagccatcttgcatctctctctccctcatctctcaactctctgcctcccttctctctcgttgtcctctctctctcgctgcccatggccggcgaaggcggcagcggcggcgcgtcctcccctccgccagatccggggaggggcggcctagcggcggcaacggcgggaggtggcatgcggcggtggaagggagggggatgcggcgggaggtggtggcggcccagcaacggcgccttccctctgttagatctagagggagggcaggcggcgggaggggaggcagtggagacctgctggcgagaggcagtggtggcccggcggcgggatgaaaggcagtggctgtccgacggtggcgccctccctccgtcggatttggatggagggcaagcggcgggaggggaggtggtggcggcctggcagcggaacgagtggcagtggcggcgcacttcctgttagtgaatgatttctgtgaatgttagtgaatgattttttgatgttcttcaatgttagtgaaagatttctgtgatgttcttcaatgtttcttgttctgtgatgttgtttgattggggattgggggttgtgattgatttgggagttctgtgatgtgggatgaatgagctcgatactcgagtctttttttggctcgcgagtaatctcaaaggtgccggttcttaaaacgggattagtgccggagcactcatcagtgctatcttcatggtgccggttggaaaaaccaacacctatggggtttcccaaccgccacttttcacgtgttctgtggtagtgtgtgatccatccagcaattttctagctctcatgtgcatgcaaccgttccatgcatgcatgtatattactcgctccgtactaaaatataaaagattttaagtgtatgtgacacatcataatactacgtatacgaatttatatgaaagtctgtctaaatttatagttttgttacattcacctaatattttttatattttggcataaagggcatatatgcatatcgcctcacacaagcgtatgcaccagcgaaccagcctgacacctgttcctctatgaatccatgccaatccgtgctggtcagagcagcatggccatgcacgttcacgtgtgcatcggtagatcgaccaccagcgtatatgcatatgcccatgcacacgtacaatctttcaagtaccagctgggtgatcgtacggcccgcacgtttccatgcctgtgtatactttggctggtcgatcgcctcgcgtgtatcgccagtgttcagtgcgtgtataacacgtcttttatatatacgtgcttgtatgactaattgaatgttaattatttaaaggaaaaggtatgttttactcccccaactattgcgacagtacaaattacccctcgaaccacagaaccggatatattacacctcaaactattgataccggatgaattaccccccccccacacacacacactcaatactaagcggttttgctcctacgtggtatacacgtggcgtcgacatggaaatccaatcaacaaaacaaacaaaagaaaatatagggcccacctgtcattacctctcttcagtcttccccctccccccttctctctctcaggcacgtgtcgaagggcagtgggcggcggcagcggcgcgtggacgggcggtgagcacggcggcagggagtggtggacctgggacaggcggcgggcgcggcgggtggcacggcggggagtggtgggcccgggacaggcggcgggcgtggcgggcgtggtggagaggcggccggtggccggcgggcatgacggcgcccgtgcccccctgtcactgcggagggcagcaaagcgcggcagcgaggcggttggcggggggacaacgtcgcggggattcgccgtgaa

SEQ ID NO: 60851 - DNA, 13442 bp, Oryza sativa
gccgctcgcctcctccgcggcccctgcctcaccgccgccgcctagcgtccttcgcccctgcctctcgcctcgccaccacgctcgccactctgctgcctcgcctcctccgccacccccaccacgcccgccctgcctcgccttctccgccccagccacgctcgcctctccgccgcctcgcctccttcgcccccgccgcgctcgcctctccgccgtccccgtcgcgctcgcctctcctctgcccccgctgctctccaccgccgccgccgccttgcctcgcctcgccgctgctgactccaccgcgcttgctgcctcggccgtcgccgtccgaaggagaagagggagagagagtgagacagtgagagatgagataggagagagagatagaaactgacaggtggggcccacctatttttttaataaataaattgctgactctactgccacgtaaaccaaaaccaccgcggattaggtcgaggggggtaattcgtccggtttgcatagttgggggtgaagaaagtccggttttgtggttaggggggtaattcggacgaccgtgatagttagggggggtaattcatactttttccttatttaaatctaaataactttcctatagatattttttgtaaataacacaacacttagcagttatgaaagtgtacacgtggagaacgagatatttcttttcctaatcaggtgcaaacgaatgcagcctctcaagagtctatataccgagcatgtagttggtaatttcaaaatttcacaactactaaattctaaattaaaattatttgcctaagcagtctgcaaagggttgttgtgagggtgttccgggtttagcggttaggcgtttgtgaggcgatcgcggtggatccctccgtgacgctgacaacgggtgcaagcccgatcgtcggctcgacgcaagctgtaaccggcacacctactggcaaagcgcgaggcggcggcgtttgcggccgattctgggctatctctgacgttgcctccatcgacgacgatgagtctgaggatgagatgcttcatttacaaccatccgtccctaaccacaagatgagttttcctatgggtgcaggtcttgaagaagggtggacgacggtgaccagacgttcaagacaagggcggcagcaacatttggatgcgttgtcgtccggcgttcaccatcatgcatcaactagcccaagtaagacggaaaatggaaagactccgtggacgggtgcccttcctccgcgtcgacgttcgccgccggtgacaatcggcgacctgatttccaaggcgtcgcaccgtcctttgcgccggccgcggcggccgagcggatcagagcagccgagatcagcgcttcctcttcaaacgaggggtcaaacgaagtctccaagaccggcacaacattagcaaaagaatgggccatgcatcacaccaaacatgcgggcccagccgcctaatgggctccagtctaagggccctggcgatggcctctacaagcgacaaccaaaggcgctgcttgccctagctcgtaaacagcgtcgaccaatcaaccccaagcgatcttttgcggaagtggtgcgagcgggtgagatggctggtggtggaggacgatatggcggcggccgtggtaccggcagcggcggcgatggccaggatggtgacggccgtggcggcgtgttcaatccaggcaggggagaaggtggcgctgggcggccgcgggggagaggaccgtggcggcctcgcggcagaggttgacatcccgggaacacggctttgtctggagcggctaccgggaatggcagtggtggtgcttccggccgtggtcatcaaggccgtggcggagacagtaacagaggtccggatggtcagttcgctgtgaatctgaatgcagcaacagcatcaggtactgatgttccaagaggagagtctagggttgacatagtgactgcagaggctggcacttcttcaaaggcgtcaaaagggcgttgtttcagatgcaaggagaagagccatgctgtttcagagtgcacaaagattttgtgtgatatttgtgaagcacctgaacatactgcactttcatgcccgcttttactcgctcccaaacccacagcaagcatgtgtggatggggagttgatggtggaggctttttcatgatccccacgccaacaacaggggcagtgaaacccagggaacacaacaaaacagcaattatccgggtggagaatggccacatttctgtggacaacttgatcattgaattgcgaaggttggtgccggttaggttccaatgggatgttaaggagactgctccagacacttatatggttcaatttccctctgtgatcgaattagacaggttgcgtagggttggcagtgttcctagttttgactttaatgtgaacctagtcattgacaagtgggagcaagagattgaagcgaagtttgttctaaagaaaacttggtttaaagtttatggagtgtcatatgagattagagactttctcagtctacatgctgttggttctgtcattggtcaaacaacaactgtggacatgatttatctcaggaaaaatggtgtggttaggatgcaggtggcagttgatgagttagcagatttaccacctagtgtttacgttgttgtccgaaaccatggctatgaaatcttctttgaaccggaattgcctgaggtggatgggaaaggaaagaagaagattgatgatattgaccaggacggagaaagaaaaaatggtggtgatcatgatgttcacatggaagatagggacccaaaacgccaaaagaatggttctgatgggtcgctaaggatggaaataggaggcttagcgccagctaagctgccctcaacgcgcaccaataatatggttctagataatgaagcattttcaccgtctcctagctcagatacgcctgctacaacaacggagttggaagcgtttgcctcatactcctccgtggtgttggaaacgcccatgagtcaattgggagcccaagggacaggaaactccgagtcaaccaaggaggctgtcggtgaggtggtgtactccgacgaggtttcgacacagctagcgaagttggcaacgactaaggtactttctactgaggttgctgtgcagctagcaggaacagatgaggtggttacgaatggcaaagagcaacaacaagaacctgtcagcatggcacaagaattacagcatgtttcagctagcttcttgtctcccgtggagcatgtattggactgcaacgtgcagtctgaattgctccccaagaatagccagcttgcaggcgatggaagagtaacatcgactaagaacttgatggcagtactagcaaccaatgaagaccaacttagtgcctccagtgctgccacatctaaagcccaggatgcagcacaggcagttggagctcgatccccgacaagaaggcgacctcgtcgcccagtggaccctattccaactaggcaaagtgaaagacagaaggcgatggcaaatgcagatgcgccggtggcaaaccgggcagagctgcttaaaaaggttcataacctcgagacgctaacaggtaacaagtttaataccacaaattctgttgcttcaattccagataagactcttgctgcaaatttttctaaattaggggtttctctaggaaagaatgatttagaaataaaggagtccattaaccagattaaaatttcagaagtggatagatttgctactctttatagtagtgctgtagcgtctactagtaatgtagataaaagcaatgatgaattgttaaaattgtcttctctccagcacttatgtagtgactggctagaagaggctgagagtaatgacgatgagtctatggattctcaggccatacctcaaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatatgttaaggagcaaaatttggattttattgccattcttgagactagaaaaccatcattcacccctttaaatcttaaaaacctttgtggtggaaaagattttctttggcatgagaaacctcctatcgggcgatcaggaggaatacttttaggagtaaatttaaatgtttttgatataggtgaaatttcagaaggggacttctatgtgaagtttcttcgaagaaataaagaggatggtttcaaatgggttttaatggcagtatatggtgctgctcaacccgagttaaaagaataatttttgacggaactagctcagacttgtggtaaggagtcataccctctattggtagggggggactttaatatcattagatcacccgaagaaaagaataataattcttttgaccctcgttggccttttctttttaatgcggtcatcaatagtctcaatttgagagagattatctttcggggagacaattcacctgggccaagaacctcgaaaatacaacttatgagaagttggatagagtgttaatgaacactgactgggagcaaaaatatcctttagttacgtgtcaagccttacctcgagccatttcagaccactctccaattatactgagatccggatcgcatgcacattttggcaatcagccgccatttcgttttgaattaggctggctagagcgggatggattctttgagatggtagccaaagagtggcaaagcataaacaagggaaggaatcctatggaacgttggaaacacaagattgtccaccttaggcaacatttaagagggtgggcgcgaagtttaagtggcacatataaaaaacaaaaaataaagcttttagttttaattaacacactagacaaaaaagccaaacacataactcttcgttgaagcaggtcaaaaatgatttggcaaaactgttaagggacgaagagttgtattggtaccagcgatctaagacaaatcatttactccaaggggatagtaatactaaatattatcacttgatagacaatggtaaacatcgtaagcagatgattttccagttggaacaagaggacactataataacgggtgaggggaatctcaaagaatacatcaccaattattataaaggattatttggtcctccagatcataatcatgtatccatgatagagggatggactgatgatattcctcaagtgtccgacttggaaaatgacatccttactgctgaattttcagaaaaggaagtcaaagaggcaatttttcaaatggatcataactcctccctaggtccagatggctttcctgcagagttttatcaggtcttttgggagattgttaagaatgatctcatggctctatttagagaatttcataaagggacattatccctttataacctaaactttgggatcatcgcgctattgccaaaaaaggctgatgcaaatcaaattcaacaatataggcctatttgcctactgaatgtcagctttaaaatttttacaaaagtggacaccaataggattacaacggttgctcacaaagtcattcgcccaacccaaacagcgtttttgccagatagaaatatcatggaaggggtggtgattttgcatgagactgtccatgagttacacacaaagaaaatggatggtatcatattcaaaattgactttgaaaaggcttatgacaaagttaaatggcagttccttcagcagacattacgaatgaaagggttttcacaatcgtggtgcaattggatttccaactgggtggaaggaggaactgtaagtgtcaaagtcaatgataatgtaggaaaaaatttccggacacgcaaaggcttgagacaaggggatccaatgtccccaattctttttaacatagtggctgatatgttagccattcttattgaaaaagtcaaagtcgatggccaaattagaggggtaattccacacttagtggatgatggtttgtccattctccaatatgccgacgatacaataatatttcttgaacatgattttgaacaagcaaaaaacatgaaggccattctttgtgtgtttgaacatctctcggggctgaaaataaactttcataaaagtgaaattttctgctttgggggagccaaggaaatggaggaccaatatagacaactgtttggttgtaattctggttcctttccattcaaatacttaggaatccccatacactatcgaaaactcagaaattttgattggaaatgtgtggaggataggtttcaaagaaaacttagcgcatggaagggcaaaaacagctcctatggtgggagattggttcttcttaacttggttctttcgagtcttcccatgttcatgttatccttttttgaaatacctcgaggtgtacttcaaagactagattactaccgatcgagctttttctggagcagtgatagccagaaaaagaaatataagttaacaaaatgggattatatatgccggccaaaagatcaaggtggactgggtgtcctaaatcttgatatcatgaatagatgtttgttgagcaaatggctattcaagcttcttaatggtgatggcctatggcaaaaccttttgcgcaacaagtacttaaagggtaaacccctctcccacatgtcacacaaaccaggaacatcccaattttgggctggcctaatgaaagtaaaagatcaattttttcagtatggatcttttaaacctggtaatgggatggaaataagattttgggaagatacatggttgggcttacaacctctcaaatatcaatatccttctctgtacaatgtggtccgaaaaagacattctactttggcagaggttatgagcacaacaccgttgaatgtttcattccgacgatcaattgtaggaccaaagttagttgagtggaacgatctgatctctcaactagctaacataaccctgtcaaatgaaaaggattgctttatttggtcgctacataaaaatggccatttttcggtcaaatccatgtataatgcgatcatcaattccaatgtaagaatccacaagaggatcttatgggaggtaaaggtaccactaaaaatcaaagtatttatgtggtttcttcacaaaaaagtaatcttgacaaaagataatctcataaagagaaattggaggggaaacaagcaatgttgtttttgtaatacacaagagaccatccaacatcttttctttgactgtcatgttgtacgttttgcttggcgatgtgtcttctttgccttcaacatcccccctccccacaatgcaaaagatatatttggtgactagctaaggggagtgcctagacccacaaaaaaaatgattttatttggagctagtgctttatgttggtcaatttggcgttgccgtaatgatatagtttttaaccataaaaaaatgcctaacatcatgcaggttatcttcatgtgttccaattggctccactcttggtgtatgatgctttcacaggaacaacaggatactatgcgcaatggtgctacacgcttggaaatagtagccaaggaacttttatttcattttggatggcgtagtacctacagaatttcgtgatagaatctacgtgattttgaaaaaaattattattttagtagatcatatcatcggcagaagttgagggtttgtcccatctcgccttttttaacttttctgttcacgtctgaatttttttggctgtgtgcttacgggcagaggccggagatgtaacacatttccattatttaaaaaaaaattattaaattaagaacagtacactgaaagtactccaagaagtataacaatagtccatgcaaaatatgatttggtggggtgactagcagagctaatatagcatcatgcatgatttaagcaagattatatggagatatatcacttctacacgactacaccggcaaaatgtacaagttagtgcgttctcggtctaaccgcacgacgacgcccatgtaaaccgaatttaacagtgtgaaccgggctgcaaaattaaattaaactgtcgcaagttttgtagcaattccgattaataaatgacgttatgacgcaacgatagaattaaaacaaatcaaatgacgttattacgcaacgatagaattaaaacaaatcaaattaagtcagcctggtcagtgatcagtgcaccatagcgcagctaaacaaagcaggttaaacgtgcttaattaagtcaacacaaccacactacctccctgccttatttttcttttcaaacctctgaagaaaaagttcagaaaagacatggagaacaaaaaaaaaagtgtactcctagctaagtagcgaagctaatctgcttctataaatacccagcaaggcatgccgtgtcacccaccacacgcacacagttagctctagctttgcttgatttgcagcagcagcagcagcagcagcagctagcttgcatccatgggcgtcttcgccgtcaccaaggtgtccgagggccccgtccggccgtccgcagcgacgccgtcggagacgctgccgctcgcctgggtcgaccgctacccgacgcaccgcggcctcgtcgagtccgtgcacatctacctccgccgcgacgacgccgccgtcgaggcgccgtgcgccgacggcggcgtcatcgtcgagggaaagaagaagaataataagccggcggcggcggtggtgcgcggcgcgctggcggacgcgctggtgcactactacccgttcgcggggcggatcgtggaggacgagcggtcgccggggcggcctgccgtgctgtgctccggcgagggcgtctacttcgtggaggccgccgccaactgcaccctcgccgacgtcaaccacctggagcggccgctgctgctgtccaaggaggacctcgtgccgtgcccgacgccggagcagtggcccgtcgagccgcacaacagcctcgccatgatccaggtacatacgtgaattaatactgcattattcctgcttgctttttttttcttttttctttttggctttctagattttgctttgcactgttggatctcgttatgtttttcatgtgtccttgaaattgatatggcaacaagcatgcggcagtttgaatctatcaatcaaacatgcacgtcaaacttaatttcgtgaaaagaaaattaaattaatactactgctagctcctgttgtgcattgtgagtgtactgcacttgattagtacaggagttaactgcatctacgactctagtaccaacgtgattgcaacacctagctagattaaaaatacctttttcgtctcctttgccacgaatttgaattgatgttttattctcatacctatactatgtactggagtactcctgaaaaccagtgtagcttgcagaaaaaatgtcgaggtcaaaacctgggtacagaaccaaaaacaaagcaaaaaaatgacgcggactcatcagtcagttgattaattagttggaggtcacgtgatttgcaggtgacgacgttcacctgcggcggcttcgtgatcgggctgcgcaccaaccacgcggtggcggacggcaccggcgccgcccagttcatgaacgccgtcggcgacctcgcccgcggcctcccggagccgcgggtgaagccgatctgggcgcgcgaccgcttcccggacccggacatcaagcccggcccgctgccggagctccccgtgctgccgctccagtacatcgccttcgacttccccgccgcctacctcggcaagctcaaggcgcagtacgccgccaccgccggcgccagcaagatctgctccgccttcgacatcgtcatcgccaagctctggcagtgccggacgcgcgccatcgccgccgaccccgccgcggccgtcaagctctgcttcttcgccagcgcccgccaggtgctcggcctggagaccggctactggggcaacgccatcttcccggtgaaggtgtccgcggcggcgggggaggtggcggcgtcgtcggtgatcgagctcgtcggcgtggtccgggaggcgaagcggcggatggccggcgagtgcctgcgctgggcggaggggcgcaccggcggcgccgacccgttccagatgacgttcgactacgagtccgtgtacgtgtcggactggagcaagctcgggttcaacgacgtcgactacgggtacggcgcgccgtcggcggcggggccgctggtgaactgcgacctcatctcgtcggtgatcgtcatgcgggcgccggcgccgctcgccggcacgcggctgctggcgagctgcgtcaccaaggagcacgccgacgacttcgccgccaggatgagggaggatctcgtctaatataccatggccgcccccaataacattattagtcacgtacaatattgtcactgaatattaatttgttcgtgtatatctattgtggtatgtattttttttttcataggaaaaaagtagtagtacgacaataggtagctgggagctacctaatatcgacctctggtttgagagtaagtgagcgagcgagagatgtaaaccacctcagtttttaccgtgctttgtgacatgcgtggtacagtactggtactattaatcattggccgtgaaaaattatctacccatatgccactgtatttatggttgtttgtggaggattacgtatactaatttatctatgtcttacatttttcttttcatggacgcactcttaaggccccctttgaattggaggataaatggaggaaaaacaaaggaatggaaattctatactattcatgcctttgattcgtagaaatgagaaaaggaaaaacgtaggaaactttcctattcctatgattttagaggaaaaaagtagaaaatttaacatccactctaacctcttggaaaaattcccttgagtgtatctctctcatctggttcctacgtttttcatgcggtccaatcaaacggtcattcctatgtttttcctgtgcttttgcaatcctttattttacacttgtattcttatcagtcctacgatttaaatgggtcctaaatatgtgtctgtgtgagatgcccgttaggtttcttcaattcacgccactatttcaagtggctagctacatccactacatgagttttcccttggagacaaacctcctatcataagaccaaccgtcgacaccagacaccagtgacgtcctctattactgtggctcacctcccacgccacctttcttctaataaaaagggggcaattggagttcctcgttaccgctctggctctcactcactacgcctcctcacctccactccaactctcccgtcatgatgcatggactcaccgcgaccgccttagaatatcaccaccagtgaggaggaggaaaacaacgatggtaagcgacaaaatgcatcttgttcgaggccaaggacaagatacaataaaacgaaaagaattgtgaatgcctagcccaatatgcgatttaagtaataaaaactgatccaaagtacaattcacttcgaaataaattttgtgctcgaccaattcgatcatcttcctttttgtgatgattcggttaaagtgtgaaaggtgacaatcaacctgcaagtacacgtacgagagagtgacactcctcatatctgatatctgtgttgaaatactcccttcgtcctaaaataagtgtagttttacactatttacgttcaacgtttgatcgttcgtcttatttgaaaaaaattttatgattagtatttttattgctattagatgataaaacatgaatagtactttatgtgtgactaaatatttttaattttttcacaatttttttaaataggacggacggtcaaacgttgggtatggatatccacagctacatattttgggatggaggtagtatattactactgtcaagtcatatacttaagataatttctaactctgccactgacactgggtctagtcacatacacagccatgcatgatgcacgtacgtagatacttggattgtgtacggctcgatccatgatgcggacccagcatatagtaccaaaatagtggcagtagtttggcattgcacaggcagtacgcatacactaactcatcgttgaataggagtaataattatactaatccatatagataacccttacaccgttttatattataaatcattaattttaacctttttctggttaatttttttaaatgtttgactaggtttatagaaaactttagcagcatctaaaaaactaaatttgtttcattaaatctcacattaaatatattttaatagtttacttattttgtgttaaaaatactactatgtttttctataaatttggttaaagaaaaaagttaaaatgatttataatatgaaatgaatggagtagtgtactacacggatacacctgcttttgcaattttcatgcagctttcgttcatttatttatacatacttcacttacttctctctacgtaccatatatataaatatatggaaggtcttcctacaacaactattatttggaagttagtagttcacatcagcttcataattgtatgagtgtctggagtaaaatctctctcggcaatcagcttatcagcataaacatactatatatctatcactggacttttattacaacgttctgctcactttcttgcaacaaacgccaagccgtccgtacaatcttctataattgcagggaggcaggtgaccggcaaaactgaagatctcaaacaccaaccgacactggtgtactcatgcaatattaagaaaaaaataataattcaagctccagttaagctagctatagcctacaggctatatattgctaacgcacattatttttcgttgacctccttccttttgctgatcgcgagaaattaagctagagcaagtataagagaggctgatgaaacatcgcatcctactgcttatttccaagcgtcttaaggaccttgtttttgttttttttttcctcctcgccgacctaatattcacctagctagcataagatatttacgtacggcaactgcagaatcatcctctcgaattagcctgacgcaacatgtttgccaatcgcgctgagtacttttgttacttgcaaattgcacctaattcatcaacgacttcagatttaagaatgcaacatatgcatgcatgtagtattgatcaaggctcaccactcccatggcaatgcgaaatggcaagctttttagttactactattttcttcggtcgtaaatatttgacgcatttaatttaagaaaaaattggttatatagcattaaaatatcactttttggttttatagcaccgaaatataccggttcactttaatagcacctaaagtttaccccgttcccatttttaacaattccgttaattctcaatcgttttccgtccgccttgatcgctattgacccagccacgcatccgatatgggctgcaggaat

SEQ ID NO: 60852 - DNA, 17177 bp, Oryza sativa
cgatctctcacctcacccacccttccaaagcacgcacccctcccctctgttcccccatatcattccttttctttagctatacagtagaagtagttagtaagatgcagtaagccaataatcatcacataacaaaaacaaaagttaaaacaatcacaatttttaaattgttattgaattttctgtccttctatatcattgtattcatatcacggttaaaattaacagttcaaaaccagtattaattatattttgacttgtaaagacatatgttatattcggtcagatcttaacccttttaacatatgacatccaaaaagctatagtaaattacaaagaaaattgaaattagacgttaattatcatcatatatcactttgtaaaacatgcatagttaaattagatttacaatatctcgaaataaaatcacaaattgtgagcaacattcaaaagatatatattctctatgttatttttgaggcagagcgacctcccgagcaggttaggtggccacccgagctccactgctggcaggggcggatccaggaacaaaaaaaaaattgaggggctcaattacacagtttttttaaactccagtcatatagggacctttagtttattattcatggtgaaaaaattgaaaggggtgctccaggggtatccatgggtctggtgtgtagaggggactcgaatcccccctgcacccacgttggatccgcccctgactgctggcgtctcctttatcaatagccgtcgacacctataaaaagttaaaaactagtcaatcaccgaaaaacactattagtcatccggatttaacgatatcgctggctctgccactagatgaccctttgcatcattgcatgccatcccaccaatcataaaaaattatcaccatatcagttctcaaactaaacaagcccttaattaattagttgctaacgggatcacatccataacacaaatgcaagctgcaaatttttactatatctttggtatgtaatagtagactgcatatacagtgaatctctgcgctgtcgttagtgtgttcaaaaaattgaaaaaaaaatacagcattgcttatctttcctttataaaaatgaaaaggagaaaaaaaaggaagatggtgcacacaggatgagttcataaaacactccagtttgcaatcaaataagtatgtatatctatgggctaattagggtccctgtttttgaccaaccgctaattaagaatcattgtaactgcaagaagtgtcagcaaatgaaaaggacgcatcactaatcccaccaacgcggcgttgactgaaggagcctataaaacctgctgctttatagtagttgattcactagttctcttttcactcccacccttgtctgcttggcggatgtcgctcgtctctgataacatggcgtctgggtctattaggccgtggtttttctgtccactggttaaatgaaggaataagtccagtttgagtccctcaaatatatgttagatcttattcttatccctcaattgtaaaaacaggtataacgactccctcaatgttaaaatcatgcaaaataactccctcaatggtttttagagcggtttttgttgacatagagtccatgactgacatcaccaccgcaacagcatggacaattaggtagctcatgagcttaatttacttgcactcgccgtcgccaggggctgccacatctcgcaccacggtggatgagtcgtgcggattgttgtgatcgtgttgttgcttctctttctgagcttggtttcagctttcaatgggcaggcaaccttctcttcacaattctccatctaactctcctgtggcgccggttggaatgttgtcgtgaaatccgattcaccatagcgcacattcatcccaaacgatggcaatctattaggaaagttctcccacaacgttaccaggttcagtaaccccgacgcgagccatttgtacactctttagccacaatgcgtgtaggcacgagcaacttctcatactggcttggctacctgccaccgtggtgcccgacgacaacacaactctagtcctccgccttcacttcttaccttacgcatcacaatcgggcgacctttccacggcactgttcaacgtctccatcatggggaggtacgtcctgcattcttccttcttgtcgtcgcgcactggcgcggtgagggagttcatcctcgcgtccgatggctctggtgtgggtgggcaggaacgaaaatcgttgggcacctagtttggtgcgtcccaccgcttgttcttcacgcttggcatgattgtctgccgccaccgatcgcttactgtggacaccccttgtcaccgacctcccaccgtcgatgtcgcctctcatggatgagctcgtcggtcatcgttcctctccccgccaacgaactcctagggaagagaggggagaggtagaggggtggggaggagaggggatacgcgagtagaggttgaagtccaattacatgtgagccccacatgttgtatatttctttttaaacgactaggataccacgtcaaccaaaagaaccatccatactgttatgggacctaactcgagtggctttgtcaagatgattggtggaaatttctagtattgcggtttagttatatcaattaaaatcgacgtaaagatgagggatggcaagtggacttactcccaattttctaatccaaattgtgggttgcaggcttgcgacccacctaaatttccattcgctaccggcctaatggaccagaaacattcgtagcccattcaaaacaaagagcggataatatggtgccgtgggccaatttagtcagattttaggatagatcgcaccctcccaagaaagcccagcgctagtatagaccaaaggttgcaatccaaactatagtgggtttttccgctcaaaaaacgaggtccacctttgtcgttgttgctgcatgctttgacagtatggttagcacggtacttccttcgaaccaaaataaaatatactccctccatccaaaaaaaatcaaattcaacttctaaagtttaaattttatcaaaaaaaaaaacttctatcattctacccacccttagcacgtaaaacgagaatttttttcccttcaataccctttatctacatcactcttactatttttttcaattattaagggtattttagtcattctctatatccactaattccacctcgggatactaggaatgtattttttgtgggacggagggagtacttccttagtcctaaaatataagcgattttggacgaacagacagggaggaaatgtctcatccttctaaaatctcttatattttaggacggagggagtttgacgcaactgccactaagctaaagattaaaaaaatattattatatcaccatgatatacaccacatacactaatggaattagatatgttaagggtggagtattttagaaaaataaacttataggaaaaaaagtattagttaattgcatgtatatatatacgtgtcttgtattataaaacatcggaaaaatggttgcttcttatatttttttatatgggagtactattttctccattttaaaatatactgtactaacctaggatctaaatagaacggaggtagtaattactttgatgcggttcattatgaaatttgtcgcatactcactgactcacacgtgctatttattgatgtgtattccctctgtccaaatatataaaggatattgttctaatattttatctaaatatataaggaattttgggatccctagacaatattttatcttccatccatcaactcatgtgctagtttaaataccactccaacctttacttttacttgtttatttcctcaatgatcaccatcttttgtcaatgatttgacccccttccactttcttaattctttctaaaatagcataatcccttatatatacgtacagagggagtattcattttatccattacggtttctgattctttgctcgccgtaaacggctaaacataaccgggcatataaacaatactgtactaacttcgtcctttaaaaaaaatctagacataatttggccaatcctaatcatcagccaataacacccctatctcgtgttttgtttaatatcaacttattgccctaccaaaattttagtaactttaataatagcaagtgcatatttggtttgttaccaaattttgtccacaatagtttaaattcaacactacccaatttggtagtgctaaaacttaccaatattttggcgctaccaagattttggtagggcaaaaattgacttcaaaccaaacaagcccttacatatcgaagtttattgttccctgctccctgtgcgcacgcatgccatcggcggtcctcggtgtgccggtcacccagacgggtaggccttgtgcaattgtgcaggtaggttacatgccggttggtgcagttgattgtataaaagattgtacacatttgtagtactaaatatcatatattatatttaattttttataaggacagagtaaatactttttttatataaaaaaacttaatagaaaatataaccccttctatatagcaaatctcgataaaaaagattgtctattttaccaggtggggtcatcttttagttcgatttttttttaaaagaagggagtagagttaatccgtcgtagtacagcgcaaattccaagttatcacgtctcattgacctccacgcttgccgaccacactgctccagtgctcagtcaaagcactgcctcactctcacccctctggctattctcaacaggccaatcagaccaaaaaaaaaaaaaaacactgacgtcgatctgatccaaacaacgcgcggaattaattgagcacacacggagaaggagatcggccggctgtttcccggcgcatatccatccacccgaccgcgaccagcggcgtcgtcatcacgtacgcggcgggcgagtggatgtggatttggctgcgctgcggtggtctcgccgaccaatccgtcgagcagcagccgccgttccaaaaaaccggataataagcaagctagcaaagcaagcgctggcggcttggaagggatacttcaccgatggtgtccctatcgcattcttcccacttgtcgcggtttatggtggctcgcgcgcggttttgccgcgctgctcaggtgtcgggtgcagtggattggatccgactctttcaccgggttaattgcagatttgagtcaaaaatgttcacctccactagacaggaaaccacacacccgggtttctgcgtactttttctactgtatatttagagtctcatagtaaataggtaatggtatctcatggcatcttcttaagaatcgtaaaattgcttttatttagctagatttcaactatggttgtgtttagttcacactgaagtttggaaatttggttgaaattagtacgatgtgatagaaaatttgtgtgtatgaaaaggtttgatgtgataaaaagttagaagtttgaaaaaaaaaatttagaactaaacatggcctatgcacaacgggatttttcctgtgtttcaggagtagggagtactgtacttgtgggcatgaattcagtgcgaatttggccctggaaaaaaaatgaatgggaaagaaaggagcagcagtaaatgcggcgagaagacgacacaggatgtgttcggatacgacaaaggggattcattacttcctcgtcgtattgtcagattcgctgtgcttgagccattccagaagcttccaaacactgcgatctcgaagcagagcgtctccgctcgaggtaagcagcttgccttttgcaacgaaacggtttctagaagccacgaacattccaactgtactgaaacaaacaaacacaagctgcgaaaaggcgtgtgtttgttacaaacacacactgtcatttgatcaaaaatttcaaaattgatacactcgtttaaccattttttttcctcgcaaaagttgctgtacaaactcgaactctgctactcacacatatgtgatatgtacatagatggatacacaattatacacggaatttagtttctgtaatacgcttcagatttctagaaggcaggcggcctggacgtgcccggagaactcgggcggcgccggcgcgcgcgcccacgacgcgggcttgccggcctcctcccgcagcgtgtacaccgtctggtcgccgccgtggcagtcggacccgatgaccacgacgcggccgtcggggatgacggaaacggccgccgcggtgcgcgcgtcctccggcaccggcgccacgggccgccacgccgcgggggcggaggagatggcgccgtggcgcgccacgaggtgcccgtcgcggagcatgtacatgcggtctccggcctcgggggcggcgctgcaggttctcgggcacgcgccgtcgtcgacgaagccttcttggacggcggaccaggtggacgtcgccgggtcgaaccactcggcggagccgacgaatcgcccctgcgccggcgtcgggtacccgccgacgaccaggaacttgccgtcgacgcagagcccgcgcggctcgtcgcgctcctccgccatgtcggggagcgcggcccacgcgtcggcgtccgggtcgtacgccagcgccgatcgaagggcgttcttctcctcgtcgtggccaccggcgacgaacaccttcccgccgacggcggcgcacgcgaagaacgaccggcgcgggcccggcatggccgcgccacggcgccacgcgcccgtgaggaagtcatacacgagcaccgagtccgtcggcgcccacgtctccgggtcccagccgccgacgaccaccagccgcttcctcccctccacaccgccatccaccgccgccacctggcagaacagcggcaagctcccactcgctccacccacctccggcagcggcgtccacctcccctccgccgggtccaacagcaccatccggtacgagttccccggcacaccgccggccgacgactgcttgtccgccgccgggcccgcctcggcgagctcacgccgcgcctgcaccagcgcgagcgccgggcgcgccaggccctccgccttcctcaggcggttgtacgccggcgactccacctccgccttccactggcgcgagatgcggcgcaccgccggcagctggtcgaaccccacccggatgaggcactccctcgccacctcctccggcaaccccggaatcagctcgttgtaacccatgatgctcaatcgagctggaattcgagcaagaaatgcgtgagatgatgatgatttcttggcttctcttctcttctcttgtctgagcttggtgtgtttgatgtgttttgtgtaaggcagagtggcgggagtggcatccgctacttatacaaggggaaagaagggaacggactgcggatggagggatggatggattgcgtgatttttttggggggtttatgtgggccccgttgcttgcacggctatggtttatgtttctttcagtttggctttttctagttttttttttgactctgtgacgtgtaaaattgagtagattagctcttttgagactaatctaccagtagatgatatggtttgttttattttgggagactctgtttcgggtaagaatgccacatcggatgcagtatcctttttatgttggccgaggtaaagggatgaggctgtttgtgggaattgcctgtttgtgtggaggtttatctcaaccgtcgtcatgcttagttcaacttcgtttggctaacgaactgcttagtactccactatacgacatggaaactgttgcttcgttctgcaatctgcaccaggaaaacagcaaaaatccttcgtcgggtgttgccaacttcacaggaagtaaaacaagaacgacatgacacgaccattacaattttactagtagtactgtacacgcaaatgcaacaaaagaccgagctgttatagttctacggacacctgtgccaacaaattgggcccacatgacctccaaaaatccgtgcgcttggatttggggattccggattccccttgtcaccctcctcacactttccgccggtcttctacaaacacacgtactagtagcaataagagtagtaaacacgctctgtgcaatcatgtttccatatttcaatttcactactgctactactagtagcacggtttttatttcggttagcactgtctcctctccacgcagtcgcacacgtgtagggctcagcgcaggtatcgcgcgcgtgccgcccgtggagtcgcgccactgaacaggttgatgtgccgcgtcccgtgaagctgtatacgctttgcggcgagccgggtgccgtctctgaacgctacggttttctctcctcctggccacacgtcggagactcggaggctcattattgccgaagagtgtgcacgcgtcacggcgtcaggagcagaagccgccgcggccaagctaaggtcagaccgggttcggcctgcctccatgaacgaacggatcgatcccgcgatcgagcagccgcgcggccgccggccggcgccacacgtcaagtccagcgagccggacggcgcgtgaacgtgcttgctgccgaactagcggcgtcgtgtcaagttcattgctaaacgccgggaccgggaaggattactatagtagtactaggcatcatgaccacaccgagaattgtttgctgtgcctgtgctgtgcacgcagttccgctacaccacgcgcaacgtcgcgccgcccccgggatttttagcgacagcgacgtacgcgagattagactattagagagcgaaagaaaataaacgggaggagaaaaacaacgggtgggtttctccggtgatccggacagccgcctgcctgcatgcctgcctagttgccctcgcagggcccggtagtaacgcaagtggaacggaatcaccgcgcgcgcgttcgcgggtggtgtcgggaagtggtaagccctatccgctaatcccacctcgctcgcgctgccttatctcgtctcgtctcgccacgccagggcccaggggccccccgcgtctcgcgcagccggcctcaccctcgcgattgattctggctggctctcgcgcgcgcgagcggtggggaagggtaaaaaagaaaaatctggaggcgcgcgacgaggcgtcgccgtcgtgggcgggggaggctgtgacgattgacgaacggtggcggagcggtcgctagctagcttgccacgcaatcgcgcgtggtgatgcggcgcgcgcgtcggatcgatcgaatcgaacggcggcggcacagcgcttatgtatccggaattccggatccaccatacggcctgacggtttcgatacggctctcccgctgttttttctcttcgtttttttttatgacgggagtgtgctgggagcctgcgatttctgtctcttgccacgccattaagccacagcaatcttttctaataactcgcgtctttttccgaagtctagcttaagtaagaagcgtattcttagccaacatatggaattatggataacgcttggaagaacagaagccttgctgccgtcaaaccgaaatgggagacgagcttgggttgccaagttgtttctagaatcattgaaccagctagttcgaaataaagaacgagttcactgagtgatattatctggagtccgttggtctcaagtaagacaagctgactgcagagtatgttaaacagagcaagcaatacgaactggcaaacagagtatggctaacccggtggtgttgattagtgcattaaccaatatcaaacattatgggacgtgggtatgctaaaaaatttaaaagacccaaaacagcgatggaatcaaaaaacgaagatgtcgtaaaagacgggctcgcttggtcgattcaatggtcgtcatctccatgaccatccaaccgtgtgattggtttaaggggaactggtgaagagggaatgaaagtttgaggttatgtaggaaccagaggcggctgaacctcagaatgtagtggacggccccgctcgttcgcgggtggtattgagaagtggtaatcctatccgctaatccccccgacctcgcgctgccttatctcgtctcgcctcacgctctcaccaccacgcgcccgtgttggcgcgcgggggaagagaggcgagaaaaagaaaaatctggaggcgcgacgaggcgtcgccgtcgggcggtcgggtggcggagcgcgtggtgatgcggcgcgtcggggtcgatccgctcggcagtgcgcctgccggtttcgttacgactcccgctgtttttctccccttcgttttcccgtttttcgatccgttcctagcagcgtgccgcccctttccgttgaaagccaccgcaaacctgcgtcgttttcggaggattagcttatgttggaagcgtattctttagccaacatatggataggcttggaagaacagaagctagctgctgtcaaagctaaaacaagagagcgtcctaaggtttgccacgttgttcataaaatcgctacagctcaaaataaagaatgagttcggtgagtgacaactgcgaatccgttggtctcaagccaaacaagcggactgcagaagtgcagagtatgtcaaagtcaaacagagcctgtttagttttaaacttttcctttaagctttcaattttttcaccacatcaaaactttcctacacatacaaactttcaacttttccgtcacatcgtttcaattttacctaaacctccaattttagcgtgaactaaacacacggggagtaagaaaaaaaaccgtgaagcagagtatgttaatggcttctacatcggacggcaccaaattcagatttcccaaaaaccgtatagtttcaaaaactaataagaatatcgtacccggtaaacatgattgccataagcgaggtagaacttcatcgtttggcctaataaatcaaaacaaaagccaaaatttaaatttttaaaattaaatttaatacattttcaacttaattcttttaaacattggtttttaagtcgttacgaacaaatatataaaagtttaacctagaaattaacttttattttctaataaactattttgccttattagaaaatatgggtaagtaatgaggctcgtattcgcgtgatattgcaaactctgaccctatgccaatccaaagtaaagaggtgcatcaaactcagaggatttcctttcctcactcttgttttatgaagctctttctactaccacctggaacatttggaaggagaaaaataaacttaaatttaagatattttcaacttaatttttttaagtattggcttttaagtcgctacgaaggtgtaaattgatggaatcgagaaaagaaggtgtctcgattaatggtcgttgtctccttcatccaagcgctctacacacggggcgacgctaatgggcgatcgatccccatcccctatacgctcctctcccccttcctcctccccttcttctcttcctactacaccataatttttttaaaaaaataaaaaatataaagttggaaaaaattatgtatagaaatactataaataaaaaatatttgaatttaaattcaaatttgaaacgggtatgtaaacttttgacttataaactttgggtctataaactaatatttgaattcagattcaaattcaaatttgaatcgggtatgtaaactttgggtctataaattttaggtgtatagaaaaactatatataaaaaaatgtgaattcaaattcaaattaatatttgaattcaaattcaaatttgaatcgggtatataaacttttgacttataaaatttgggtctataaacttgaggtgtataaactttagatgtatagaaatactatatataaaaagtatttgaattcaaattcaaatttgaattgggtatataaacttttgacttataaactttgaatctctaatcattaggtgtataaactttagatgtgtaaacttaaggtgtacaaactttaggtgtataaatttactaaaataggaaagtaatgcggtgtcaaaaaagaaagccagccatatggggaggggtgatcgcccaggtaagggtgggcagaaaaagaccaaaccgaaaaaacggagaccgagaaattcggtcagtacttcggtcttatgtgctagatgaccgaattttattcggttaattcggtcatcaccctcgattaaccgaattgaccgaatttcacagaaagcccaatatcagcccaagaaagcaagtccaacattaataaaaccctagctccctctctgtttccttctcctcatccacccagccgccacacccgagcgctcctcttctttttaacgctctccccacctgagcgctcctcgttttctctcgcacatcggcgtcctgttccgtcgccggtgcctctgcacgactgcagcgtcccagcatctcctcctcctcctcctcctcctcacaagtgacaccacgacgacctcctcttcttgcgtggcttcagtggacacccaggccccaacagccaagcccgagccgcgtggaggctccaccccgggggcacatccgatggtgcctcctccactccgacggcgacgagcggtgccaaagccgatctagatgagtatatgatagtgaagaaagctgatctaggatttttatgaattttcttgatgtgtatgatttttttggatctgaaatttattgaggatttgtgcgattcttctgaatatttctaaaatttcggtctaaccgagactgagaccgaattgatcggtcttcaatatttttcaagaccgaacggtcttgcactatagatgaccaaactttcaaaaaagaccaaagacctaaaccgaatttttggtctgaccgaatgcccacccctacgcccagggcgatcgatagcccaacaggaattttgctacacacgaccattcgatcacggcccgcagccgaagtggtagaaccagcgtcccgcggcgccgctggtgggttgagccgttgagcgccattcggccgcatgatgggcaaatggtccggttaagctttggagtccatcgtaaacagccaagattggatcgctaccaatgggcttacgcgtcgtaggaggctcatgggctgaacaaacccgcgccgagaaaatgagtcggatataaagcccaaacattccgtgagatggtaagtttcggcatgtttaggcatcccaggtactacaagtttgctgtgaaaatcatacatttaactcaacctcagcagctaatggctcaagaactgatgccaccttacccatgtccacgccttccagtgttgctggcttccactttggtttctacagatctatctatatctctattgctggctttgtctgccagaatcagaaaatttaatctttttcaactagcccaatttctagtagaaaaagaaatttggctatacattcaagagcattctactgattcttttttcaaattccagacacacatagccactccgtcacaatttcggcgtcgcaatgcttttcacaataacttgtgtcattttctgaagtttagcttaggtaggagccattatcttagccaacttatggataatgcttggagtaacagaagcttagctgcagtacttttgcacaaacgcctcatctactgtgaaacaactttgttggtctcgaaccgggaaggaggctccattgctgctctcaaggcaggcaaaatttgtactgtgcaaaccagctttgtctatcttcctcagaagcagctgaagcctgaagatgaacaaaaaattcttggttacgcagcacaaagggaaggagctggcatcgaacaggcgcttgcttgttggcttgctgtggcatcgggtgcccagacatggaccatctcgaacgaagcgaacagatgccgatgccggcatcccgtgcagtgccaggggggcttgtctttcatcagagtaaaggtgcagagcagaatggaatcaaaacgaaagcttaagcttgtgctttgccactactattctctgcgcattgtcgtctctttcgttcctgcacattcttggagattggtggcagccggggatcgtggacgatcgaagcagtgacattctgcgctctccggccgctcaatcgccggcgccgggggggagatcgagcgatggagtcggtggccgtgaacgcggcgcggcgggtggtcagcaaggcgctgagcccgctgtccggagggttcgtggaggcgtgggtggccagcaaggagctcggccccaacgtcggcgccgtcaagatggagctgctgtacgcgcaggggatgctcgacaacgcccgtggcaccggcggcagggaggcccgcagccccgcgctgaggcagctgctcctggagctgcgtggcctcgcccacgacgcgtcgacgccgaggacgtgctcgacgagctcgactacttccgcatccaggacgagctcgacggcacctgcgaggccgccgacgagcacgccaagggctgcgtcgtccacaacctcttcctcaacactcgccatacagccctcagcgtcgcgagcaacctagtgctcctcccgtgcgctggtgatgatcaccctgacgctgacggtcggcggtcgggagaagacaagaaccgtcagatcggctcctcgtgtgctggtggtggtcaagtgatgaaccgtcagatcggctcgtcgccgtcgcgcactctccacgccgccgccgacgaggaggctgttgccagcaactgctgcatgcacaagctctctcccagtgctcgcggcaacacccatcacatcggtaaacactttccatgcctctcttttgcaccttaacatgacggtacggtggtgataactctagagtacaattcaattctaatttatacttccagtatgacgacctaacggtgtagattgattccttttccctatttaatgagtaaaactttttaaaacatttttttttgaaaaaaaaggcaaatatgtctctctgggtaaacaaccagattatagtgaagaaataagtagtgtggctctatcctttcccgctgatcggagttgcgtttagccgccatagtaaacctagctgcagtttttgttttgtttttttctctcttccccccttggcataagcctatatagctgattgcattgtgtaataagaactcttttccttctaatatattgacgtgcaatctttttgcgcgttcgtgaaaaaaaaatagtgaagaaataaagaacacaccctgctaaacagcccttgctcttgaccatatatacatcagctcgtcgccgtgtctagcaatgagccgtgaggctcggccaaaaggacgagcgcacggcgagcctgccagaccgccgcgaacgccaacctcttggccgggctcagccacctcgctgctcgtcaaatcgctctagcaacgttcttccctagtgcacgatgagatccagtactaaatactcctcccaattggattaaatataaactataaattgctgtaaaatccatctctaattttctaccaaattcctaacatgcccttctatatactgctaggatattgtactgtacaagttttctaactctagcgtcatgtgcacatgcaggaagccagttcctccgctgcacctgttcctgcggcagggtattgcagagggaggatacgatgaaaacaccaaagctgaagttcgatagggtggatctgtcccaaagaatgaagcgcattgtcgaacagctgaagccattgtgtgccaaagtctctaccatactcaatctagagttgttggaatcaaatcgcagcattggccagtacattgccatgagtctcaatgccgagttttccaagaaaccagggcatgcacctgttcttccaagcggttttgctatcagtcggcctatgaccacttcagagtttacagatcctacagtttatgggagaatggatgaaaaaaaatacaactattaaaaacattactcatggtgattactgtgacaaggacctgaccatcattccaattgttggtccaggggggatagggaagacaactctcgcacagtatatatacaaagaagtacataactactttgatgttaccgtctgggtttgtgtaactcccaatttcaatgtgtatagattgaaagaagacattgccaagtcgatccctcaactcaaagatgagaaaaacagtggtccgcatgatttgattgtgcaaagcttgggatcaaagtttttacttgtcttggatgatatgtggaattgtggccacgaggatgaatggaaatatctattagcatctctcaaaaaaggacaaaccaagggaaacataattctagtcaccactcattttctagcagtggtagaaatggttaaaacaattgatagtccaatacaactaaaagggcttgatcctcaagagttttgggaattattcaaagcatctgtgtttggtgatgagaaatcagcaaatgatcatgctaatttacttgagactggaaaaatgatatcaaaaaaatctgaagggttcccctttggcagcgaaaacagttgggaggttactgaaaaatcaccttgatttggaacattggacaagtgtcctggaaagtaaagaatgggaattacaaaccggtgagaatgatattatgccagcattaaagcttagctacgattatctcccttttcatctgcaacaatgttttacatattgtgctatgttccctgaagaccataaatttgctagtgatgagataattcacttatggataggactagacatcctacattcacaggatcaaaacaagaaaattgaagacattggattgagccgattgaatgatttggttagctatggattttttgaaaaacatgtagaagatgggtcttcatactacgttatgcatgacctactacatgagttagcattgaaggtttcatcgtatgaatgtcttaccatatgtagttcaaatgtcaaatctatacaaattctaccatctataagacacttatctattgtggttgatgacatggacgtaaatgatagagtgacttttgaaaacatcaagaaggatttcatcacattaagtaagagactagatgttggaaaactgcactcattgatgctatttggacaataccatggaagctttatcacccctttcagtgatttgttaagaaaagcacgtgcactccgcatagtcttgttgtctatgccatcttatgctatagtcagtatgttgcataacttttcaaaacttgtccatctacgctacttaagg

SEQ ID NO: 60853 - DNA, 13646 bp, Oryza sativa
ggggggggggggggtttgaatcctagggttagggttaggtttcgggtatatttatttaggttaggattaatctggaccgtccattcgattggacggctcaagctgctcccacgtcgggctgcctattgggccgccgaatggaggacacaaaatggacatcaacgaagaaaggaaacaggccagaaacttaggctgcgttcgagcgcaggagaaagagagaaagatagttttgttttccgcgcgcacgcttcccgaactactaaacggtgtgttttttgtaaaaaatttctataggaaagttgctttaaaaaatcatattaatccatttttgaagtttaaaataattaatgctcaattaatcatgtgctaatggctcacctcgttttacgtatctttccaatctcctcaatcccctctttctcaaacacaccctcagggcacccacaatggttatctatagactctctataaaagatccatgtaagcatatttttctacttggaagagattaaatgaagagagagagcaaagctatctactaacctgaagatagtttatagagaaaaacgaggcaatttattagagagctatagatacccatgtagacatactattgagattgtttattattaatctagtctattgctgagatgtacatgttttatagatagcaccttactttaccattgcgggtgctcttagaatagataaaagggaaggaatataaacttttctatattcggcccaaacctaaaagggaggattttgattcctttttccaattaaataattgttaaatgatgtttgtattatttaaattagcaattaagctctgaaaattccaataaaatttcaaagagtgtaactaatcatggagaatttaataaaattaaatttaaccatgtcattttatttctcacttactttacttgtaaattgatttaattatacacctacctacttaaaaataccaaatatttcagcaaatttgtattttaattaattacataatgtaaatttttcttaacttttcctcaattttttggtctgtacattttccgttgcaacgcacgagcacttttgctagtatacaatagatattaaaagtagggaaaagctggaatacggtgcccccaactgcattcacaatttcatcctgaccgccctgtcacgcacgtgagagggaaaacagaagatttcccctttcctctctactccacgtcgcctccaccgccagttgcacttctcccaccgtcggtgcaagaagatgctcgacatcaaataatactcctgttcgcgtggaggtcagcttccgaaccaccgaagaaatcgatttgtatcggtttttaaagtaaagagatacgttatacctagctttgtggttgagggatacaatttgctggtgagggatacaatttgaccggcaagagatgaggaaggcaaaatagacttactcctaacaaaaatgacaatacattgctagtacttcagtaagtcacaaatactgtaatcatgatattatttattggctcaataatcatcatttttatccttgttatttcttattgcaacataacagggaaattgaagagggtattccggtaccaataatattacatgtttgctgtgaagatcatacatttaactcagcctcagcagctaatggttcaaaaactgattccacctcacccttgtccacgtcttccagagttgctggcttccactttggattctacaaattgaaaaggaaatttagctatacgtttagtaaatatatatctatagagttcatctccaccaagtttagtaaatattatttctctcctctcttattaagacacatcacctcgattatttctagccctttgataattgatatgtggtccaaataatttccctccttttcttctcttataaagtcataccaccttagttttgtctttgatgattaatctatgttactttctttttttttttccttctctcatctagccacatcacgtaagttttgcttttgattgatcaatccatatatgatttaaattgttataaaccacaacattttaattgtttatagctttcttttttaatagtcgatcatagatgaaaattatacaaagtgtagccatcttacatgttatttcgactaatatcatacaaaactccgcagcaatgcgtggggttttatctagttctattaatcctaactctagagacataacaccattagttaaacaaaacacaccacacatgtaactatgtgcctttttatattattactaggtatatggaaaaagaacagctatgtgcctatgtctagcaaggcaaaggagagtgaactttgcaccgtgccacacatgctataatgtctgtatccctctttcccagaagtcgcacagtgcgcaagacatggttgaattctaaggtctacctctactggtttacttcttattaacaactcagagaaatgttcaaactctgtagtacgaagtgttcttcagaatttcattgacagaagtttcgatccattagtggatagctccgcgaaaagtagctcaaggcttaaatattagggagtggcaaataaacaattgattttaaacaattaagcttcttaagtttaattacaagttgaataagctggcggatgatacgccacaaaagcaactatttaatgtgacattcatagtttgtaatttgcaacccatgtgctagacatgtggccctgggacccacagacacaggaggtgtctaattatcactatggagaggcaaatgtcagaagatggatgtcctttgaattatggaaatgtgatcctaaaacatttactatacgctatggtgattataaattgtccgccaaacaatttaagtaatcggagagtaaagagatactaagtcacatggataacttgcctggtccttgtcaactaagacagcacgtacaccttcaacaaaatcatttcgaaccgatgacctcaaggcaattcgatattcaactttcataacaccagccaactgaacaaaccaaatgtcagaattagcaatgtccttgcaaaagaaaaagagaagcctgaaaataaaatagttaaccaaataaaagtattcaattgtacaggatagcagtcataccttcgatagatagtgttcattattcctatatgctgatgcaacttgagaaaaatgtttttgagttaaacatagagaaaatggagccccttttttgagtcctgccaaggcctcgttggcccattctgccactgcagacaacaatgaaaaggatacacgtgcaactagtcagtactaaactgaatttataaaacggtctcaatatagaaacactgttggcacttgtgcataaatataacaacattctcttgacgccttagcttaaaagcagagtacctgcagcatcatcactttgactacacttcttaagctcttccacagattcagcaactgatttgtcaggaccaaaggaagaaatgatatatggtaaaaacttatctagctggggccctgactctggctcgttcttgaactttgtcagcaatgactcaacatctctgtgaggatcatctgtgctgcaaaaataaaaaacacgatatcagatgtcaagacactatcaaacagaattataaccgagttttgaatgtgtcactattattctattaatgaaaaattatggaatttatacttctttaaaagaatggaatggtggaggcagtgaatctgacatcccacctactcccattgtaaattttgcaaattgccccttgaatctaaatggatagccacatataaaatcaaattaagatggatgttccctatagaaaaaggatgggtaacacatatcatggaaaatatgtttttatttattttcagtagcaaagcaggggcattcagctagtagtaattaaaagaacataatgatcttgctagcatttagtaagtttttaccaaataacagttcggaacatacaagttagcactcaagagggattccctgagaggtcccaggttcgctgaaggtacataatgagttccaagaccaaagaaaagggcatcagcaggtgatgatatccttttccctgtcatcccaaggtaagatcctgaaagaagcagaagtgagcagtgaaccgtgttattaaggcggtatggcgaagtatgccaacccagcaccgccttaccgccatagcgataagacgtatggcgtggcgacgccttaagtgcattgaaaaataagaaagtattaagtaatatgggccctaaaaatactaatggggtactccattcatcacagcccagcccaatagtagcacttacctagcctagtccaaatactttgctcttttgacctagcaaacaacattttaaccctacccaacagcttccctcccagcagccgccacctcaccttcatctagatctctctcccccattgtgcagcacggctcctctcctccacctttcttctctccttgtgcacgatgcagcaagcatacaccatcatcctatcctttctctcctctattgcagccagcagcctcctctcctccaccttttctctctcatgtggcacagcagcagcaggtggtgcctctcttgatctccctgtactccccatcagcacaagaagggagagggcgatgctagggaggaccagcagcaagacaacagacttttcccctctgctctcaccctctttccttcagtttatgcctgtaaggcggaggtagcctatggcggaaggatgccttgcccttctgggaacgtcacgatgctatagcgacgccttaataaccatggcagtgaatagaaggaaatgaaaaaggcttttacacatttggagcagcaaataatttaggagagcaaataaagacagagtttagaaccaggttacatatcttgcaaaattgaacaagaactgaataatatgcaatgtccagaactcatagctcagaactacagaacaattcctatgttgtcaagctcaaaatgagttatgatgatagattattaacaaaattagtagcggaagacatggttctacagggttactgaaacaagatagtcaagaatcttaccaacagcaccacctcctggagctttggcaccaatgtaagcaaagccaacgtccgggaacaagccaataccattttctggcatagccaggagcgtcctctgtaacagtagtgcatgcgaacattttgagccttacaattcaaatactgagaatacaaatgatgaacataaaatctaaatcagagttacagaaatttcaaacttgcctcagtaataatgcggtagcggccatgccctgataatccaattccaaatcccattgtcacaccatccatcaggcatatataaggttttgtatactcatgaatcttacaaatcaaagagtactctgctgtgaagacctgaaaacaaataaagtaccttttcagtgatgtaaattttaagaacattttggacagaggacatatcaactacatccattttcccatgcagcagagagaagggggaagggggagggggggggaggagtagaaaatgtgtgctactgcctactaggactaatcatgcctatagccctgtaaacaccatttgttgtgcaataataagatgcaaatggtgtctcagtgctcagcagcctaacctcaagtcatttgcaaaccagctaagcatgctgaatttcagttcccatggtactttaattaaaagaagaagaaactagcatggaataaggttcagaaacccctctacgactgactactaattacctaaagttggcatcaataattaaatatgccaccagagtcatattttagattatttatgtacaaatcagctggttatgaatcatatagaagttgttctgcatagtgtgggggaaacattaagtaatttacaaaaataacaatccatttttttttcaaatgagtcgaaatatgttttgcacaagtgcatgtatacatacatgatagatgtattatgtgaattaggcatggttaatccaaagcaggttattggtcacaagtcataaccagttattttcaaacaagtgcatgcatcaaggagcacaccaaacacagcttgtagtttgcagcagatagaagtgattgtaactgtgttggaaaatgatagtgcttcaaagtgagttggtggcggatcagatggtgttagaaaagaaaaggatacaacagactacgatggattaaacaactgaagtctttcaactgtatgtgcattgcacaacttgagaagaataaataataaatgtcagttactaaacccacagatcagttccttctttctttttatttttatgtgtaatatgaacgcaccaataatatgttttgacaacataatcaaaacccaccaataatatgtgaaaacaatgccagaatttttagatcctcatgtctcagtaggagcaggaggatgtacttgtatttttggatattgcagaatcatcagttaaatttaattatgtgttaaatctcaattattgtttagatgtatcaactacaatattaaactgcaaatcaaaattttcagaaaactatttcaatattgcatgactttcagttcgttatgaacttcatatacaaaaaacctattcagctctcctctcaaattatgattgcaatatcaattccgatatcttatatacactttttcagatacaaagagggcattataatttttagaaaatcagagcaaaatagccgcaatcaacaaaaggttttccatcatgcgatggaaactatctccaggaaagcattaatcatgctattactagacctctattatctctggcattgtgcaatcattagcaagtctcttcacatccccacctgcagtttacactaaacaatatcactatctgagcaaagcaacgattgttaacaacaccgttatactgtcacataaactgttgaacaacaaatagaaaagaaatatgagctttaaaagtaaaatcagatcaaaaacacacatgacaaaggtaaaaaccttttgcacaagtggtgtgctcttgtccttttgaatttctgctgcaacacccttaatatccatccctgcattggtcatgaatcttatttgcaaacatctccaatgctccggaaataaaaaggcgcaaaacagcatgttcaatgtacaaggcccagctttttcaacgaataaaaacagagaggtgatcaccagctgagaaggcacggggtgaactgctttccacaagaacacacttgacacttggatttgtttcccattcatcaagaaatgccttgtatcgaaggtccatttctgcaatcatatgagaccttaaatatgtgagtgaacctcagaaagctaccaatgtactcgatacacagttggtgtgcatcatttcttcagaaggttagtgtcacttatatacaaaatcaagaagggaattgttgagtaaaaaacaagggatgcttgttaaaaataaataaatatgtaatctacttttctgcaagtgaagaggacataactatcaataccataaatttatggtgtatctattagtgtctacatgacagcgctagaattgtacggagtacatgaaacccatgtaagtgcagtaagctttgcaaattcccagctccaaatgtgggtctagggctctatgctactaacggaacgcatgaaatctgtaactgagtgtcaattttcaaaacctcaaactaaaacaatcaactggatgaaatatttaacatgcattttgactagagtgccaactgtaccaaacttcacttagctgcatgccattgagcagcaaattattttgattgctttcccatcaccactttgagctcacaaaccggactaaaaagccgcacagcatccagttaaccactaacactgtacagacatgttcaccgcacgagcaacactgattttaattcattattcgcaaccttccaaactagtgggaacgccacaaatcgtggagacctccgccgcccggcccggtcgccctactcccagtaacccaaataggaggaggaagagagagagagagagagagagagagagagagagagagagagaggagcgaccctcaccgaggttcatggcgttgagggccttggggcggtcgagggtgatgacggcgacgccgttgggggtgacgcggcccttcacgaactcctccgcggcggcggcggccatggcggcgaagcggcggaaggtgagggtcggggctagggttttggaggcggatgcggcggtggaggaggggcactggaggaaggaagtggtggagatcgatccggggccgggcgggtggatgcgggagaggagagctcgcatagtgacgtgagagcaacccatgtggagaggaagaagccgagagcgagagggggggggggggggggattaatgtgatgaaattgactattgagaattggagggggtgtgttgttggagtacatttttttcccccaaaaaatgcgctgaactcgcgactcgcgaggaactgatgctaaaagtcagggaaaagtctaactgtcaattttcaaaaacgaaccttccgtctgacctgtttcactacatcgctaagatttgatttaaaaaaaaagaaatataattaaaattcataatgcccaaaatacccttgaggaaaccatacccatctttaaccctatccacatgtctctccatgtctctctcctgccagtgagttgcggcggcggcgatgtgtgcagcggggagggaggtggaggttggcgcgcgaagcagggagggaggcggaggttggcgcgcgaagaagggagggaggggcggcgcgacggcagctggcgccggagggaacgcggaggaataaaggaggcgacgtcagaagaagaagagagaagagagaactgacgggtgggtcccacatgtaatagggtcaaatgactaagggtaaaatggaccttttgtgcttcagttaacaccgttagaagcctttaacagaatagggtcataccgtatcttcaattttaaaaagaagggtcaaataagcaaagttgaaaaaagaggatcaaattagtagttagctttcaaaagagggtcaaatgcgcaattgcccctaaaagttagtactaatattataaattatttgacttttttaagtcaaactttgttaaatttgattaaatttgtagaaaaatttaacaacatataaaatattaaattggtttaattaaatcttacattaaatatattttgataatatgtttgttttgtgttgaaaatactgctatatttttccataaacttataatatgaaatgaaggggtactggtttaccgctaatgctaaaagggagcaggtcctaagcgtcatccacaatgcaatgataattaggccattcatagtacagatcctctacttacaggtcactaatatgtggatccgctggtagagggtccatatgtcagtgacacaagttagaggatctcaatccttgcagtgaggtggcgtttggtctaaatacgccactttcgagattcccttccacgtaagcagatgttgttcatagtgagtccctcgtcctcctgttaggatttggtggccttgttagagaaaagtagaaagacgtccagcgaagcagaaaacatgagagagatgttgccatcgcggagctcccatctctgccaccctgcttcgccggtttgccgttgatcttgcctagccaaaggtgcctccggcagggagtgccctcaataactagatctcgcccgatccacctttgagaggttgctgccttgatctaaattgggaggacctcgtcaacacggtgccgcttggcatcctcgctaccgccataatgtggagagaggggagaggaggaggcaccaccttgatccgcactggctaccccgatgtgcgaactgtcatgagtttgtcggccgcaccgccacaaggctatccacctcgctctgccgggccgagcgcaaatgctaacattgtcgacctgcgctgccccgtctactcattgctccatctgctccattaggaagaagggggatggttgaggcaagaaggagtggcaaaaagggcatcgacaagagaccgctgtcctaatctgtgagttgttaggagcttattgggagagggaggtgaggaggttgtcggcatcatcgggcagccgggcaggagggatagtggaaggagatgggattccattgttctgtatcacaaacaggtggggcagcagagaacatctttgatatatttttgtttagaaaaaggtcctttatgtaaagatctaactagaaaaaaaattaatatataacaagggttgaaacaaaatatgcatgggcttaaatgacaaaattgcatgggccaatggaaacacggtgcaccgtcgagatgtgtggttctatttactttcttattatgtagaagttgagtatccagttaggtgtagactacaatgtgagtactcttatctagtggtctcatgttgccagctcggagattctaatccagatcagcactgcgtgccccacgagagcgctcgtgccttgcaggggcacggatgccttgacagccgtgcaggtctcctcctctattgtgcacgtttctttcgcgagatagctagagagagaagttgcggccgaaaagggaaaagaaaatggccggagaggacagagacaggtctagaacaacctttaaacttatcaaaatgaccttaccaccgtcaccgtcaccgggtgttgagctcgctagttggagctgtctagttccttttacgcggatctggaagtatacgacgcatatctagtatttaaacggtggcgatactgatgcaacacctacacagtggtgctcaatgattggatgaggcaacgccaacaacaatgatgcgtggaaggtcggagacggtggccctcgcctatgttcaaccttctcattgaccgcgcggtgcactaggcgagacccagcatcaactccaccaatcgccttcaactgccattgccattgtcgctgggttttaggtaggagataagcaccatggggaggggagaggagaccgatggcggtggaaagggaataggataggtgccagtcggagcccaaaggggatggggggacgggggaggggggaaggggcacgggagagctaataacctagagatggggtgctatgtgcaagcgtgctatattcaagcgcatgccccctattgcttgcctagctgcttaccaatagtacaagcgtgctacatgttagcttatgataagtgttgactgtcaaaagcctagagacaaggacaccgaccctttataattgactaaatggtaagatttgtttgaattaaagaccgtgttttttcatcccatcccagggcaccaaaacctaatggttgttctatactcaacttgtccaaacattcagcacatgtctctcctcacattacattagtgcttgagttgtttaactaggcaagaagcttaatagccgagtaggcagacgtatgaagagaagatcggtccaatgtataatactctagacttattttagtcatcgtaggtaaatttagtaattagtagcgaggggaaaagtctaaagtacttctcgttaagaatagaaaattacgtagtaggagtatcagtgtattaccacgtgataggtaagtgatattgaaagtataagacttctcgattttgttgacgtagttaagagggtagaaattaattaacttatttttattaattttgaatgctaaaaattatgttactaatgtacaatttaagattattttaattttgtcactaacttcacgagtgtattcccgcctaactaccgcatatccatttgtggtgttcattgatcttatagccaaaaccaatcattagacgagacttgatagctccattgcatccaatctcacttttggaaaacggtagttggaacctgatagcttcatctgccaatcaaggcccccccgtacgttcgtttggtcaaaaagagatacatgttttccttactagaaaaaaatgtttgtacgttgcaacgggtaaaaatattttttatcctacgcactatgctccctttaatgcccatgcgttttggaccaaacgaacgcacattccttctgtccttttcagctctagtcctagtacagtccgctatctctctctgctcggtctacctctctttggctcagtccataaatggagttgtaggcccaagtcgaacagtattatgtccgtaccattacaaagccgatcctcccatcaaatccggtaatccgctcgagctcccatagtcttataccatgacggagccgatcctcccatcaaatacggtaatccgctcgagctcgcatagttccgtacccatacgatgactaacgaagccgatcctctccatcaaatccggtcgaatctttctccatatccaaaattattgagggatttttatccacttgatcttccttttccttttttttaccaaaattaaagcaatcagcaaaacttgggataaaaaatgacgacgattaaatggttcatcaaaatcgaagcaatctgcaaaacttgagataaaaaataactatgattaaatggagattcaatctgatgaattaaagctgaatcaaaaggggaattcatggggaaaataatgagagagtagtggggaatcaattattgcaacgaataggaggaggaagcatatggggagtaaaatcaacgtggcggcggcgctgggtttggcccgataaaaaaaccgcaaaaaaatatagcgataaaagaaataaacagaaaaattggtgaaagaaaatacgcaaagaggggaaaaagaaaacggacaaagaaaacaggaaaaaaggtgaaagaaaaaaaaagaaacgggaaaagaaaataaaaggaaaaaaacaggaaaaaaaaagaaaacgaacaaaatgtagttttcttttattttcgccactttcttatggggaatcagacttttttattttaggtttttttttctatttttttatttagacggacgaaggaaacatctcttaaaatttttaagtagtaatagatacaagataatgtaattttttttattgaacttgatgattacaccaaggtaatatagaccggtggagaactcatttttattcccggttaaaaacccccactagttccggttataacaccgtgaccaacaaatcgagactaaagatctcgatcttcaagtatcgactgaaataaccggtactaaatttgcatatcaagttaaaaaaaatatgtgggatgtgagagattcgaactcaagatctctcacctcatcctacgttaccgtccctcctactacacacatctaacttggatagatattaactaaccctgtagacatcttaccggtattaaaaatatctttagtacaccaaccgagactaaagagctaccaaccgagactaaagagctagagagctctttagtcttggttagtgttaccaactggtgctaaagatgcatttttagtactagttggtaacaccaactaggactaaaaaagtttccatgaagttaaatttttagaaccgatactaaagcatatttagtaccggttcctaatctaatcaagatatttgtgattttgggtaccacaataaaagattaattctctagta

SEQ ID NO: 60854 - DNA, 3715 bp, Oryza sativa
aattcctgcagccgtgcttctccttcctcaacgcgacgacctctgaccgcaaccgtcatagctcgtcgcaccggtggagctcctccacggccgcccgcttcttccccgcatcgtttctcgcgatgatggtgtctttcgtctactcgacagcacacttgaacggcggttcttggccgcggccagctcgtgctcttcgccgagcggcatggaggaggggatagagagagaagagagataggagagctgatatgtgggctgaagggcatttttgacatttcacgcgatttatctctcatcttcgaccggaaattattattttaatgagtaggatgtccaccagtaaatatttaacttttgagagtgtcttccctaaaagtcacttcgtgcggtgtcctacagctaaaaccgcgaagtcacgatgtcctgtagtaaaatttccctaacaactatcaatcgtaatattagatcaccacacatgtccctgttaaaacactcttgaccacatgctccaaacatagatatgccggcaataatcaaatcctgcaaggtgcaagctgggtttctatagtataacccaagtgcgtagccaatggatagttaaatagatagcctgcatgggagaaaaaaaatttctatcaaaaaaacatatcactccaacataacttaagcaaccagcatataacttaggtggtgtttggttggagggactaaagtggggctaaactttagtccctctcacaaaaatataagtccctatacttttgtgagagggactaaatttagtccctagttcccaaacacccccttaagcaaccagcatatagcagtcgcccctaacaagatatatatggttgcagatcttcttgaacaccccaaatccaactagtgaatttgcgtgaaatactaccagatggaataattccttactccacactaaatgggctaagtggcattcaaagaaaaagggtttaattgtcttcttcttcttgtgaataacaataattttaattgccttgtcaattatgtttacataaattatctttggttaacacaactccgcgacgaatgtatcaatggaaaattttaaccttcaaaggcacttttagttttcagagatttgggatgtcactatggacttcacattcaaccgtccattaagggttaagttccatataaactaatattgctcctgaattaaatcaatattagtgatgtgtgataataaattattccatgccagtaattttgatctagttagatctgttctctaaaacatctgcaatagttacctatttatacctaacaacactgtagaggaaagtgtactgttctcgtagggttacatctcccaatcatttgtctttccataatctaatttaatttagtaaccattcttaattatgtaggatccaagacaaaagagatctcatttcatcttcattaggctgtctccggccttctactgaacttgcgtgagcggctgtgaactcaaatacttattttgtattagctgtttccaaacatcatctacagtaagcaactgaaatagccacttactgagtaatactgaatttctaaaccaccttatctttaaggcggcatagtatgtctcacttggcttttttttttaccatcactctaacaacaaaaaccagagcaaaaatagtagattttttttaaaaaaattcctctcgctactgtgaagtacttcattcatgaaaaaaaaactcaatctaaatgggatgtgacatactccatccgtttcacaatgtaagtcattctagtatttcccacattcatatttatgttaatgaatatatatatatatatatatatatatatatatatatatatatatatatatatatatatatatatatatattcatatacatgaatacaaatatgggaaatactagaatgacttacattatgaaacaaaagaaagaatatagtataacaaatctggatacctttatatctaaatccattataccaagttggtcgtgtcacatcccccaattagattgggtcttgttttaagacgtgaataaacactaagttaattagtgtgagccctccttcaatagatagaaattttcctttccaactatggaagagatgcatatgcgtgtccaaacaccaaataatagtacattagcccgggagcaagccattggagcatactccctccgtccaaaaaaaaccaacctagaaagagtttgtttagattcgttgtactagaaagggatcctttaaggttgtcttaaaaatacccaacctaaaaaagatttgtccagattcgttgtgctaaaagagaaccctattagacttgtttttttttatggagggagtacgagactaactacaaaattttcagtctagacaatgaccaagcgggggggacatatgtcgctggactcaaactccacgacggaactggcaaacagacgacaagatctcgaccgaatctgatcgacactgggtaaggtcaggaagaacagtcttactcgtcttttttctaatccaacttaagctcagtgatgacgccaactaatctggaccgtgtttagttgtttaggtgtaaaaattttaaagtacacgggcacacatttaaagtataaaacatagactaataataaaacaaattacatattccgacggtaaactgcgagacgaatttattaagcctaattaattcattattggcaaatgtttaccatagcaccacattatcaaatcatgacgcaattatgcttaaaagattcgtctcacaatttacatgcaaactgtgtaattggtttttttcgtctatatttaatgctctatatatatatatatgcccaaacatttaatgtggtggaatttttaaaagtttaaaggtaactaaaagcaacgctggttgagttcgtggatgcgacactgccatctcgaactcttgtgcactcctctcgctcgccacacgaaacgccacaccactaacagataaaaaatagctggccaattgccacccattttgcctatgcgccatagctgagctgagctagagctctcactacagctagctaaccgagagccacacgtcggtgactcgtgacctgtggagccatgtcgccgacgccgaggccgcacttcctcgtgctcacgttcccgctccagggccacatcgcgccggcgctccgcctcgccaggcgcctgctcgccgccgcccccgacgcgctcgtcaccttctccaccgccgccgccgcgcaccgccgcatgttcgccgagggggagggcggcgacggcgacggcaggctcgagctcctcccgttctccgacggcaccgagaacgggttcgtcaagcgcggcgacgccgcggagctcggcgcgtacatggcgtcgttccacgcctcgggccggcgcagcgtcggggagatggtcgacgcgctcgcggcgcgggggcgccccgtgtcgagcgtcgtctacacgctcctcctgccgtgggcggccgacgtcgcgcgcgaccgcggcgtgccgtccgcgctctactggatccagcccgtcgccgtgctggccatctactgccactacttccacggcctcggcggcgtcgtcgacgagcaccgccgcgaccattcgttcgtcctggagttcccgggccttccgccgatggcggccggggacctcccgtccttcctcaccgaagccaccgacccctgcgactacttccacag

SEQ ID NO: 60855 - DNA, 1625 bp, Oryza sativa
ccatggcctcgaggagagcgggaggccgtacctctgcgtggtgcggaaggacaacaaggccgccgtggcggagacgggcgacgcgacggcggcggcggcggcgcgcaggaacggcgtggtggtggagtggtgcgaccaggtgcgcgtgctgtcgcacgcggcggtggggtgcttcgtcacgcactgcggctggaactcggtgctggagagcatcgcgtcgggcgtgcccatggtgggcgtcccgcggatgtcggaccagcagatgaacgcgcggctcgtcgagcgcgactggcgcgtcggcgtgcgcgcggaggtggacggcggcgacggcgtgctgcgcgcggcggagctgaggcggcgggtcgaggaggtgatgggagacggggaggcggcggaggtgcggcgctcggcggcggcgtggaagcgagcggtggcggaggctctagggaaaggagggtcgtcggatcgtaatctgacggccttcgtggagggtgccagaagtgtcatttgaaaacgacataatttgaaaacgttataagatgtattttaatttgaaaacgatttggggatcctagggtcttcccttgttggtttggctgtttgttcacttgtatgtacaacctctactgaactactccctccgtcctatgatataagggattttgagtttttgcttgcacggtttgactactcgtcttattcaaaaaaatttggaattattatttacttttttgtgacttactccctccgtcccaaaaaaaaggtaaaccctggattttcgtatccaactttgactgtccgtcttatatgaaatttttttataattcgtatttttattgttgttagatgataaaacatgattaatattttatacgtgacttgtctttttaatttttttcataattttttcaaataaaacggacggttaaacgttgggcacggaaactagggtttgtctttttttggacggagggagtactttattatctaaagtactttacgcacaacttttcgttttttatatttgcataattttttttaataagacgagtggtcaaacactacaagtaaaaactcaaaatcccttatattattggacggagggagtagctgccaactgggctctcattttttatgggcttttgctatattgttgggccaaattattaccaccgaactgaactacctgttgggtaagggaacatgggctttctctggtgtactttctactttggggtcccgtgggtaatataccatccctgccctcgcacccagaaatgaccagggcccccacccgcttcccctgcgggttagaattcccacccgtccctgtaggggcgggtactcaccgggtccccaaccccaaccccacgggagaaattaccacccatatatccaatcgttcgtaggctcgtagcatgtttgttctgcacaacccagatatctaattgatgacagtttgctatagttttactagctaggctatttggtgagaagccgacaagtgaacggtgcctacacattcgtagcccaataccctacctatgtactcaaccaagttcttctttagtccatggccatgtttggatccggagggctattaaatagccctccggaatcttgct

SEQ ID NO: 60856 - DNA, 3015 bp, Oryza sativa
gtagcatctctgtagcgaatcatggattagtatacatcattagattcgtctcgcaaaatagcctaggggttatggaatgggttttgtcagtaatctacgtttaataatcctaaatagcaagattccggagggatatttaatagcccggaggatccaaacaaggcccatgtatacaatcactcctattccttcttcagtccgtatcctatcgctcgtaggcttctaggtggcagcagaggtgcggcgtagggcggcgacatggaagcgagcggtcgaggcggctttagggaattgaggctcgtcggtaggggtgtgtcagggttacgggttaggtataccctttaccctttgatatatgtcacatatcggtatggcatgcccacgcgcatacggatactctctacatacactaaggaaatccttcacagagtttacggacgaaaagagtcctactcggacaagactgggtcgtcaatgtatcgtgtagggtttgatgtctccgagttctacttggaaaccgcctgacctgcgatataaaagggaccccccagggaggacctaaggcatcaaatctcaaagccaacacaacccccacagatctagtcgaaccaactcgactacgatcttgtcggatccatcgaattccattgttccctttgtaacctgtgttttccatcatataatcccacgtcaactggattagggctattacctatcaaggggcctgaaccagtataatcttcgtcttttgtttgcttgatgtcgtattacgtggacccttgtaacaacgtactccaataccctctatatccggtctatgggtatcacccgtcgatagtggcgcgccaggtaggggcacttggtgctcaaggttctactactatgtcatccagcttcgtcgacaacagcgtcaacaccaacctcaaccaagtattccctgcttcaacaatgctggtgtagactcaagtcggcaaaatcgtcttcccggtttacaccacgatgccgatctcagccggtccatcagtgaccggaaacgagaacgcagtggatacaaaccaagacgactccatgtcgaaaaatcctcccgccgaggcagagaacggaacatgaacgacatctgagctcgagaaggattccaaggcgaccaaagcttgtcactccgacaagaaccacgagccgacgaggatgacttccaaagcgacaaggtcctggtgtcctatccacaaaaccaggaaacacactttgcaagcctgctgggtttttctcaacgtccgcgctgaaattcgctcctgcaaagagcgtggaattcagcgtatttctccaactcgtgatgtctattctcctattcacaagacaaagaatcacgacctctcaagctgcaaggtctttctcagcgccatgaaggcgccatctcctaaggtccaacagtcacacatcctcatcagggataaagacaaggaatgaggagcgacgccaacttcggatcgatttgttggggtaatcgacatcgatccccacgaaccatcagtcttgcacctcctcgaagactatggatcatcgacaacgagcgtgccacgggagatattggctattgatgatgtcggcacgtcacagcgcaccaatgcagaagcggagaatcaagtagccactccggcccaacacatcagagccgtcaacgctatactgagggaaaccccctacgatcccgttctgaacgatgatctcgcgcgttggacagaacgactacgggaatcagtgaccaacctcagcaacgcgttcgaagaggccgctgccgcagcgcacccagagcagccaccaactggcgatgccaatggtgaaaaccctgaacggagggaatcgcctcaacgagccacccctccacctcgcggcaccggcgatctccgtgatcacctcaacggcagccgagaggcacgacgcacacaagacaacgagaaccgttcccggcgtcatgtctcttcacggcgtcatgataacaaagatcgaggagaccgttcaaacgaagactgagaccgtgataaccgccacgatcacaacgatcgcgaacagcgggtgccaggcgatactggtcgaggacgtcgccataatgacgacgatgatggagaccggcgccgagacaacagcgggagacggcgacaggattctcgagagccaggccgacaacctcgtaatcgtacactggaaccaagcgacccatcgtcatcgtcattatcctcgtcttcctcatcatcagatagacatccatgaaggacacacgatcgccgataacccaccgcccccagcgctgggtgtagagctttcagtcgttccctgcatgatgtccgatggcctgagagattccgacctggagcaatagagaagtacgatgggagcaccgacccagaagagttccttcaagtctactccacagtactctacgttgccggagcagacgacaatgcattagcaaattatttgccaaccgcgttaaatggctctgcacgttcatggctgatgcatctcccgccctactcgatctcttcgtgggcagacctgtggcagcagttcgtcgccaacttctaaggaacctacaagcgccacgcgatcgaagacgacctacacgcgttaacacagaactcgagtgaatccttgagggaatatgttcggcgcttcaacgagtgcagaaatacaatccccgaaatcaccgacacttctataattcgcgccttcaagtcctgcgtcagagatcgctatactactcaggagttggcaacaagacgcatcacaactactcagagattgttcgaaattgttgagcgatgcgcccacgcagatgatgcgctaagacgcaagaacgataagccgaagaccgggggagagaagaaactagccacggacgcacctgagtcaagcaagaagaaaaatcgcaaaaatgggaaaaggaaagctcaagcggaagtcctcgcagcagaatacgcgaaccctcccaagcgcccagacccacagggctgcaggaat

SEQ ID NO: 60857 - DNA, 3335 bp, Oryza sativa
  unsure (1)..(3335): unsure at all n locations
aaaagtcgctcgagaagcacattgcatttgaaaaaggcaagcgagtacgcgtggtcgaaaaggatgcggaagcggctcccaaggagtcggactcagcatatccagactctgacctccacgtttcacacatcttcggaggttccacaacgtactcctcaaagcgagaatacaagaaagtggaacgtgaagtctgttcgacatggcagggggctgcacccaagatgaagtggtctgaacagaagatagaattctcggaagaagaccaccccaagactgccgtcatcccaggacgatatccgatcgtggtcgaacccactattcggaacatcaaggtcacgcgggttctcatcgatggtggcagctcaatcaaccttcttttcgccggcactttggacgcgatgggaattccgcaaagcgaattgacaccaaccgattaaccctttcatggaattactccccagtcatcgtccaaaccattgggcaagattacgttgcctgtgactttcggccaagctaacaacttccgaatagagcagatcacctttgatgtcgctgaattcgatacagcttataacgccatcattgggagaactgcacttgcgaagtttatggccgcatctcactacgcgtatcaagtgctcaagatgccgggaccgaagggaataatcactatttaagggaatgcaaagctggcggtgcaatgcgacaaacggagcctcgacatggtcgagcaaacgcccagcccacccgccacgaccaagccacccaagaaagtgagcaagacaaacaagacgccgaaaccggacggcgcaatcaagatcgttccactctccagtgccaatcccgacaagaccgtcaagatcggggtgacactaagcgagaaataggaactcgcgctcatcaccttcctccgcgacaatgctgacgtgttcgcttggcagccgtccgacatgctgggggtccccagggaggtgattgagcacaaactcatcgtgcgacccgatgccaagccagtaaagcaaagactgcggagatttgcaccagaccgaaaacaagccatacgagaagagctcgacaaacttctcaagcctggcttcatcagagaagtactacatccagagtggctagccaatccagtcatggtgcgaaaggccaacgggaaatggagaatgtgcgtcgacttcaccgacctcaacaaggcatgtcccaaggatcacttccctcttcctcgaatagatcagctggtggactcaacagccggctgtgagctgttgagctttctcgacgcttactttggctaccaccaaatcagcatggcaaaagaagacaaagagaagacaacattcatcatgccattcggggtattttgctatgttaagatgccattcggactgataaccgcagggaatactttccagcgcacggttcagggcgcacttagcgaccagctcggcaacaatgtcgaggcatacgtcgacgacatcgttgtcaagaccaagacaagcgactcattgattgacgatctgcaggaaacgttcaacaacctccgacgatatcgcctcatgctcaatctagagaagtgcacgttcggagtaccatcgggcaagctgctcggattccttgtctccggcagaggaatagaagcaaatcccgagaagatcaaggcaatcgagaacatgaagtcgcccacaagactcaaggaaatacaaaagctaaccggatgcatggcagcactgaacaggttcgtcgctaggatgggagaacgagggcaacccttcttcgctctgctgaagaaacaagacaaatttgtatggacacaggaagccgaagaggcattcattgcactcaagcgctacctatcaaacccccctgtacttgttgctccccaacctaatgatgaattattcctctatattgccgccacgccatattccgttagcaccgtcattgttgtcgagagagagaaagtacaacgaccagtctattacgtcagcgaagctctccacgacgcaaagacaagatatccacagatccaaaagctgctttacgtggtcatcatgacatcaaggaagctacgccactactttcaagcccacagagtcacagttggctcctccttcccgctcggtgaagttgtgagaaacaaaaacgttgtcggccgcattgcgaaatgggtagtcgagctgagccagtttgatgtccactttataccacgaacagccatcaagtcccaggtactcgccgacttcgtagccgattggactatgcctgatgacaaatcagacaaccaagtcgacaacgaaacgtggacaatggcgttcaatggtgcactcaacagccaaggagcaggggcagggtttatcttgacgtctccttccggagatcaattcaagcacgcaatccacctcaacttcagggcgaccaataacacagccgaatacgagggattactcgccgggataagagctgcagccgcacttggggtcaaacgactaatcgtaaaaggagactccgagctagtcgtgaatcaggtgcacaaagattataaatgctctaaccccgagttatccaagtatctcgcagaagtcaggaaactagagaaaaggttcgatgggatcaaggttcgacacgtttaccgcaaggacaacatcgagccagatgacctagcatgacgtgcgcctagacgagaactgctcgagcccgacacttttctggacatcctgacgaagccatcagtaaaagaggttagcggcgaagttagcccggccgccccagacattggcgcggaggccacaaaggcagaacgcgccgttgccgatatcgagatcacagatgactggcacatcccacttatgaaattcatcaacagcgaggagttgcccgaggacgatacagaggccgagaaaataacccgtaaagcaaaaatctaaagtgtggtcagcaacgatctatacaaaaaagcgccaaacggggtacttctcaaatgcgtctcgtccgacgacggcagacacctcttccttgatatacatgaaggcatctatgggtcacatgccgccggtcggacattggtcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60858 - DNA, 1148 bp, Oryza sativa
atatcttcttgttctttaatgtattcttgggaagcattattgcaggatctgctttagagcagctcaaaacatttcttcaccaatcagcaaatgagtatgtcctctttgtctaccccacaagctgcaccttcaatccattatcctgtatgcttgcaatttatatatgtcctgataccacaatttaatttaattttacaagccatcctatctctctgattgagctcaactaaaccatagaacatcaccaaccatagatagaagtgtacaataaattatgtcaatgtgttgatatttttttcctttgttttgttcatagaggtagttgacaaaacaaaaaaatattgactatgccaaactgatagttgcattcttttgctagttacaatatagatgtgtctcaagccttaaaagttttgcacgacatgagacagcaggcaattctattggctgttacctatgacatagatggcagttgcaatttatttacatgagccagctgtagttaaagaagagagtgagggagggagtagcaccaaccattctagagcgcatatacatgggtgttttttgttcattcagaactaaacatgaaccgtgaaaaaagtggcacgaaggtgcacattcatcatatcatttactaataaggaaacttgctttgtcactgacgtttgcctattgtttttacattgctctgctgccctgcctttcatgctcttcatttgtgctacaatttcctattgtatttcctttctttttcgaagaaactcttatactccttttcaactgtacttatttgcctctttgcagaataccaaggacaattggtgaagcaattccaatgaaagcaaccttttttataacatatgtaatggttgatggttgggctggggtagctggtgaaattttaagattgaaaccattgataatcttccacttgaaaaactttttcttggtcaagactgagaaagacagagaagaagcaatggaccctggaagcattggttttgactcaaatgagcctcaaatacagctctatttcttgctcggacttgtctatgctgtggtgacaccatttttgcttcctttcatattaatattctttgggttagcatatgtggtataccgtcaccaggtaataaccctttgga

SEQ ID NO: 60859 - DNA, 712 bp, Oryza sativa
ttcctgcagccctccttggtgacaatgctagcgaccaagtagcctccttcactccttcagcataggcgctggctagtcctcatttcatccccccttttctatttacccaccattgcaccatggaggcgttggcatccattcccctccccatccttgattttgttgttgtcaccgttgaggagcaaggaggtgaacaccaaacgaatgagtgttggagaccaacgatggttggtagtggtcagggtctaggcagtaagcaaggggatgcggcagaatgaggagccagcaagggtgaggtcaaggtcgaggcctaggcaatgatcaatggggctcttcagctcaatttgtttgccttgcttccccgttgtggccttctcccacaagtggttggggatccatggtgaggagggaatcatccaagtcaacaacgcggtcattgctagttaagttgcaactcttttttagctctgtcggccccttgaatctccctctttggcaccatgtccagcctcgcctctcatctacctccaccctccttgtcgccaccagacaccgctttctttcctcccctactcgcttccctcgtccacctcacccctccttcctcggtgttggtagtggcctcctgagcacgatgaggaacacatcagtagccaccttccgatccaactcagcactctacctccatagtagaaccacatcatctctcttt

SEQ ID NO: 60860 - DNA, 6728 bp, Oryza sativa
  unsure (1)..(6728): unsure at all n locations
ggcatgcaagcttgtttatggggataatcactagtggcttgaaacggattaggtcattagggtattagaagggagaggtagacattgattgctatgagagaactagttgacacatagcaaatagaggcatgaagtatatttcttgattagctaatggtgattacatgctatccatttttgtaagggtgactcaactttgatcccaaggaaacaaacttgaacttattattccatttaactactgccagccataacattagcttctatgcgcactggcccagcggggccatgtccacaacttttatacacttcagtctttaaataggttctcttggagtttatgcccattcctaagcagcttacacatgttccatgaataaacacatgggtataattgtgttcttgtactgatggctctgaaatatgcaataaatgtaaagagttgatatatctgcaattgcatgtagcatcactttgcacaagatggcaaaagtttatatttcacattactcagaagtaagaagttaatttgtttttctcattactctagagtgacatggcatcataaccttaaggtttggatgaaaacgatacttctcgacacgatataatcagtttatacatagacaaattagactggcatgatacaaagagcagtacagaaaaaaaaatttcatatgcacgcagtattgaagcagagaagccaacatagctctaatgctctataaaccaacaatatttggcattaactgccttgtcagtattactgccaaaagtgcagttacaaaaaaaggaattgatcataacagattttcgataaaacagagtagagccacaagtgaatgaaaggatgtatcataaattgaatttacctcaaatataatagaaaaaaaatcacttacatgatggaagatataacaaatacattcaggcataaagcgaacattagaagcttcaccccagatcagcaaatacaaccctatgtaaagaatctcaggttgttgtgtggaggcatcgtttggaattctgcaatgtcaatattctcagttgacaaggttgcagattttgagcaccagatgtgcaatgatcattagtggtacttactttatgtttgactccaaatgtaaatatcggcaccaagaaatgtagttttcaaagattttcctcatcaaggatctaactgtatcactatgcatctgcgagccatactagaagttcatgaatcagtttaatattcttacatttatgcggactgagaatgatgtgtgaaaaggcaacaagctcactcaagattagtgatattaaatgaagcttcaaagagaatgtttaccacatgattgtgtctgtcactttggtaggcattagccccttttctcatatcaatatttgcaagcagcaaaatcaaatgctccttctgattctcaacattgcctttctgtaacaacaaatcaaagcatgtatcaaatactaaacaaacagggtaggtgttcaaagataaacagtggtgtctagccatccaactcaaagccaccacaattattgtatctacagcatgttagagacaaaaaatatatttcccatgagtgcagcaatgataggtacaaactatttagttaacactgccatgtaattaacagatgtttggtgcattgcataaagaatttacatgaaggaatttactttaaatatgatattaacatcatcaatgaacatggttcaggaataaccaaaattgtaagtcttgcaagaattattatatgatgtgaccgcaccgtgtatgttttcatttccatatcattaaaacttctgagttacataaccaatgaagtactcaatatttatacttcacaaattgatatcaataactggtttagagaaaaaaaagttctataaaatggaaatagttcagaaaaaacgaatggagaatcagaaggttccagagcacgcagtcgtgcaaactaaacttagttccatacccaatgaagtactgaaacttttatactttgcaagttgatatgcataatttgtttaaatagaaaagttctaaaaaaggaaatagttcaatgcaataaacttttggatcatgcaatcatgcaaacttttggattaagttaagtaattgagtacgattgaagaaagtgaaaaaaaggcattagtttattttgcacctgaaatccaaatgtcagccagagccaatcaaacaaatcacggacagtaggtacatctgtctctttttcagcagaaactggatcaagccttggcatcgggaggccgtctatcttgcgaagaaggtccactgctgctttaatctgccaattttagagcagatcacttttactacttatgttatttatgaaataaatgtggtatttttaaaataaattttaaagtacatgacctcaggaatttccattactggttgtcgctgaccagaaatattaaggggtagaatgttgtagtgtgagaaggaagctttctccttttcaacctctttagcatatatatcaaactgcaaccagttgttcaatattatcatatttcatgatttacagaaactgggaaaatcaataatatcttgcaattatttgtaattactggatgcagaatgcagaacctcagcgtgaaatttttcaggtgtcacggtttttagcacatcatataggacggacgcaatctgatagtgtctagccatctcctccctaaggcattcaaagaatagtatgagaacattgataaagtctgagccatttgtagttttgcaccgagagatagttaatgcgatgcaacaatggccagtcttacggtttttttgtcttaagaccgtccacaagattttttttacaataatgctcataaaaccgctgaatctctttcgcatctgttcctgcaagtctgcgctgtgtctcgtgttcatcctgtgaaataacaaacgtcaaaccatgcaatgcatatatgttgaaagtgaataggagcaattaacatgctgaagcacttctaatctgagtaaggaagaatgttaaaagatttggggctttatattaatcttctacatgaaaactttattccagtttattccttgtggagttaattataacttctcacttcacaatggtgttctggaaaataatggagactcatttctttttgcacgaatcactattgcaagcttaatagaaatattgtctccactagtatcaagacaagctatcaccggtaactaactccaacaaaaacaggacaccaagtgatacctggtttgggagaaattctagacactgccatgcgaattctagtgggtaacggaactatgggattgtgaaacctctgaccgtatggtaaaactgtaaggccagttggcaaagtactctctgggggtcacataaaatcaggcttttggtgctttatgctgcaagcaaggactgtgagaaagtaacattttgtaatcttcaaaaaatcatacttgattagaggaattttttttttctgaaacagatggcagggccacagaagctctgcccattcctctgtactaatataaaaggaacaaatttaaactacatggatgctataaagcatcatggccattcatcctctagtttggaaagatgagatataaaggtgggtccttactctataattaatcatacacaattaatatgcaattaaaatagagactctccattactaagatttgcagtgcaagtgagaataacttcaatagggaaaatatctacttaaatccctcaagtgtaatggtttatttccttagcaccctgaacactaggtatcgtaccaccttaactaacaaaaaccagagcaaatgtaggcgtattgccagcatggcagatcaagctggcaacatgatagtgactcagcaaatcaaatatataaaatatctcttgcacagtgggcccctatgtcagtggtatactcttgttctttctcatctttcaccccccccccccctctgtttgttatggagaaaaaaaagagcacattccccgcatctctgccatgctgcttgtgaggtaagagcatagtgaaaaaaaccagaccggcccggtgtttggaccggaaaaaaccggaaccagaggtcagcgcggttcggttggatggaaagactggacatgtaattgacccgctttagaccgcttgaaccggccagttttaagtgaaccggtgataaaccagcctcgatcggaccggcctagacatctgaattgcttaaatgggccggaagaaggcccatttaattcgaaggcccgaaataactagatatttaggcaaaaatgaccaagaaaaagggaatggtggggagtcaaaccctggtggtgggtttgaagttgactccggtagccatccaagcattaggttgttagttctgatacgagaatataaagtaatttttatctagtagcgaaccacggttagaccggccggttcaccagtcagaccgtcggaccagtgaaccaagaggttgaccgggtcactcactggtccagtcttttcaactatgagtaagagcattagtgacatattcctctcaatcatctcagggcttgcaccgagcctgcttcccatgggcatcttggcattcctcncaagngtntncatagttgctattgccgaaagcacaaccgctctgaccgtctattctaagaccagacttagctccgcaattctactgacacatacttcatcaagtagctttaagtcatcttaccattttaacaattaccgatttcctcgtgactagttgagaacatacttttggtacgtggtaggatcgaaattgcaggagatttattgctctcatagcttgggcgcgatattgttggtatgaaattgtatcaatctctcaccaccctgtgtcacctgttgactctgattagacccttcttttgcacatccagatctcatcatgctaatagcatatgaggggagaaagagagagcatatgaggaagcttaggtgcgttgcaccagcatggatcagagactgttgatggaggcatccatggcggtaaccaggaggtggcagaatgagacagagggtagaaaggggaagaagagagacttcatagagaaagggggcccacattcaagacaaattttacacattgttgagtcatatccatgctgctggccgtgttatcctccacagtggcaatactgccacggaactagcccagtgggttctttttcttccttttatattacgtggtactatactttagggtgtaaagtagacgaactgctacatttcaccttctaaggataacattgcaaactgcatatcgaggtgcagaaattttctttcggcgcaacagtctctctcaatagttaaattattcaggcacatcattattgtttatttgtgtcacgattccaggtgcttactgcaatttgtttgcatttccatttcacatcataaaagttcaaacagtttaacaccatcacaagaaatacacatgcacttaacaacaaaagctatgtgattcctgcacgtagctactttcaaacacttacatgccacttgggaaagacgtttgttacgtgtgctcattgatagataggtggaggaatagcaggaaaagcagataccttctccagcctatgcaagaggtatgttttgaattgccgaactcctcgtccacctgagtttggatccatggtgtgagccttctcgaacgcggtaaaccgaccttttagcaagcaccaagccaccaaccaaaaaccacagtcaagtcatcacaataggctaagttcaaagcagaggtatacaagggagataaacatgcacatttcttacataaacagaaaaaaaaataaaaataattctgcaatcgatactatagctgcgaaatgagattcttccaatttccaaggctcactggctcagaacattcatgatggcactagactacctaaatggtgtggtcggctgcgtccgtgcatgtaatacggagcaattcattagagtatgattaattaagcatcaactaaaataaatttgaaaaatgaattaatatgaattttaagcaaattttctatagatttttttaattaaaaaaacaccaatatgtgtcaacgagcgagcatagctgcgcatgcaggcaacagatagcgaaatcataggagagaagtaaaaaaaaaaaagggaaaggggaacgcagagcacgcacagaggtaggcgacgcgctggttctcctcctcgatctcgttggcggcgcggaggatggggacgatgggggcgagcgagttaggcaccagctcgctctcctcgctgtactccccgccgtcctccccggagtacccctccggcctcatggtgaacgccctcgacaagccccgccgcagcgacggctgcggccccgacaacccccctccccccgtcgccatgcctcccccgccccgcggcggcgactacgacaacgacgacgacgaccaacgtaccccctcctccctattcgacaacgatcgagaccaacgccgcggcggcgttggcggcggtggcggcggtggtggtggtgaggatcggcgaggaaggggaggaggagatgggggcaaggcatcttcttaagcgggagggaggggggagtgtgagtgcggagtgcgcgctttttcgcttttgccgctttggccttctttctttctttcttcgaggggaggagaagggaggaggaggagattgtgctcggctttgctttaaaatttgggggatccact

SEQ ID NO: 60861 - DNA, 4386 bp, Oryza sativa
aggttttttttcacttccctaattcatctctcgtttttttagcgcacgctttttaaatttctaaacggtgtgtttctttaaaaattttctatacgaaagctactttaaaaattatattaacctatttaaaaataactaatacttaattaattatatatgctaatgaatactccctccgtactcgtaaaggaagtcgtttagcacaatgtttaagttaaaccttgggaatataaatcataaataactatcaagttgttgagtttaaaaatgtaaaaattatatgaatatatttgttttgaaaaatactttcataaaagtatacatatatcacttttcaataaatatttctatagaaacaagaagtcaaagttatgtttcggagaccgtatcgctgtccaaacgagaccgtgtcactgtccgaaacgaatttctttacgagtacggagggagtacacccattttatatggacagagtattagggcatgttctctttaatgcaaaaaaagacttactaaaatttggcattgccaaaattttgacatagttgccaaaattatatactcactaaaatttgacagcaaactaaatatagctacttttttgataactttatcaaaatttggtaagatcaaaaatgacatcaaagtgaacagagccttagtttccaacaggagccgaacacagggccgggctcttcgctttctttcgtgtgcgcttttctttatgaggtaaaaaacgaataatgtttatacctggtttcctggcttcaaaatgtctgtgtttcatgtcatgtgtaccaccgtatgtcggcgccgtactgcagagggaatgagaggatggataaaggtacagctacccgctttcgaattatttgtcgtcttatctaaattaaccattttaagttcgatcattaatctttagaaatctatttgtgtagtataacgttatactcccttcatttcataatgtaagactttctagcattactcatcatatttatatagatgttaataaatatagacacatatatatatttaaattcattagcatctctataaatatatggacaatactagaaagactcacgttatgaaacggaggaagatttatgcttttattcactacagaaacaactccatagtcgaactaatggtcaagattaaagcaatgagtataaatggaggggatcaatgagcatcggtaagctttgctttcctatatatgagtactaagttctaatgttttataacctcgtagagtggcagggagtcgttaataatttcttctttcgctttctccaaattgaaacttgaacaggacaggatttgaaaccggctctctccggatctgttcattgggcgatcgttcaattatgcacgcaaaagagagtgctttaatcaaataaaagatacagtttgggcacgtctcaactctaaagctagctatcactagcttcactggcgtgtttagttagcatcaagtggcagctatatatatatactcagaacaatctagcatatatattcaactggattgagatcctctgacataacttctcactaacttggtggctgacatgtgggcccgaaagtggtgaggcccacatgtcagtcacggcgaacattagaggatcatctttcatattctactagtgtggattgcatggatacgggactaccacgggtggaactacgtacacctgggatgggaatagctaattatattgcctcgctagggctcagtttctactgttttttttaggaaaaaattgctataggatactcaaaaatcgtgtaattgtctaagagacactgtaaaaatgtgacactgccgatggacagtacaaaagttgtgtagtttaggacaccaaaggcattattttataatttctgggctgaaagaggggagagaaattttgaaatgatgggaatgcccctgtactccttattcctttctctcaatgcagccgacatgtggacccacgctcagtgtcgtcatcctcctctcgccagcgcccaatgccgaccgacgccactgcatcccttccaaaatccgatcgattcggtgagagagtcagcgatgcccaatccggtggctacaacgaggcagtgcctctcgtcggccgccgtccctgcccacgacgccatcgtcacctccaccggccaccgcgcccacgcccagaccacctccctccacctcatctcctccctcctcaccgcgacgccctcgcccgcacccacagcgccgcctactccccacgcatccaactcaaggccctcgacctctgcttcgttgtctccctcgataggctcccctccgtctccgcctcctcctcctttgcctctacgccgatgaaccccccgtctccaactcctcatggccgccatcaagcactcccaggccaaccagcgccgcaacccggacaccttccacttctaccaccaggccaccaccgcccaaactcccgccgctgtcaaggtcgagctctcctagcttgtcctcgccatcctcaatgaccccatcatcagtcgtgtcttccctgaggccggattccgcagcagggacatcaagctcaccatcctccgtccggctccacccatgccactcctcggccgcctccccacgtgcacccacccgccgcctctcttcctctgcagcttcgccaccgtggatgacgttgatgtcccttcgccggccgggaaccttgccggcgttggggaggagaactgctgccacatcaccgagatcctctcccacggccgcaactctcactgccgtcaaggtcgagctgtcccagcttgtcctcgccatcctcgatgaccccatctttgctcgaattttggaagggaccagcgcggccaaggcagcatagacgcacgccttcaagacgatgacagaagcggtgagcacgcagaacaggaagatggacaagcatacaacggtgaagtcatcgacacttggggggcaatccggacaattcaataaaaatctcaccactttcatctcgaaaatgataaaataatgtgttcggtgttatacggccaattacataacttttgcagtgtccatgggcagtgtcacgtttttgtggtgtccctcagccaattacacgtttttttgcgtgtcttgtagtaaatgttttctctttttgagaaaatccatgaaatgccattgacaagcaccctaatccaagaaatgccattacagccaaactgttgttaacttctctccgttaagttgtatgaaaagacaatattacccctgggcaaacatttgctcactcatcattctgtattgtttgcccacacaacattatttttgcattgatgcatatttgaattcagacataattattttgctatcaatcaaattatttcaaaattaaattcacaaattttgccatcaaaattatttcagaaatttcgctatcaattatcagggttgtgatatgagcagaaatcaggctatcaatgattttagaaattttgttatcaatctgagctaaataacaaaacatggtttcagagttgagtacaataggtagactgcctgacaataaaatagagctaccatcaatcatttttcaggcattgaacgtgcagactaataatcatgtcaaaattcgatactactttcatgtaacccacatcagggcaatcaacacacaaagtagcaattatgatgcttaagcgaggatttgggcctgaaaaaaaccctaaagcggatggagagagacggggagttgagcatttgagcatttgctagttgagcatttgctgtctgggtacttaacataaaagaacaaatgtaatacagagcaaagggacatgaaaaacataggccaagtttagttttaaaatttttcttcaaacttccaactttccatcacatcaaaactttcctacacacataaacttccaacttttccgtcacatcgttccaatttcaaccaaacttccaattttgacgtgaactaaacacacccataggctttccctcaattcagcctgcatgcgtgctccatcgctgatggatcccaattcccaaaacccctgccaccgccggcgtctagtgcccggcgccggggctcgggccggagtccatgatcccgccaagcatgtcgaggctgacagacttcagccactgcaggccaccgtcaccggcattctccatgctcccgaccattgcctccaaatcgaccgccagcgactccaccgcgtccccgtctttctccatctgcttaagcatctaatactcctgggagcgccgcatcgccgctgagggccgccgcgccaccgcctggggccaccgcatcgcccctgtcacccatcgtgttaggtttagggctgtcttcttatttttccaatttcttttcttttaacgga

SEQ ID NO: 60862 - DNA, 1332 bp, Oryza sativa
atttcaattagaacataattaaataaatccataaaaattctaaaaattccaaaattacgaaatcaatcttcttggatagacctttattttagatgaatttaagtttaagttccactcaatttggagttaaactggctgtgatattgcctctaaaagattcaaatttaaattaattgaaattattgcgatatgttacagtgctacccttttcatttctccatgagaacttggaggagtctgaggcttccgctcaaacttcaatcaacatggattcgtggtgaagaaaatgtggggttaagtgttcattgcatagtctagggctctaggcaaactcccgaagtggccttcgcatccttctattgtggtggttagatgacgatgcagctgacgaatggtggagagtatcagggtcagaaaggagggcatgtggaggccattgtgagaaggtgtaaatggtggctaattgcatgggccaaggttgttggagctatgcattaccaagaacatggtggaatgacataaccgggtttggcatcggcatcatgtgtagggttgggtgttcagtttttccggttaaatcggtacggtttctttggttatacctaattccattttcttataaatggcagaattctagtttcttataaatggcaactgaagtaaacgataaaataaatgtaaccacacaaaataaaccgaatcacgtcggttcgattcctcggtttaccaagacaaccgacctgctcaccaagcacgcgttccagatagcattgggatagctagatgcgatctcccttgcggccttcacggagcgaacatctcccacaagctagttagcaacaaagttaaggtaatgggctttggcctattgagttaagtgagcctttgagactttcatgttggaaacaccagggaagtactttggactagtaatgcatgtacctagatcagttgttcggctttgttggttaagccggagattgaacacaagcaaaaataaaacgaagaaaaaaccaaagataaaaaaaactgctacttcggctcggttcggtatggttcgctccggtcttcggttgtcggtattattgtgcctacccctactcatgtgtccatggggctcaccacacacctgcatccaatgacatttaatcattctaagcaccatgcttacatttctaaataatgtcagtaattctcccacccttcggatggataagttaaaactagtgcaatccgttaagatcattggaccgatgtcgtagcatagatcgactaatctaaactgtatagtttatgaaataagtataaactacaaaataaagggggatccac

SEQ ID NO: 60863 - DNA, 1144 bp, Oryza sativa
ggcactttcaggaagttgtgcttgttgacggcatttctgggattagggtactgtcaatggcatttcatggattctctttttttttattacacggtacacacaccactacatgcgcaatattacactcacatcccctacgaatgtgcctctaacgcatgcttaaagagacgaaaaccaaatgcacatccttgatcttactaaaatcatgttaaaaactcgcctataaatacgtaatattcgtgggtacaggatttaaaccctgatgaataaaatcatgcaccatgactccgccatcccaacactaattcttccccacctcattagacttgttaaccagctcttgcacattatgtaacaaaacaatatatgctaactagtaaattatactaattacataaaaaatagttggaagtaatttgtaggacaaaatactacttaggtgttaggagcagtaaataaaaaaaagactggactttttctttgctattttaacctttttagaaaaatattttacaaatcgacccttacaatttagaaaccttattgcacatcctcggtcctcggtatcagggacgttggcaccaaggtgtgatgtctcgacgccagatgagctgacaccaagggatgggttttgatgtcaattaggctgtgttcggcagcctatgtttccaactcccctcttcgttttccgtgcacgcttttcaaattactgaacggtgtattttttgcaaaaaaaaagttctataggaaagttgcttaaaaaatcttattaatccatttttcaagttagttttagctaatacttaattaattatgcgataataagctattccgttttccgtgccagagggataggctccaactggcacaaatgaacgcagcctttagtttggcactgacctctcccatctagatttttttagggaaactctcccatctagatttcctctaaatctatacattttaaaactaaactattcaaacaggacgaaacacccttcccctattttagctagttttgacatgagctagcggtgaatataagatgaatctcataagttggagttccacaaaccaaactagcagtgaaactgcaatgacagaataatctaagcaaaacccaaccctaattcaacaacggcta

SEQ ID NO: 60864 - DNA, 2465 bp, Oryza sativa
  unsure (1)..(2465): unsure at all n locations
cgatggcatttctgggacttagacgcttgtcaatggcatttcatggattatctcataattttaacacaatcttgtaaaagttcgatagaatacaatattttggacaaaattttgacagaatttcagcaataagtttggcacaatttcaacagatatgttcaacatctcgccttatataacatgtccaagcatcacaaagtagcacatactcaagaacacacattaaacctctctagggttttgggattgggtgaaatgcaaccttctaacccgattcacaccctggttgactgatttacttataaggggtataatggccattcacaaattacaatatcattttttccctttgtttaatttgaaagttccgagtctacctaactactgtcacaactgggggtaaacggttgcttcattttaaaaagtaggggcaaaaacacaaacctaaaaagcagggataaaatcacaattgaaagtaggaggctaaggttttaatatataggaatgagattctaagataaacttgtgtctttttggagagatcacaatgttatgccagcaaaagtgaaaatgctaattacctaacttgtcaatatcactcttttccataactactttagctgaggtttttctattaatgtagggaacatctgcttgtaccaccttacttcaccatcaagtaagtataaaattcgtttgtaaagccaagaagacttgacttacatatagaccaagtaacaatgctttgaacaatacagcaacaaataattcgccactactttgcacaataccaaggtaatgtacggcttgaagtagaaaaccaaaaccaagtccaccttaaattttgcatggcaaaaggacatcaaagttgagattactagttagtagtaattagattactttacaacataggctcatctaaaaatatggttttgttgacttggtggagaagagtcatacataggagaggagtatgtatcaattcaaaagtggtggaaaggaggttctggttcctctcattatattgttaatttgttatcggataaggaaactagaaactattttgatagtgaagtaggggaatgaactatgcaatgaattcccaagaagggcatatagtttctagagcaacaaaaatgaaaaacaacaaaaaatcaagggcattaacacacatgtttaaccactcgatcgtaaaagtacttcatagatgaaatatttggtcccagtatatatcacactctgcgtctctgcaatcaacagttgatcagagaaccctaattaataaactcactttttacccccgaattaacacatgcaccaggggcgactaccagcttaactcaataaacaaaccatcctaattaagcgactaattaaagacctaattaatcaaagacatggccactccatatatatgcatgtagatcaatcagcaagtggcctggacggtgagcacgccggacaggcacccggcgccggcgaacgcgccggtgatctccaccgtgcacgactccttcccgacgcacgccgccgtgaacgcctcgtacgccgccttggactcgcacccgccctcgtagccgccgcaccgcccgcgccccacgccgaagctggccacgtcgacgctcgacacggcgtggccgccgccgcacgacagcgtgacggcgtcaccggcctcgccggaggtgcacacggcaccgggcaccacggtgcggagggcgacgcccgaggggtcgccgccggcctcctcgaagaggagcagcgtgttgggctcgccggcggcgaggaaggaaagcgcggcacgtggtagtagcggggttccttttgggcccggcaccgggggnctttncnggnnccncngnncangncccgnntgaggcacctggtgccgtcgccctccgcctggaacgcgccgcggtagtcgcagcggtggcagccggccatctccgccgccgtgtacgacggccagtagcggccgaggttgttgccgttcacccacgccacgcccttgttcaagcccagcaggtccaccaccaccgcgtcctcgccggacggagcttcaaatgtagccttcataacaaaaaaaaaagtaaccaaagtattaagattgttttggcggtgaaagaattaatgacatgatgaaatttcatagggaaggtaaattaagtaaattgtagtcttcataagaaaacaaaaaaagtattaaaaatccttttatttttgcaggtgaaagaatgaaacgatgaaatgaaatcatacaggtaattaaattactccagtttcataattgataagttttaggttaaacttttataaattaactaataatgactttaaaaatatctagtttaaaggcaccaaaacaacatatataaatttgacttacaaagtactataacaaaagtaatatatatatatatgcatattaatatattgtaatagagaaatatagtcagaaatatattccg

SEQ ID NO: 60865 - DNA, 10509 bp, Oryza sativa
tgatcaataccagcaaagttaacaaacaactaagcattgatgaaaaataatgtgtaaccttataagaccaggagctgttggagagatcaattgcggtgccattgctgtctatcagcttaacagggcctccaacaatgcccgtgggcatcttttcgaacgaagggccatagttctgtttaccaagaatgatcaaacaatttatcactggtatacatgattaattgcaaataaagaagatgagttcgttgctgatacgatggaagtgagcattcaagaaagaaaattaggaaccttgaggccaacggttgcactcagaagagagatgtagttcttgccatcatggagcttcaccggcgactctagttggaagacaaaatctccatcggcagaatggtttttccctgacaaattatgaacacacatgtttgtcaatgaacattctttaattttgacccgcaggttcacaaacattctttaatttcgacccacacagaattaaaagaatggtgcaacgaaaatatggaaaaaaaataactttgatactcaccaataagcttcccgttcacaaaggcataaagttcatggccagtcgtgttcacgtacaatttgtagctcccttctcctttgtgattaagactgcaattttttttttgttggtgacgttctaaatttgtaacatatatatatttttttgtcggaatcatttcaaatttacatcatcatgatctcttttctttagtataaagagattttttttttaaaaaaataccttgttctgtaccacaggtaatcactttgatcggttgacgtgacgatctgctccaagagctcattcttcctaaagttgcccttctcatcggtcatgaaaggactcaagttttcaggcatccaagaccattttaggctctcctgctcctgctccgccgtgttgggtttcttcaccatgacagacgtctgggtcttaatctaggtcataccaagaggaaaacaaaattaagagatgaattatagaccttacacttggtctcattttaatttcattattgattattgagaaaggaaaaataccttggcgctattgaaggcaacagtcttgcagtcaggcaagatgctgactgaccatgcaggcaggaggtgagtggctccatcgagggtcacattgacatctttatcatcaaatctgttgttgatgaagcaagcagatgaggagtccagagtgtacttggtaacctacattgatcagagatagtaccaatatgcatgcattagatatgtttgcattagacgtgataattttgattaaaagaagggcgtgatctgaatattactgtgatgttatcgccatagttggtgtcaaaatactctccatggacaagagttttctccatggacttgagcacggagtggagttccttcaagtgaccatatttgggttgcctgagattacctgtaataaatcaaaagtagaccaacaagattataattaaaataagacaaaaaattgctttcttattcaaattcaccatataattaacagtacggtaaaatatattaatcaaagcttaccatactcatccaaaggcgcgtcataatcatagcttgttgtgatgtacggacctccggaggtacgaccaaagttggttccaccatggtactaacaaaaaatggaaaaaaaaaactcagcataaatcaacgaaaattcagtcattgtgaaagagatacaagctagccagcataccatatagtaattttgcagagatccacgcttttggaagaacatcgcaaccgcaaaagcaatgtcttcagctgacctatggaaatccggcttgtcccaagctttgaacctaacgttaagtacatcaacaaattaagataaatctcctccatgttcatcaaaaaataattttgcaaacaaagagatatatgtactaaaagttaattttgtaaacaatgagagaaatactaatggaagaaaaaaaaataccagccagtccagttctctgtccaaatcttagggatgcctgtcctatttggaaaccagtcatggcaatagaatccattacaggtattgacctagagcggtccaaaacaatgacaaactcatgttattagatgagtgataaacaaataaattcatataatattctatattcttgtgggattaaaacccatgctcaccacattgtgcggcacatcgtcgtcttgttgacacatgatccatgggacaccgacgttctgcttgttcgccatgtcagcacaccagtggatgtattcagatgcagactggttgttgtttaatttccccatgatgtttccatactcattctcaatctgtgcattgatccattaatgcattgatattaattgacaatatatattgtggaatgacaatagtacaaattattaacatgctaatttcccattgttcaatcatattgaagaatgatcattacaatacctgagcaaggatgatcggtcctccttgttcagcaaacatttttgaatccttcatcttgttaactataagagtggtgaatgtctccatctcattctatatcatggaaaaaaacacttgcattaattatatgctagtatatgtaaaagtacacaaaaatagatgagaattttattattattattattatttaacctcaaaaggctcattatgcagcctaaactgcattccagggatgtcgcgtagccaagctggaagtcctctgcacatttggcatttgttttagaaaacaacaaaacacagtgagcacttcaacatgcatgcatggacacataataatgttatagaaagaaactagagtagtttagtgtgctcgcttgtttcctcttattctatatgaacactatagatataatatttgattaatttgcagatcgatataatagtctattctatttcgtttttttctctaattctatatgaacattatagatataatattcgattaatttgcagatcaatataatattctattctatttatcactttgacacacaaatgctttagcatttatatacatgatacatacccatagttccattcgccacagatgtacgggccaatgcgaagaatggcgtacatgccggcattctggatctccttgaagaacctgacgacatcgtagttaccctcaaaattgtactgccgatcaaagcaaaaacattgttatagtattactagtatttatccatggttgttattgtatgtaatagctgcagtacgtagtagtgtttatgtgctaaagcaaaagtagtaatattgaacctggcggcggtgcggctcatggccgttccaaaagatgtaagtctcgatggcatcgagaccaccttccttcgccttcttgatcagatccggccacatctgcatagcaacaataagattagattagatagaaaaaaaatcaaattaatcttttgcgcacgtacatatattgcttatgttcattaatttcttaacacaaattaagaaaataaagatcgaacgaatataagtcacaacataatatgcatgcataagtatataaaagtatagaacataaaactcctcgcactgcttagctcatcacgatctatggcacaaaaagaaaagaaacactcaagcaagcaactctgtatcctactagtacaaaacactcaaagttgtatatgcatttaatttgcagattaatattatcaactatctctattttttaatacatgatgttgttgattttttcacacatttaaccattcttcttattaaaaaaacataattataatttattttttgtgagttgttttatcactcaaagtattttaagcatgatttatatcttatgtatctccataaattattacaaatgttcaaacatattaaaaaattaacgacatcatgtattgaaaaacaaaaatagtatacactaggaatatctatacctatacagcgttaacctggtgaatctgccgttgatcaaatagacccacacattattaatttatagttaatatcatggtcccatgggcctcacaaatcccatccaataatctctacatacaattttgttgggaattcagttggatatattgccgatgatctggatttcaagcggaggcatcaacacaaatggaaatagagatgaactttaggacgcgctcagatatctccaagtcgatcgggtattattgtttctcaatctagattggtttctcatctcaaacaattttaacctgggtaaactatatatatgacacggttgaaaaatgagcacctggaagagtacatagtaacgtgctaattactttgctgacagagtttagtctatgattatgttgactacacggacagaattttggacaatgattatgttgctaccaacatatgattaattccgtggctactttttttatttctttttacatgtacagattggatctaatgccaaaatttatttaattaattagttttccacttaacacattactacgcatagttacaatttcaatataattctcaacggtgataacaatatcaatattgtacaccattcataatacatggatcttacaattttaaaaatatacaacgaattctatgattaaaatataattcactcagaaaataaattaaaaatcaccatattgcagttggcattaatttgccatcaatttaaaccattcctatacgattttgtatgactgaaatactatcagagtaaaattttatagggctaaaaaataatatttaaaattatctcgtgcgttgcacgggttgacggctagtataacaagtcggttacctcgggagtgctccggggataatggatggaaccagagaggatgatccggcgctggccgtcgatgacgaggctgcggtcgtcgtagctgacgctggtgcagcccacggcatcggccgccacggcgaggaccagcagcgccacccaccaccggcaccagctgctgccgcgccgtcccatcatactgctgctaatttgaagttaattagctaggctacaggggaggaggggaggagaggaggagacgagatgagttgcaactttgcagatgcaagcgatcgaattgcagagatcgggcgtgggggtgatacggaatttataggccgcagcgatacgatgcgccgtacgttggagatagatacaatagaggataattacgtagtacacgtgggcatgggtttgttaatcttggagatactattgcacagagaaacaaacaaagtagttaagccggatcgccatgcatacgataaagacgtatgatacgataattagtggttagccgtaaaatcgagattgcgtgccgtttcttttttttttgcggatagtgctaaaactagaaaagacaatctccatcccctcctcctaactgagagatttgataatttaacactattttcaatgggtttcgattatttgacattctggttcactttcatacactcatatggtctcacatatcatcctcacaaaaatatcaattaaagtaattggacaatgaaaaaagcgttaaattatcaaatttttcctcctaacttggcatcagaattcttttccatcagatgataatgcccctcgtctcttcacgagattttatcacctctcggaactggctgacaccctgtgcattatcatagactctgctgcctgaatagcttctgatgttccagttatccctatcagatatcttgatcctggcaccactagcctgaatgatctctgtaatgttccttccggcacgtcgtacgacagcaccaaaatgttcatcagcaataccaatagtgagaatcttgggcgtcattgttagcaggtgagatctcataggtgtactgggtttgttgttttggtcccttcctccatacccattaggtccataattcacagcattattatacggcacctgtgggatcataatacccaacaggaacaccagggtaactagggaaactaaggcctgcatatggaaatggggaactcagattaggtgggtagtgaacgtcctccgataacttatgcttcatatcaaatatattgcacgcatctgatggtccaagggtcctgtgacagtaacgagtctatcatgcaaaccaagaaaattgttatcctgtggtgaaatcttgattccagcatgtgtgtcttcaatgaatgacttgattcctttaccaatgattcctccacaataatttagataaaggaattaaagctttgttgatcatctcagataattacatccaaaggtgataaaattagataaggtgatacaattagataaaaaagagtattatttgcagcaagcaactgcgctctgaaaatgaaattcattgttatagaaaatcctggtcgtcattctcattgtttttttgttccccaaacactgcaaccaagcaataaaacaataggggctactacacacatgccctcatatgaacacgatggaaccagaaacaaataaatcccagaaccgccatatcggtgccaggaaaagttacatcggattgtactagtcaaacctgcagagaagcacaacccatatattcatcatgatcagtccctctttgagccgctaccattctggccggtgaggatcctggagatctgcagcccccggctgaaggcctggttgaagagcagccgagtctgaaactcggagacgaaggggaaccacgacaggacggcgatggggaagaagatgaggatccccatggtgtactcgtacatcctcgccatctcctggatggagtcccatggcccgatcttgcggagcacatcccggctcctcagcctaaacctggcgcagcaacgccccttgcatgcggtgcccccggtgcaacatgaacagaacagggcgcagagcggctccgtcaccaatctccggaacaatggtccacagagctgtgcaatctacgagagtaaagtgaatgtgatgattgaatacaatggacaaatgagtggacaattctagtgggaagggggaaaaaatcaggttgaagttgtgagcacagatgcatcacttacctgaagaataaaccagccagtagggatgaatgccaaaatactggcaccaacatcagagacagtcagattgaaaacaacaaataatatgaccaccaagctgatgaggacaataaagacaatgcccttgaggatacggaatacaagttgaaaattggtaataaacttctctctccccattgagacgacctggaagaagaaatatgctcaactgtaggattactattgcaaagaacataatacaataccaaataaactgttaccttaagtgatacaagaactatagctataaccagccatgatagtgcatacacctgtggaaacaaaaaaaagaaagaaaaaccattagtccggtcagaattcatacattgatgcagagcactctagtcaggataagtaccatgaagcttctgttcccatgcactatgtgtaaatgataaacaataccatattggtatatcaagaagcgaagggagaggacgaactccaacagcaggctacgtattgtaccattcctcaggtggtcatgttcacttatccaccaagcctcccaactttgctctggtgccaggccaatacctcctctattgctcatccaatgccaccagtcagtccagtcatcaacagtcttgtgccactcaaagcatgatggattgaagacaaaaggtgcaaacagccaacagaaaacaaggaaccatattgaaattgtgacatatagatacaaacttgagctcctgtacgaaatgccataagctagatagacaaccaaaagaatgagtagctccagtgctttcacaaagtggctccgggaatacatccggtaattctcagcaaactttgcatggcgcacaacaaacccccggcctgtacctctatattttgcaccaccatgaagtattgttcttccatagtagtgagtcttcgttccaagatggaaagtgaagaaaacagaagctaattgaagttgcattattacaaactctcccaaggctctgccaaatcctttctccaagccaacctctatcatcatagggaggacgagcaacattccaagttggaaaatagattgagttgcaagtgcattttcaaagggcttgatgttcttaatttgtggatcctggagaattgacttctctaggccactcaaaacaagatataacctcccgtataaaaatacatacactgtaagaacagccacctgaaagtaatcaaagccataaaatgcgttagcacactttgtacaaaagtacaaaccttatgtcacattttttagttctttataatctgctggtcactgctttaaaaatcatgaagaacaatatagaccattttatttccctactaggttgttttctttgtagagaatttatctcctcaaacggaatgcaaagataagggagcataattattgggccaacatgctaaatgtgcctcaaacttaacttcacatccaaatatcttcctgggactttttgttttttttgcaataatactggttggttattggttttagtggcaagatttttctagttcatatcttgtttgttgtcgtgctttacaaaccacaaagtgaaccaatcagctattgcagctccagaaactttatatgttactaagttgatgtgtcaaagaataagattcataccatactattgaagtagaaaccaactgtagtgaagtatagagacaacatcctgtagaaatcaaatctgtgccctagtcgataaatatctcgacagagtgtttgttcaccatttccgtttgccaccttggcctcaaagttggatatttgattcattccaacatcacgtcctttacccagctgtatatattcatgatgagtaacatttccttgccgcagggttgaattgaatcctttaatcagaacaaccataagcttactgcacagaacaaaactaatttgcatgatgcacataatctctggaaattttacctgcaaagatatcctcgctaaggttgataacctttgatgccttgcttatgccaccccttgtgaggtgaaagattctatcgaaaacatcagggtgaccataatggaatcgtaccctgcataagaaatttggaaaaataaccaaagaaaataactccgctgctcatggtacaattgtacaaagatctacacagcaaggtgaaaatcattctagcctaacctgtatcacttgagttttataattcctatatttacttaacaatttatctcctatcctctcaaaaaattatctcctacacgataaattgtacctaaaatcaggttttacacggtgagaattgtgatagtacctagcccccactggttccctaaaactggtgggttattgggtggtttctagactcactctaggcactgccaatcagtttgggattgatgaaaattgttcaagttagtcaaaccagtctaacttgggagtaaattggtataaatatcattactaactcactgaaaatgagatgagtaaataacaagaataattgatttgtcacatctgaccagtttgaccataaacaggtaagaactggctggtccacaggcctttacaaccctgtcagctgtacgttccttgaatttatgtgctgtaaattatcatttctaaattctaagtatattgccttcaacccctgtgttcatagcatgcatggccttgtgtttgctttgctatgctatgattttggctagtcaatgccatttaacaattttagcaatttattgttcaaaattatagttcctttacaccttaacaagtaaatctcccagcatatattgatcctttattccttgtgtaactcataaaaatattctagtttggtggttggttatggctccatggaacatttagtagttatcaaaatccaataatatgaaagctacacatttgtgggtaggagctctgccatgaattagataggatcaaagcttagacaaaaccatactgaatgcttgaggagaagccaacaacatgaaaggaatatgaatcaagcagacattaaggttgtgcaatatggtgactatattgcagaagttgtataaaatgaattggccaatataattttgaaggtgaaaggagacatacttgagagtgttcgcaagaacacgttgtccaatggtaacgaaactagtctcttggtttgacataaaccacgcaagggatgaaacactatatgtcaagtaagaacaacataatgttagtacaaaaggagttaaaaaaataaatacactatcagcaaaattgatggcgcgctaaagtctagaggtgattaatagaaaaaaagaaaagccaaacctcccagtaaagatatgttcgcgaacacccaatattgttggttcagactttccgtgtttaataaggaactcttccagtagatttctcattttaaatgcttcctcaaggtaattatcctgcacaacagagaatataagataaactactaagtgggacttattttacacagagattgcatagggctgcaggaa

SEQ ID NO: 60866 - DNA, 7371 bp, Oryza sativa
ttcaattcgctgccatttcctggaatgttgacaactgcaccctgacatcagtgttgatgtctttatgcatttgaatactgttccaatttattttataaatattactatccacaacttgatctacaagcactttatcacttaaaggtaaaaccgatctataatcactatcatggataataaaatatctacagaaaaaggtagatatttgagttcaagcaatgaaaattcagtacctcatcattgcctttcacaagaactgagtaatattgtttctccattttaccatttggtaatggcacttctttctcatcaatgtaagcaatacgcaatgctggatacctgtattgcacataacgctgaaggatgcacaaaagatatgtactttataaaatgtaatgggtgttcagcaacttacgttaacatgagatttaagatgttttcataaagacctttttcacgggaatcctttgatgccttatgcatgccatagagttggcaggaaacaacataagtgaattttatatcagcaatggccttggaccttgcagattcctctccgtctaaatcagctaaggtataacaatgtagccaaagttaattgtttccacataaaagaaaaatggaggaccagtgttttgtaacaagagcactatctgcctaaccttgagcatttgtcatatcctcatagcattgtagttcaagagctcgtctgtagtacatcattcctctcactagacataagaagataaaaacaataagatctggagaatagatataagtttggcagcttactagaggatagaaacattcatagtaccagttctggcaagtgtttgaccacggtaagatgcccagatacggacatcatccatgtacccttttactgcctcttcattttctgggtcaactccaatgcgttctagaaagttcttccattcatctggtgaagtgacaaagcattactcattaaatttttactatgaacacagaaataagatgaactacatttaggatacactaaaatctgatgagtaagatggttgatagtatggaaaaccagattggtggaacacatactctttcactcttcacatttatcatgtcactatttttaatttgtaacattgatctgcggatccttcacgaattgtgttcagcagtttttattgataaaaaagaatctgcaactcacctggataaatcttttgtagatagaacaaaattgaaatgccatcttcattcttcttattcagttcatgagaagaatagagcacttcctcattataatatggagtcaaaacactaaatagtggagtttgttagaatgtgaagttcctcaaaatgagtgcagaggatagtaaattaataacagaagtaacactgcgcattatgtacaggtgtacagggctgagtgaagatataataaaaaattaaaaacatcatatcgttaacatgatttatttcgaaagacatgaatctgaatatggttaattaaaaagaacatacatttgtccatgtctcaatgttcacatgacgagcacttgtgcatatagctctataaccatttatctaacaaacaatctgatgtcccctcccaaaaaaaaacttcagtcagtagggaaaaaaaaaaccttatcaggcatcggaccatccccaattttcagtttggttctgagcaaaactatcgggttcaaccggttactactgtttcatttgcatctctagtcttttatgcaaaccagaccaggtacgggctctagtttcccccagtttaaccgtcggtccattatagttaactattcaaaatgcagcatgtatgcacggaatgtcatattataaaaaatcgccgtacagagttttatttaattaatttattagtccacataccaatatattaggatatgttatgtacaaacaaatatggtgtaatctaatggtcttatagatttaggcaggtatcagaatctcatcaatttctgctgtaaccaacatatgcagacagaataaacttagaaatcaaatctacccatacttctgaaataaaagttcattgatgataaaatgcacacctaaatgaaatcatatcatgaacttgaggtgcttttggcattttcatgaacagtgagtttgcaaagaaggtgatcctacgccgagcatccaaatttgttggtacatccattgcggaatccttcatagtcaacaataagtgcaaccggacaaactgggagcaaaacatctatttcagtattaaacaattaagaaacaactttcagagaagtcacaatgatagttgcacaccttctccttccaaaacgattcctttatcatatccatgtctaaatgtgtgaacctctgctttctctcattctcatctttcaaaatactgccacagttttcaaacaattaaaccaacacatttcatatctaaggaacttattaattacaatagttcttacccctgtccatctttcatgaaatcccgtgtagtaatttccataaaatcttgcagagcattaatgatttttctctcagcagtaccatcagtagattcattgctctgcaaaatgagtgataaatacagattaaatgtaatatatatatacgcagaaaaggaactaataaaataaatccattcattcttctgcaaaacgagtgattaaatgaatctgcgttaaatgtaaatatatgcagaaaacaaactaataaaatgaatcaggcataacagttgttaccagtagatgcaataattttgccagcgtgttgctgactttgccaatctctgccatatgaaaatcttccaaaagtgtattattttccacactatcaagcactgttttatcaatggcatcgacgattctgcagcagtatgtcaaatgagccaaatcagtaatttctaatatattgtacagaggaatagattcaccatgtaaatgaaagagtatggcctttacttctgatcattattgtctagcagaagattcttaagaataagaaccaaggactcgtagcattctatgacagcattgaatctagcttggtctagtctgattttttcaatcaactcatggtaatccccttctttagaagtcatggccatgtgaagagctgtgggtacctggtatattcctgagaccatgagcatctctgcaaaataatcaaataatattggataatttattatctatttctgagcaaacaggctttgcgcaccttactggcaacaaggaaaggaggccatggagtaacagaaaaactacttgaaaatgacggagccatcagtatgtccctttctctatcaaaataaaagttgagggttaaccctacagtgaatggcatagtggaatactattcaaaaaaagtttacagttccaacctatcacttatgaagtcttcctctcgtaaggaattgatgaatgaattccaaacacaaaaaaatctcccctcaccacatgcttgctgcaatgaaggtaataaaatcactcaaaattcaagtgcctttagcaaatactaaagaaattatgcatttctatgtcttcagcccacctaaaagggaaacagatcctaacttactgccctctgactttgagtggctgacatgtgggcccctagctcgcgggcccatatgtcagcgacccacatcagagggcagtacgtcagaggagattttccccctaaaagatggcccctgtatgcattgtagccacctacactttcattctcactgcatgtaaaagggtaaactcggatatccagatctcttgtttatataatagcttcagcctacctagtctcactaagtcggaagtttcacaatcttagaggtgttggtaggatcacttctgaactacacacgctagtctagctgaaaacctgattatgtgctgctgaaaagcttagtaacttaggaagggtacatgtccttctataggacttttaagtcggtgctacagtagaagggcgtgtacccttcctaaattagtaagcttttcagctcagtttcagctagactaaagtacagttcagaagtgatcctattcctaccaacaagaggaaatttccatgcttgaaagtttcaaaatgacatttgaaacttccatagtaaatgttttctgaaaatacaagatgaatttgcttcacttgaaatatttcaagttttgagtcaaaagttgtgaagccaatgtgaaaaaatctctgcttttgcggtagggatgaagagggagatgacaattattacgtgtgtagaggggggtttctgcagaggagatagctatcagatgatgaggggagtggagtctcatttacttaggctgtccgtgttaagcatagttgtaaaaaggggaccagactggtggttcaatcagaaaaaccagaaccagatctcagcacagtttggttgcatcaaaagaccagatgtgcatttggacccctttgaacagctcgaaccaacagtcttgaggtcatgaggtgaactggctattataaacctggaaaggctgggccggcaggggaggaagagtgtttgtaatgggccaaacggaagactaatcctttccctcaagacccaccacagcttaatttctttggcaaaaaacacagtttggttgtgccgaaagaaccaatgtgcattaaactgggacaggttggcctggctggggaaggaagagtgtctgtggtggcccaaacaaaatcctaatcctttccctcgaggcccaccacagcattcttttgtcaaaaaaccagtaaagggtgtgtcaatgggatccgatccctggttgagagattcaaagcagtgtgccttctccatcctaccatgaaggctgctgcattttaaatggaacatatactgcatttaagtatattaatattaaccaaccacggtttgactgcctagaccgactgtcagcgatgggttcacccatcaatctgactttttaaccatgattagcagtcccatgaggaaaatacaaacctctctatgcgctgttgcatggcttttattgaaagcttctggcattgatttgaatctggctcttaacatgccaagggtacgtatctacattaaaagaaaaagaagatatcttacaactaaacatttttaacactgcaaatatattgtcatacataaaagagtcactaacctcaccaacatgactaagggcacctgaaacacccccaaatgcagttgaaaaaatagcataccatatttgtatatccatgaagtacacctataaatagagcagtaggttatatcaatcatggaacaatattagaaccttccaagttcgagaaaaaaaaattgaaccttcatgattataattacataccatgacgattggggcccatatagtaatgacgacaccaaggttgtgtggcactgttaaaaattaacaagaatattgtaagtaaaatataatcaccataagaaccatgcagataacatgtatatccaaaataacaagagaatattagaaaagaaataaggagaagccccatatacttaattatatagttgcccccctcccccaactgccacacacacacacacacacataaaaaataaagaaaactaagtgtagttaatgtatttctctcttctctcatgaaaccacatgacctcaattgtttgtagctttggatgatcaaactacagttcaaattgtctcacttctcttataaatagcctcaattgtttctaacctttggatgattaacctatgcagcaaattatctctcttcacttttaaagtcacatcatctcaattatttctagcctttgcatgtttgatcaaaggtgtaaattgcaaaaagcatataaaatcaattatcttgcaccatattttatcattgtggtacagtattcacgcagcaatgcacagggttttcatctaatgttataggaaatgaaatcaccaaatgaaacaacattattgcaagagaacaaaatcaagtttggccctcaacctctgttggaaagctattcactctgaactcaaaaaaggctgtcttccccagtactctaaaatctggacagataacaccctcaaccctattctatggtggttttgattagagtaaaatgcaccacgggtactaaaacttgaaaggtgggtgcacttcagttgtaaattgctcaagcaagtcacacaacttgtttcgggggttcaaatatcacagagtacatgtcacatgaactatttgttgctaaattaaaaacttttggcgtaagttgatgcacttgtgaaccgcagagcaaggttacaagtttcaagttaagcaaattaacctccatatttttacgtgcactcctacatgcatatgctttcagtcaacacaatcgcatagtgcttagcaataaaacaacaaaattcatcttaaattggattttactgtcaatacttttacaccattggtttatttgtagccatgtttatgaaagaaattaatatggcatccaacttcgaagatgaacatcccacatggcatatgttttatgtgatttgcacctcggaaacaagatgggtgattcttttgagctatttgcaaaatgagtgacttaattgcacccaccttacaacttgtggtactgctggtgtactttactcattagagtaattcagaggggacaggattgcattgaacatttggtccaatctagctatatcacaagatacttacggaaagggaagatttcatgccactcatagttcccaactccttggttaagaaggaactttgtcggaccaataattggggatatctgcacaaaacgaaaacacattccatagagtaaggaaaaaaagaaattgcatacattaaaactgttatcgtaattcctgttgcagaatagaagatagatatttttttgaaacaaaaaataatagacagtacttctttgtcaaggtcttctaaaattgagttttttacttggcagctgtgtaaacattaatatagctcattattagattttcaatagttgtttccttttatatggtaaagaagacatatcattttcaaacttgtatatatttttctagatttttcattttttcagggcaaacaaggttaagtctctggcccataagactactcggtactcacgcccagcatggtacagcatgtgttgtactttcaagttgtagtacctgcggtgcattcattaggtcgagccaacccgactctgtgtacaggagctcatgtcagaccccatttagccacacctacccaaaccgctgagtatgcaggagccaacatgcataatcaagccactaagacaaatgtgagcattagatgcacgttcactggtgtagcaggcactggcttgtactatcatcactgtacatgagagcacaggggagagacaagagaggaaca

SEQ ID NO: 60867 - DNA, 6621 bp, Oryza sativa
gtggatcccccgtttattattgcctagacctagagttgtcttatgctagcaaaaaatgagcttttcttgtacttcttgttacacacttaactagtggtatgtaagttgtgtacttgtgacagtttgccaacagaaatcagagaagaaacttttggaggatccaaatcctaatagtacggtgtgacaaatgtaatccttcaaacaagttggcaatcttctgaaaatattatctaatttgcaccaggcgaaagcattagtaattgacaactttcaaatatgtactgaaaaatagtgcaatatttcagtaatttacctcaacataaaaactaaatgcaagcttgcaggtgagcaaaacgacccaaaagaagacatacctgttgcatccaaatgaacagtcatattcaattcaaaggaaaacaataaattgaaaaggtgaagcacttacttaataatggacaatatatcttcatgcataccacgtgcaacatataatcttggctgatatgtggcaaaacatcatgtaagcgctaattatgctcaacactcaaattagttttgtatgtgtgcatcatgttaaaggaaatatgaaacgctgacctgaatccaccacataataagaccaattacacgccagtttgagcgttccatgatattctgaagttgtggcaacaagaaaagaaaggcagccaaaatgtccgggactatatatatgatgattgcaacattatatactgacgggttatgccaatttcctacccaactattcaggagttttccagcaccagatgggtatctgatggaactagaatatgctaatggaagaattattatccaagcaatggccacgaagaattttaatagatatctgactatttgtatccagtccatattcccccatgcttggaaagtaagcactatgtccagagttactgcacgagtagaaaataggagttatagaaatagcatagctctttgaaatgaatactatgtagtacaacaaaatagttcaacctgacaaaatgaaaagcatttagaagagagtactacacctttaatgaagttgagtagagcagctgttataaagacacttaaaacacttctgaaaacagttgcatcagcaagcgcagaaagagatccagacgaactccatgatactattagcattgcctggaagtggaaattcaaggtgtttgtgttgcaagtttaaagagttgaaaagattctgatgtacttcagaaagaggagtcacctgaaaagctagtatgaaaaacatccacattcgattaaaacttctaaatatgtgtagaaatgtgcggacttcaacaaaattcgttttgggctttgttgatgtagtgcgctgtaagaagaaaaaacaaagaaacattagctaaaaagcaactagcgtatactgtttatttcaagtgaacatgaaacagttccaagatctgaatacttatcatcctaaaataatctttccatgcaaccagccaatcacatactgtcaaattaatttctttccagccaatatttttcacttgtattagagcaaaatctgtgataagttctctgacacaatatttcaacagaacgtgatttggcacaggcatatttggattgaatggaacagatttgtcttaagatgagattctggcagacaggtcactatggaaaacagttactccccttaatgtaggctcggaaacagcgaagaaatcttcaaaagagttagtggtgaattcataaaaataaggttagaaatgacaatgtctagctatgtattaagctcctttccacctctagataatttgtaactagtattttcttccctgacggcaggggctctcctgtattatattcctttctagtaaaatgtatatgctatggctcaaaaaatctcttaagacttaaagagccccaaaatcatttgaaagcgagcacaagcttacccaattgtgaaagtcacttaacataaggacaagtctagttgcttaaattttctttttaactaagaactagccttcttgcctaaggtattgaactatagtcattgcagactgcctgttaggaacacaataattttgcaggatatagtatgattcctcaaaataaaaccatcaaaacatgccactgattataagtatcattttgactgttctcaagatcaaagttctattcatacattcataatgaaactataatgttaaattctattatctaaaaatgatgaaatcaccatgtggttcaccaaactattggtgcgatctccctaataagacaaccagattctatccttttgatgagggaccacacatttgcaccatgctgacattaatcaaatcaataataactgctacttaccccttgataaaagaagtccgctgtaaggtcccatggccagttaagccttgcaaaacatttctctgacctgcgtggaagaaaacgaaaactcacagactgaaaaaataaacaaccacacagaagattatgagattaccaaaagtgttcgttcaaatcgtcatagtttctccaagtagagtggccagctgtaccacctttactcttatgtgcttcctttttttggttaaaataagaataacagtttgtaagcacaagagcttctcctgcaaggaaaaattaagttatttatcaaactttaaatactcactttctgcaaaaccttgtagataggttcaatggcagttttcagaaatgatccctcttcttcaaatcctggtggtgattgaaaattattttcttcgatcattttgtgcaactgtcttgccatctgccaaattatcagaaagtaacagtcaaaacttatatacaggagaaataagaaaaccataaaatagatattgcaacttatgtgatggttcatgatgaaagatggtttgaatggatgttgtagctggttggatattattactaattcaccttgacagcttgataacacattcatggcttcaattcaatcacctcacaaattcattattaaggtatgcttacagttgaaccttgatgtaggcaaggattgcatcacatggaataactcccatagtcatattatcatttccagtagccatgcaatggacacaagatctacaatgctagcagtaatattgagctatttccatttgcttggactgaatttgttcagaccataaagtccaaaataatttgtgttgagcccatacggcatcgaaatctagaagaagataaaatcgaacactcttgctagcatgcctcagatatttcagcagaaatttttttcgttgtgtaaaatggcatatttgtgatttataaagaagcaaatgtttaaggagcaccaaccccacattaaccaaaagtacatgagactgttaaaataattcatagaataaacaagccagggtcagttcttgaatttctgaaagcgtgaactggcatataatttaatgatttgttgaaaaagatagcaacgaaacattatatatgtaaattaaataaatcaaccatgattaacaagttattcaaactggaatacaaaaataaatgaaaatttagattggaaaacccttttgttccaacagatacttacatggtggaatatgtctagatcaaccatgatcaagaagttatttaactagaagcccttacagaagtaaatgaaatcgagcatggaaaacccttccattcaagccgatacttacatggtgaaatatgtagcacaggcactcaggcataaaacgaacattcgaggcctcaccccagataagaagatacaacccaatgtgaaggagcattaattgttgtttattttgtgtgactgtctcaacgttcctgattccagaaaacagaataatggtatttgaagacattaaatattgaaggatattgagaagagaaataagcaaaatcttcataaactgttgaacgtacatgatacttgaactaacatgcaaatagctacaccatgattggtagttctgaagtatctttttccataatttattcacagtgtcaacctgaaagttaacatgccagcatactgttagatttcctttttaatgtgaataccaaaattggtagctcgctaaagaaaagcacataataaacttaaagcatgaaagcatatatcttttaaatgaaacagaaagagcattcatcttaccagaggatggtcttgcccagcagtccttgtgccaatatttgcgagcagcaaaaccaagttttctctttgattttccacatttgatttctatagtgagaataattaagttcaaatgtcacaatgtttaaatacggttgtcaaacataataacatgcacataaataaaactgacatgtggcagaaaataacattgtatcacttccatttggaaccagcggaccatatacatagacgttaaaaattttacctgaaatccaaatgctagtgaaagccagtcaagtaaatctcgtatggatttattcccatccgtgtgcatagtagacatgtgtggcattggaaggccatcgatgctatttagcgcatcaatagcaccttttatctatatcatttacatcaagaataccatcattaataaaaggttttatatacaggtagaaatagtgtgagcaaggagtcaaacataggtgtgaagaattataactaacctcatggagttccacaattgcctcagatgaacctggaaagttcaggggaataatgttgtacttgtagttcttgaaatgaacactcttctcctcaatcactttcgcaatcttcatcacctataacacaaagtttggaaggttgtagagaagaatattaccagtaacaagtgaagcacagggccttaagcaacaatatgcaagaagtacctcagaatcaactttgttgtttgtcacatctcttaacacttcataaagagcagatgccacttggtaacgtctagccacttcctcactgagcattcaacatcacaaaaggtggttaaaacagatcatcaataaggaaacagctaatcagtgcattgatacttacaagtttctcttttctgatatcctactcagctcagcacaataactcttataaaatcgttgaatttcctttgcatcattgcccataacttgggtgtcgtcctgttaaacagagagtaaactcaagggttcatcactggagaaaatattatgagaaagaaaacacttttaaaatggaacataaagataattttaatcaaagtaaaggtaatattgcaaacataatcacaacaggatcattttagagttccatgccaaggatgatacacagtcatgactcatgaatgattgccagagccgttattggctatgtaaatataggactctatatgtttgactgcttcaaatgccagctgaaaagaatatttttccctaatatcaagataaatgaagtaatgaaagaacgtatttggcctcatgggtcacggcaatatattaagcagccatttgaaagagaataaggttttaatgcccctggagggcacctgctcccatttgtaaggttgtaaatgactagcaagattatctacatcgtaattgttctttatagaagacttatctaatatctgattccgaagagtaagaaaacaagagttaatagacagtgtatttacatattaaccagaacaagggtaagttcagtaccagaaaatatgcactaaggctgtttcaacagaaactcaaagagaaagatgcagattttatctacactgagggagggtacctgcaacattacaatttcagacatacctgatctagcttaactgacatgtatgttttgaactgtcgaactccacgttggactgatgatggatccattctttggactttgttgtacgcatatcggcgaccttgatacaaaaatgcatgtaggaacaaaactcatatcagaaagacctgtacatcacaatacatgaaagaaggaaccaaatagctgataagataaacaaacacggaagcaaccacctagtaccaaatcggttcatgaatcatgatgcactatggcatgcagtgaacaaatttctagttagcatttgtatcaacaaaatgaattcatgattacttttataaaactgtcgtgtgtattgcacggtatacccaactactagctgtcccaagtaaatttacacataaaagtgcagtatttgttgagagttcagcttctcatgacttcatctaagctttgatggaagtgaaggattaaaccatctgctctctgaaaaaaaaaactactcaaatccagcataaatgtgcctttgcactcttgtacactgaaaagcgagaactcctatcctgtcccgttataaagtaggctatcaaaccctggtatgcatatgagttactcaggccataattagtcacacaatcaccagaggtgcatgtcaacatgaatgtctgctgtacacaacaagcatgggtaaacgttccaacgaaatatgaatatcgagatcgcaatgtaggccaaacagtacaaagtttagctgtataattttcaggacctcccgctaataatctgtcaaggtgtgaaacaaacaacccaacccagccaactcaatagtatgcactatgcagcatggaaatggtttgcgcttgcgcccatcatattcggggggatccact

SEQ ID NO: 60868 - DNA, 2136 bp, Oryza sativa
atgattagccacatgtaaaactgaaatgtaattaacatataattattaattattaagaggtttaaaatatatttgttttttttcaaattaactgctatctccgttccaaaataattataattctaaattgtagagcatatattaagatattaagatttgagaagaaagattagaattgtgtaaatatatataggtaagaatgaaagattggttgagagtagaatatgaggaaatttgaatgagaaatgattaatgagataattaagcaaatattttataataaattaaaattttataatataattattatgggacggaagtggttctaaaatgattgtttttatactaaacgtattattattcagctgttcaataaacgagacgtcagacgtgcactgatcagtttctcttgcgccgcccgttagttttcccaacggctctgcactcttgcgggtggatggtgcgtgccactgggcttggctgggctggaaagctgacgcgccaccgccacggtggactggaatcgtatactttgggcgttttcgagcaatctccgagcgatcaaaagatctgacacgtcccgtggtccaatgtaatccgattgcagaggtagtagaagtacctactttttcagttcaaatttaaaaaagaaaagagaagggcttttttttttcagttcggtactttggcaaaatattactccctacatctatcctacatctacatatagtcatatttcatcttggcacacagaccaaggataagtaactctacttatcatttatttaaacatgctactagttattcctcgtaaacaagtaatttattaatatttatatttctcgatgcctatgtagccaatcttgtgtgaaagaattgagagtcacgaattaaatccgagaaaatcattaagaggataggttgttggattaaaatatgcctatcaaaaatatttttttcagatttaaaatatgactaccaaaaatagatggaggagtattgtactcacttagctttgcccgatgcttagctttgccatgtccatcatgagtgttgcgttctttatagtttgtacaaaaagcgtttggttgaataatagacctagattgcaaaggtggagcaattcaaaattcgtacaagaacatctggctcttttagcccagaaaaaggtacacgattcagcccaccgtcacctgttataaaatatggttaattggatcatcctattataaatttacccgttttaaaatatatcattactatttgcgaaattggaaccatgccattaaaatttcacatatacttcagatataccactacttacctattcactgcatttttcatatttttaggaccaaattatccattctccatccatccccttcttccttccccctctctcctctcttctagccgatgagctcacatagtggaagggttgcaacaagccaccgtcaccgggggagctagaagagagtggcggttgcagtgtccatgagctacaggcgaccacaatgttagagcctgtgtcgagggcgaggactgcagccagcgctaatctccctgtgcaccgccgcttcttggcttgttgctccagcgacgctgagtcacgtgggtgagtaagctctaggtgtgagatctcggcagcggcaaggtcaagccatcggatctagaggcaccaccggtcctctccagctccaccagtggtgcccctgcaacagctcttccagcactatagctgcttgctccacaagcctgttgtggagtgaaggcatgccccataggggcaacgatcggccgcagctagaggtgagaggttagacagagaggaaaggaagaagttgatggaggaagaagacaagggtattttggtcaaaaaaaatttagaaattgcatcaaagaggtgattagttgcatatctcaaacatctgttaaattataatggtagtttcgattttgcgaattgtagtggcatatttccaaatgtgctaatttataatggcatggatccaattaggaataagttcaccggaggtcccttaacttaacagcgagattttttaggttccttaaccataaaaccagaaatatgtacccctaaactcacgcaaccgtgcaaaaaaggggggatccact

SEQ ID NO: 60869 - DNA, 3288 bp, Oryza sativa
tcctgcaccccctgggttggtgatggtgagctcgctctcctgcgatggcatcacgatgcctgcacagctgcctcgcgaccttccactcgccttccgctgctgcggtgctatctggaagcaaaccactagcccgctacactccacccgctgtctgaggccgtgctcgccttccgcccgctgccttgccgccacgctcgcccgtcgccgctctgctgctgccccctacctgcttcgccttccgctcgcttccgatgaaagggaggagcacgacgaggacagggttgctctgcccgccgccgtgctcagccgccgccgctccgcccgccgccgcgaagtggtaggcaatgtgggtggcagcaacgcgcgagtcggcggggggcacgacgtcgaactcgtccgccacgctcgcccgcccgctccgctcgccgcctggtgccgctccaccccccaccgccgcgcggaccttgccgccgcgctcacccgccgcccgcccatcgtcgctccgcccaccggccgccggcctccctcactgaagaagagaagagagaaaagagaagagaaggagaagaaaagagaagaaaaaaagtgcagctgacatatgggctccacgtactttttttaatttcttttgctgactaggatgccacgtcagcgaaactacctatatatactgcaatatgaccttgagtgcatggtttgtatgagtttaatggtacacatttgtttcgtggttaagggatttaaaaaaatctcgttgttaagttgagagacctcggtgaacttattccatccaattaaccccatgaaatatggccagagctatagctagcgaaatgggccgtgctctgtcaggacggcccatgcacgatgtcgttacagcccaggcacgatgctacggcgaaagtgctaatgggcggtcagtcgcgcgcgggagggtgcgcgcgactgaacacgtgtcgcgtgcggagagggggcgcggacggcacgcgcgtggagactggagacgattttttggggttttgttctgtttctgtttggttttttttccggttttcttttggtttctctttcttttcttttttttaaaagatgtacgtttgcaaagtttgtattcgtatgtataccaaattttgtattcgcacgtatacaaagtttgtattcgtgattttttctctcagattttaatatgtacatatacaaagtttatatacacgtacgtaaagtttgtatacgcgtatacaaactttgcatacgtgtatacaaagtttatatatgtgtacgtacgggatgcaagatttgtatacgcgtatacaaagtttgtatttgtacctacgtataaaaacctaaaaaaatacatgtatataaattttgtaaatgtgtagataaactttatatacgtgtatacaaaattggtatacgtaggtataaaaacctaaaaattatatgtgtatacaaactttgtatacatgtatacaaaattggtatacgtacgtataaaaacctaaaaatacacgtattcaaaatttgtatttgtacgtatataaagtttgcatacataagtattaaaaaaagaaaaagatatggaaagaaaaaaatagaaaaaaaacaaaacggaaggtacggaagaaaaactaaaaaaaagagagagagaaacccaaaaaaaaacaaaaaagaaacgaaaaacgcgggcgcccaagagaaacgagaaaaacagaaaacacgggtgctcaagcgacacgttgtccgccgcactagtagttgagagaagagactagagaggttagaactaattgtgcggggcgcaaggagcgcgactgatctcccattagggctcgccatgctacggtacgcagctcggcaaggcacgtttcctgggccgaggccactgcctgtgggctgacacgacaccacacgggtactatagcgggctggcatggcccgacacgacaacggaggggcccggtatggcacgacaagtccatatgctgccgcccgtcatcgccaaacctcgcgcgcctgtcgcctgcgcgattcctttttcttccttttctttttctttttaactttctcgatcaagccgtcgtccacgcgattcaatttttcgctgaagagaactgcggccgcggccgccgcttcaacgcgacggctgccctcccggacgacgtgcgccttcgagcgtcgagggagctccacgtgccaatgacgggccgtgccttggggttggcacgacacggcccgctacgaaaaccgtgctgctggtgggcctgtgccatcctgggccgagctgcccgttcggccaactatagccagagcacagtgcatattaattgcataattaactgttgtagaaagaaaaaaaagtgaaccatggggtatatgatatttgaagggatgaaaatactctcgaaatcggtaacatctcttcgaaaacaatgctagatctgttaaaattgaccatatttatcaatgtaactattaaggcagtgttcgagaggagtggttgggaacccctcctcccgacatataaaacgaagcacatattattgtaggattaattaagtattgattattttttaaaaaaagaattaacataatttttttaaaacaacttccatatagatttttttagcaaaaaacacactgtttagctgtttgaaaagtgtgcacgcgaaaaacgagagaggtgagttggaaaaactaggagaagaacacagcctaagtgccaatatcttactatgctaaaaatttttgaaagatcaaattttataatgcctaaaaattgaaactgaaccacgtatacagaacgaagctcggtttgtctggaattttcgtgaccatatatatcttcattcttagatgagtaaatttcacaacagtacatataatttgttcaaagtatctgtattttttttaaaaaaatttactcgatatttctttgcccgatgtataagtatctacatggtatgtataggtattcaaaataatacatgacggtaaatactacttcctctgtttcataatgtaagtcattctagtatttcccacattcatattaatgttaatgaatcttcatcaatatgaatgtggaaaatgatagaatgacttacattgtgaaacggagggagtagtataccaataatatgatagtggagttgtcggtgacatgggatcaggagtatcatgactagaggtttgaggcagacacaatcgcacacgtggcctggtacccccgagggacgtcgggcccgagggtgatgcgttcgccctcctcttagtccccccgagggg

SEQ ID NO: 60870 - DNA, 1477 bp, Oryza sativa
gtgtgtgtgtgaaaatgcagatttgcactcaggttcacatgtacctacaatctgcaccgttgatgtgtttcaagattcgtgctgcaaaatgtacctaaccttaaccaaatgaatgattactgtagggagaaaagattaggattaggttggttcacaatatgtataacatgtatgttgtattttttaccaaataatttttttcaataataattatatatatgacatttatatatctagtgcgctgtatttctctaaccctttttgttacgcggagcacgcggagcaactacaacaatgcgtaagcattcaatatatctagtagatccatgattttttttatccttttctaaatatgtttcatatgcttcatcttaagagaaaaaaaacatcccagaagtcatagagtttgtgtgtgtgtgtatatatatagtgtatctattctacacccctctcctatgggccaaacccacctcccctaccctccctagggcccaaaacccccctcccacctcagtcaaagcgtcctcccgccggtcaaacccgcccatcactccctcccccacccaccactttgctgctctcgtcttgcaggaatcgtggggtaacaggacggtcatcgtgcagtaacaagaccacattatcgcagtaacaacgtcaaaaagtagccatgatggatcttgtttcgttaagcgtttttttatgaacttcatggtgcacacggattggaaatacaagatatgatgtgagagatattgctctctaaagattgagatttacctttttttagtcctcgtctcactggaacagcgtagtaacacgatggccaatatgcagtaacacctctgcttttcgcagtaacaacgttaaaaaatagttatgatggttctagttccgttaagcactttttttacgaacgtcatgatgcaaatgggttagaaaaataagacatgacgtgtacattagtactctctaaagattgagatttaaaatactctagatctaaaaaaacattactactatagggccactgttactatgcatgttctctgttactgcaaatttcgtcatattgttactgccaaaagtgcagtaacaacctataaagtttacagtaacaacttatacatttttgcagtaacatatgatgttactactcttctaggataatgttacttccgaatcatagtaacaaggtatgattgttttaggtacataactgatttgttcacaaatcatcatatggtgatttggttagaagtgcttggcatgaaccatgagatcatgggttcaagtcttgaattcaccaatttatttttaatttttctaaaaaagagagaaggagtgagagaaaaaaaaggagggggacgcgggagagaggagcgatgggagagggagtgctggggggagcgatgggagagagggagggggcgcaggaaggaggggaggtggggatggataggaggtgggaggggggtgt

SEQ ID NO: 60871 - DNA, 2435 bp, Oryza sativa
tgaccggcgggaggacgcattgaccaaggtgagggagaaagagcccagaggacggtaggggaggagggatagacccatggaagggggtgtataatagagctatatatatatatatatatatatatatatagtgaatctattctacaccccctcccatgggtcaaacccacctcccctaccgtccctagggcacaaacccccccacctcggtcaaagcgtcctcccgccggtcaaacccgcccaccaatccctcccccgcccaccactttactgctctcgtcttgtaggaatcatgcagtaacagaatggtcatcgtgcagtaacaagacaacgttctcgtagtaacaacgtcaaaaagtagccatgatggatctagtttcgttaagcgtttttttatgaatgtcatggtgcaaacggattagaaaaacaagatttgatgtgagagatattgctctctaaagattgagatttacctcgtttttgtcctcgtctaactagaaaggtgtagtaactagacggccaacgtgtttccacagtatcgacgtgaaaaaatagttatgatggttctagttttgttaagcacttttcttacgaacgtcatgatgcaaacgggttataaaaataagacatgacgtgtacgttgctgctatcaaaagattgagatttaaaatattttatctctaacaaacattactacaatagtgtcactgttactgtgcatgttctctgttagtgtaaatttcgtcatgtgttactgccaaaagagtctgtaacaatctataaattttgtagtaacaacctataaattgtgcagtatcgtatcttgttactactcttttgggataatgttactaagaaatcatagtaacaaagtatgattcttacagtaacataactaattttttttcacataattttttacaaacatacaaaacatgcaaacatcatatggtgaattggttaggagagcttgccatgaactatgagattatgggttcaaatcttgatttcatcaatcttttttatcttttctaaaaaaaattgatcgatcgagagagagagatcgaatcgagagatagagagtacatatatatacatatatatatatatatatatacatatatacatatatatatacatatatatatatatatatatatatatatatatatatatatatatcaaaatctccacaaaatttggacgaagctgaacatacatcacgctgatcgggagattatacagatatagagaagggaatggtcaagatatgttgccaacatctagtaacgtgtagagattgaatcaaggcggatgattaataaactcttacaaacaaatatcccaatcgttgaatttaattagtgatgaataattgtcagaaatcaaggctcaatagtaaacaacttttgtgcgtttatcattttcctaattaatttcatttggtagcgtgcgtaggaagaagtcaaataatatatctctgtaccggcatataaagtatgggcaaccaagcgactttagatgacagtatgcatgacatctaagaaacctttattatataccaaaaaatattcttattgcttacctctaagatcagataaagctccccagatccggttaattagtactatagtaatcaacaagcaagtaagtatccattacaggatccatcagctatgtaccgtatattggttccatttttttactggtattataattaataattgtttaattctcttccttgtcaacgcacttgtgcaatgaattagcgactaacctctatttttctaaacatagcgcgctgaccacacacacacttctagcttctagaagctcatctctcgggctggccatgacaagatgccctgccaacaacgaaaacagcgggactttttttattcccccaaaggacctaaacgtggtgacgcctcactgcagacgcaactgcctcattatgcaagcgagttcattaaaagagcctataattgatatgtgcatttttccaatattggtaggaatcttcccctaaaaaaatatagtacaaaagagcatggataattaaacacaacagcaacttacatgatattctaaatacgcgcgggagattgtgagtttatgacaattatttaagggcacacatataaaataaatgttaaaatgttggaaagtcatttaaaaataagagtaaaattcaccaacggttcttaaacttgtcaggagatttcacttaggtccacgaacttgcaaagcgcacatcgagatccctaaacttggtttattttatcatcccggtccaaaaccgcgtttgaccgtggtcttgcctacgtggcacgctacgtgaatgatgacatggatttttttaatttttttttctcccttcttccttcttttttttaccactgcaacaacccttccccccgtgccgcctctcacca

SEQ ID NO: 60872 - DNA, 2862 bp, Oryza sativa
aacgtgttcacgtgctagtcttttcgcccaatgggataatctttatattcggatgagatgggtctagaatgatgtgaataacctagcatagtcttcgtagatttgtgtggtatggttctctgaaaaatttttaacatcagcgccgtcccttttaactctgcttaattacacggacaaacttttgaaaagattggcccacgttggcggaaggaaaggggaaaaaagagtaaaaaggtgaaagaatagttcactttgtgctcacgttgctttggtagtttctgtaaaataaatgttttggtactgcaagaacttgtttggtgggtacaaattagtacacgaaattataaaacgctcgttttgatagatggagttctcatagtacatgctaaccaaaaccgaaatagcatggcaaggctaattttatcaacttggataatgattaggacgtgccgtgcacacttgcttgatattttatgtcttcttttctttgcaattattatacccttattctatcgtttactccttccatgcagaaatatagccacatttacttatctcaactaatcgcaatcatcattatttagtttctccacttattttctcatttcaactaattataaccgttcatcacttcacctacctattttcttaatatccgtgcatagcactgaagttaggacgaatggaatattaaatatactagataatgccctgtactttgctatggaatatttgatgaatatatgtaaaatattgtacaaaagatggatggatttgggttgaaatattgcgaaaataatatgaaaatgatgatttaatatgcttatatgtttagttttagatttacttgctatgtttgcatgttgaactttaaatgcttagcggattgatgtggtatgcttgtatattaggctttaggatatactaataattaaggcatgtttggtagagttccaactcctaaatttatctctaggagttaggtcttgagtggagttgtggagtagcctaaacacaactccacctctctaattcattttgtgagagtgctttacccagctccgctcctattttaggtggagctgaaactgtttagccaggctccagctccaggagagatggagctggagctgtgccaaactggtctttactatgcttgtatgttgagttttaggtgtagtgggttgtaactatatagaagatatgcgaagtgagcatcaactggttaggttccttatggtggaaccaacccacccgggttcaaatcctagatttgacacgggtgctcgcatttatggctaattattctttcagtggtaggcgatgtactcgtcgacagcgaggcgcctatggtgacttcgtcaatttcaagacatgccggcccagtcttccggaggtgttcataggggtagggtatgcgtgtgtgcgttcataggggtgagtgtgcgcacgttgtgagcgcctgcatttgtactgtgtttctaaaaaaaactatatagaagatacaaacatgtctagaagatacaaatatgttttgtttatatatagcatcctaatcaatacttcaatcagcgagattagcaataccatattcttttggtcttggttcatacatactagaaaacctttttgcaccaaaacaaacattttgtaagtttatgtgatagattacattcacttgataagtttgtatatatagcaccaatataatttactcagagagaaaaacatttaaagctagaccaacttcaacgtgcagagttaatatattgatagttgcttacaacgtcgttacaatacgcgtctttatctatcccaatgcatggaggtgctatatacatgtcggtctgcatcataaaccaactctctgcgtgcataggcatgctcggaaattccatagcacctctgaggtaacaacgcccatggcagcccacttaccttttcttttagaaacgaaaaaaattccgagggcgcgtacaggattagcgcctcctcgaaccaagttggaaaaaacgtcagtaagcagttaattaagcacccatcgaagtaccccgggccagttgaaatttttagtaaattcgtcctcaacgtatacagggtgaggttttgtgaaacattgtaataattatatatacttgtagttatatgtcacaagtcataatacctatgattttctgcaacttttattataaaacgtgggattttcaaattttactctatttttaagtaaattttaccacatgttttatgatcagagttttaaaaaaatgatatttattataacttgataagcataaccatatgtatggcttgttcacttgttatatgaaacccttatatatatataccataaatcatgtgctataagtcatgttatatgtggatatacctgtaattttgacttaaaacttgaggttttctgaaactttctcttgttttttaatcccaaaaaatgcgggagaaacttgtcaacggaattaacagttgcgatagtacctatatcatgtattctatatacaaaataaaaaatgtactgctgcatgatattcttaagtattaattgtacttattatatcattttttatgcatttatgaccataaattcccttgttctgactgaatatgcatgatatacgactataaagacacacacgagcatcatatcacgtttctaattgtacatttgtacttgatataaatcgtgcatatatatgactataaagctaaactacaccaccatcctagctatcccatcactaaattgtactccctccatcttataatatagaacttagtaacacaaagtatacaagatttaactgattttatgagagagcatcttgctcaatgtggctgcaggaa

SEQ ID NO: 60873 - DNA, 2298 bp, Oryza sativa
tgaaacagagaaagtatatgttagctaaacttctttcagaagaagaaatcaaatagaagcgataataacacaaaatactacatatgatggctaatagtaaacactgggaaaaacttatgattcgggaaaaatcgaaggcaataatacgctcaaatcctacatcaccaacttttataactttttggactacatgaggatacttctgttactctagttgaatttagggctgaggacatatcccacgagacaaacgcacagggctggtcctgactttttaggtgtcgatgcgaaactaaacatagaggcctttatcatactatataataataatcgatagatacatatactttatacatatgaattattgtcgtaaatatttaaattgcatttagaaataatatttatatagaaaacattgtacatgttacctcaaaaaaatttctaacatttctagatgcgaagtcattgataatggtaccaatattaatttcatccaataatttcttctcaatgcataaagctgccaaaccatttgacctttttttttgtacaatgaatatctcaaatagttcttcaataatttcaacttcgaaaagcttctttcagtagatgccacagtcacgagcacagtaaataagatccgataagcaatagaaatattagggtaacaatttgcatctctgacaaactcaaatatctccatggcagacatatggctatctggcaaagtcaactgcataacacttaactcagaaattagatcattttaactcaacatcagatgaaccccctagagagattattatttttattatttttttgcaaatttagtgcaactgtcttttagttcagcaccatctaatgacttcaagaccgtggaactcataaaatccccaatatacttttgaattcttgaagttcttcaaatctagctttcaatgaagtgattgccataccaaccataaaaaaaagtaatcaactttgaaagccctctcagcttgcaaatttacttcatcactcacaattgcatcaaactgtctctttctggttgcatgacactttactggaaatgatgcatttacacccaattgagatgcaatatctttggctttgatcaaactagaagcaaacccctcatttctatacttgtgaaagtaagtcattatgccttctatttgctgtaaggtggacttaatgcacaagatggtgactgcaacttcttactcacagtgtttacaacaaataaaatgtcacgccaaataatcataccaagtataaactaagtaccaactacctcaaataatttcttttgcatcactcctatctttgggttcgataccattagattcccttaactgtaacaaaactaatcttagcttatgagcttgatatctagttgctttaatacttttgatttgactctcccatcgagtattgcacaatggtttcactgttaaacttggaacatgttcaagcaaaactttccatctttttgttgaaccggaaactaacacatatatctgttgcacaattccaaaaaatgaaatagctttagcacaagatttagccatatcagagagagtaagattaagactatggcaaacacatggcatatacaaagctcttggattaatatcaagcaattgtctttgcacccccttttattttcctttcatgttagagccattatcatagccttgacctctaatatcatcaatactaagaccaaaggacttgatggaatcaaccaatacattgaaaagctctgaatcagatgtatcatccaccttcaaaaaacccataaaatactcctctaattttattttgccataggacatattaacacatcggaccaacaaagtcatttgttcttgatgactcacatttggggtggaatcaatgataatagaaaatattttgcctctatgatagattttgtgatattagaagccaagagagaaaaccaactcattctgtattttgtgactaagataataatgataatgtatctcgttgttctgaatacgtctaagatgatcttgcatcaccaagtcaaactctgcaaccatctcagcactagctaagaaattgccattctgatcattgtaaagttgctcattggatcctttaaaagccaaattatgtttactaagaaatttgacaatagcaattattcttataaaacttatcgtatacgttttttctccttagcaattaatgttgcaaatctttgtcaattgtttcatttttttatcaatctagctcttaattcatccaagaggtcatgttggtgatatg

SEQ ID NO: 60874 - DNA, 1062 bp, Oryza sativa
cccaccccctagggccggccttgcaaacgcgtaaaatattaccaaaatagaggagaactagtgatgcttgtaatgcataaatatgttagaataataatattccactagtattaggtatactaaccttttgcagaaaatgacaataaagtggaggagaatcgacatcaactcagacgataaatcaatcggacgatgtctacaatcagacttatgtatgaatgggtcaagaactcagaattggcacgatgaattgggccaaaattcacaagtctgcatatgagagcaaaagaggaggctgcctgtcacgcctggaatttctatccaaaattccaaacgcttacatgtgcgttaaatcctcgtccaggaatcagccgaggcacacaataacaaattgataatagagtactatcaaacagctaattaatattcgcaaaataaataattattacagaggtggatagttcctctcaaaagaataaaactctacgcagcggaaaaaaaacaaaagactaaacaactatggcgactccactccacaagcaacttgacccgcacaaagcataatcctccagatcatcaccttcactgaagtactcctcctttgatgaatgaatattgcaagaatgagcatatgacatactcaacaagccacacagcaaatatgcaagtgcacaggataacaaaggatggcataatacagctcaattgcataaacaacatttaataaacatttgagaaaatagtaaaacagttaagtaattaagcaatattaaatatacactatacaacacacccgtattgcataggcccaaccttatctgaacaaccaacccagttgtataaatcaaacctccataccaagaatataccattccaaaccaggagtcaatttaattatcacaaattatcaccaataatgagtagtgtgagactaatcacgaaaaacattgttagacccactcataaccgcgggcacggctattcgaatagttttactctggccagagatgtaccactgtacccacaagacacgattccacacatgttgccatgccccgaagt

SEQ ID NO: 60875 - DNA, 7105 bp, Oryza sativa
taatacagaaaatattacgaattaaataaatgatttatgatgtcacgatgacatcatcgccggcctagcactggacgacgcggccaccggcgatagagagctcggttgggctatccgaggacacctacgcgaagaggacgacgacgcgaactcaccggtgcaaagaacaacgacggacgacgacgtacggcggccggcgacgagctccgacgacggcacggctcggcccgacgtcgacggcagcgctccagcggcttgcgacggcggcgaaggggcggccgaggtgctcctcctccgcacgaacccgacggcggcgacggggagcggcggcgacggctacagcggcggcgcggcttggctggaaaggcggcggctagggctacgcggcggcggcgctacgggcaaagatagagctcgggacttgaggggaaacgtagaggacgactaggggatgctttatataagcttggattagagagatcggactctaaccgagaggaatcgaagccggaaaaatctagggttagtttggagagataaactcaaaacgaattcgattcggtttatccgggcaaaattgatctccgaaactttaggggaaagggagaggataaggaggagatgatttcccctcaagcaatcggactcggagatggccggttgttgcggaatcgacgaggaggcggcggggctcgggcacggctcggccggccggaggtagaagaagacccgacatgtgggccccacatgtcggcggcttgagaggagggggcggggcggcggcacggcctgggccggtttgggccacaaggcgcacgcggctgagaggggagttaggccggaaatggcccaacggcctaggggagggttttaaagactttcatttaaaataattcgtgaaatgatgtttcatttattaaaaatactttctttgctcaaataattcctagaaaaatctagaaaatatataaacaagcaaagtatttaatgaaattttatctagctcagttttatgtcgaaatttttcctagattattagagtttaacttgtaggcttttaaaataatttctaaaaatgcattaaagaattaattattaaattaggcgattttcagggcatgacactgcctgctgaaattgggccaggttggcccagcccatggttcggccgaaccccccgcagctccgtttgatccagggttctcttggacggctgagatggctccccaatgacggttggagggtattaccgaccattccaaccgtcacaaccgtcattgggaggctataaaaggagctctcatcctcacttcactcacacacctcaagcaaaagctctctcatttctctcaagtttagtttagtagtatctagctggtggaataggaatagagtagaaatcaggagtccggaagccttcggaagagttcgggtatagctctactagcttttctcttctcttttgtaagctttgtacttttattagaatactcttctatatacatttatggtattgaaatactttatgagtatatgaatgcccattttacattatggtcatgttatactgaatatacggctagcttatctgggagatgcttttatgcgggtataatgtttgcatatgcaattactctatgtcatgacgatgatattatagtagtatatggtagtttagacgtggtgtctagattaccggatatcattatttggggttatatattgcggacgaaaggtgggccgctgatggtgacagctcagtacgggtattcctccgcgccggtatataatcataagttaattccctggggagggtattccttcatatttagccccggttgtatcgtcatgacgggttgtcgtaaggaactcggcagtcaggggtggcttctcaaagtaccaggagggcatcggatagagggtattagctagtatatcagttaactagaatgtatgaatactatgtatattagaagtataggaatatattttctttctcttttccgtccacttagcttagataatatataatgagaatgagtagttaatgcttgtgtgtcactctacccttgggattatcttaacccttgcctagaatatgattatcacaagtaatatataaattattagtcaagttctctctacatgatcttctcacgggataaaataaatacgatacccttggaatactctcgggtgaaatgctacaatggtatatccgtgcgcttgcggatgaactctgtaaccataatataccataagtatttctgcgtcattgttgggaactatatttctagtaatgtcgttaagaaataccaacaagcatttctggcgccattgtcggggaagattcataatagagattacctgaactaatattttttatttacctttgtataatcattttcctttgcaggctaaccttagttgttttcacttagtgcatgattggtttcaacctgccggaaaacttcaaagaaaatccagaagctttcttccggagcgtcaggccgcgagtcgctgctccacagaaaaaactctaccaatagagaaaccagccgtaccagtgccaccgaccttcaagactatggctaagaagactctccgcgagttcgctactccctctgctaacaatgtggccattgggccgtagttcaacatgggagacgtggatttcaacttgaagtccagcctcatcacgatggcgcaggctagcccgttctgtggcaagcctaatgaggatgccaatgctcatctgcaacagttcctggagatttatagcacgtacactatcaagggcatcagtcccgacgccgtcaggctgcggctgtttccgttctccctcctcgggagagcaaagaagtggttctacgccaaccgtgctgctgtcaatacctaggacaaatgctctacggcattcctctcgaaatttttcccgatgggcaaaacaaatgcccttcgtggaaggatttccagtttccagcagacaagggacgagtctattcctgaagcatgcaaatggctgcaggagtacgtagccgcctggcctcatcatgggatggacgactggctgatcctgtagaacttttataatggactctcccagatgtcccgcgatcacctggacgcggcagctggaggagctttcttctctaaaacggttcaaggagccgttgatctaatagagaagatggtctccaatacgggttggagcgaggaatgacttcagacccgtcagcgaggcatgcacaccgttaaggagacgaaactactagctgccaagctagacctcctcatgaagcggttggacgaccacgagaaatggccacaaggcaccgtcaaggccttggactcacacgttacgtgtgagggtctgcggcggcacgggtcatcctgggaatgactgcccggaaacccgtgagaaggcgatgtacatggggggtaccgtccacaaggaggtcaagggtggaatcaaccacgcccatattatcaaggaggtaacaacaacaataacttttctaaccagccctccttgaaggatctagtttttgcacaagctaaaaccactgatgcgctaagcaaaaaacttgctgccactgacaagatcctagaaaacataaatgtcaagttagatggctttgcttctgcttttcaaaatcagctgagcttcaacaaaatgatagaaacccagctagctcagttagcatctttagtccctgcaaatgaaacggggaggattccggggcaacccgactcctccgttgaaaatgttaaggcgatcacgatgaggggaggtaagtcgactcgtgatccgccgtatcctaaccctgcaggagctactgggataaccaaagaagcgccatctaatgactcggctgacaaggaggttcagccagaaaagacagtgccgcaggagtactgtgacacacggttgctgccgtttctccaacagatgaggaaaccgtcagtggatgagcaattcgctcgttttgttgaagtaatccagaagatccacatcaacatgccgtggttagacgctatgcaagtgccagcatacgcccgttatctcaaggacatactcaacaacaagagaccgctcccaacaacggaggtggtcaagctgacggaacaatgcagcaacgtgatactccacaagttcccggagaagaagaaagatccggggtgtcctacgatcacctgctcgatcggggcacaactgttcgaccaggccttgtgcgaccttggagccagtgtcagtgtcatgccaaaagacgtcttcgacaagcttaacttcacggtgttggcaccaacaccaatgcgccttcaacaggcttattcatcagtacgttacgggacttcttgtatggtcatgacgggctgtcgtaaggaactcggcagtcaggggtggcttctcgaagtaccaggagggcatcggatagagggtattagctagtatatcggttaattagaatgtatgtatactatgtatattagaagtataggaatatattttctttctcttttccgtccacttagcttagataatatataatgagaatgagtagttaatgcttgtgtgtcactctactcttggattatcttaatctctgcctagaatatgattatcacaagtaatatataaattattagtcaagttctctctctacatgatcttcccacgagataaaataaatatgatacccttgaaatactctcgggtgaaatgctacaatggtatatccgtgtgcttgcggatgaactctgtaaccataatataccataagtatttctgcgtcattgctgggaattatatttctagtaatatcgttaagaaataccaacaactggaggctctcttaaggaaccatccatacaaacagatatccattttttttatttttgttgccacaaaaagatttgattttgttttcatattttagtagtctgctacagggttgcatgtcacaagtcatgtaattttagtcgcgtggagtatttatgattcgaaccgaggacctctcactcaccgtgtagcctcctcatcatatcctttcaacttcatccctctaaaacttataacacatattttatactctaaatgatatcaaatggaaaaattatcaaccatgaacgtgtacttcgcgttgagctctaagcctttgagaaagagcatatctctattcgagctcatttgaaaaactcaaaaattcatctttttttattcaaaataaagctgagagtttgtaatgaatatatggccctctaaactatctcaaatgaagcaaatgtttaactacgaagttgtgccattgagagatacattgttcatataaattttgtcatcatctaactcaaaatttcttttttttcctattttagtggtgctccgatttttaagggtggttgttgaagagaaccgtccatggaaatcgatttttataaccttccctcataagaattgcccgtaaaaaatattttaagggtgttcattaataattcatcctgtaacaatcattttaagattttaagggcggctcgttaataattctgccaacaaataccttttttctttatcctttcaaaatgtttaaactttaaaaatttataaaagaaattaatttaagtccgattgagatgaaaaaaagtcactactggagaatgcctcttctcttccggctggcaaccccctatagtcccggatagcaaaccggaagaagaaatccgggactaaagatggtgatctttagtcctggtttcaatacccgagagtagagatgcatctctacttccggttggtaacaccaattaggactaaagatcgctatctttagttccggttggtgttaccaatcgggggtagagatatttttttctttttttatttgcttgtggaccattgtttttagctatttgcacttgtttttcagccgaactcatccatggttcatctcccaacatccgaaatcatgcacaatcccaaatcattcacaacaacaaaatcatcatccataatctcaaatcattcacaacaacaaaatcatcatccacaatctcaaatcatccacaacaacatatatagtcaacaaataatcatccataaattaagaggaaaaaaggaaaaaaaataaaaacattggccagccctctgcgtgcgcccggccgcctgccgccgcactcctcaccggccacggctgccgtgcagccctccatgccggccaccacccgccgtgcctccccgcgtcagccgcaagccagcccggctcactctgctgcatgcgtgagaggatagaatagagagaggaaagggagaggataagaaaagagaggaggaggataagggaagaggtggttgctagaggataagtgcgagggattatatactatacgctgatttttagtccaaccgggaataaaaagagtggggggcggacactttttctaccgggactaaaaatgatatttagtcccggtttaccataaaatggctgtaggcttttcaactggggctaaagatgatttttagtcctggttctttttggaaccgggaccattgtgattttcagccaacccaacaaagatcagttctctccagtagtgagttttctataatctttataatatttacaatattttgtttaatatgcctgccatatttccttgataatacttctttaaatatgattgtctactcatgtcttgtagtctctatatgagagttgatatgttatctaactaagatatttcaaaattaaataaaaattaactaggtcatattttaaaaatagtgtaagaatataacttttatttacctcaatcttaatatgaactttctgaaaatttgaaagctttaaatttctaaagaacaccttgtaaaatataccaaaaatatttaggcacttaaacaatctcaaatataaaaaatttcaactatacagttgtagatttcgtcgaggtctataattttagtgtagaacatatctccacctaaggtcgtttgaagaaaaaacaatattttttttctaaagtagatatgagaacttgtaatgaatatttagcccctagaagatatgaaatgaaagaactttcggctataaagtaaaggggg

SEQ ID NO: 60876 - DNA, 1087 bp, Oryza sativa
ctaattgttaatgtttatattgctatatctgtctataaatttaatcaaacttaaagcagtttgattttaagtcaaaaaaaaaacatcatgtaactagggagtacgtcgctacatgagcatctatcaaatgttaccgctattgaataactgaaatgttttattcctttcgccccgttgaggcgttgacgttgttggagcatcactgtcaggagctcccgctcatttcattagttaccagggggcgctcgccaatcagagtcgtgattaactttgctaatcataattaaactgcagcgcgatggagagagcgtcgtcgtctccatcggccgtctccccgtaacccgcatttattagtaattttttttggcttggtgcccaagcctgtgactcacaaaccaagcaaccaaccgtactttcttttttatacacgctgccggccgctgcaacgtaatcatatatcgcgtgtagagattctccattctctccacgcgcacatggcgaacgaattgacctgagagaggtgaccgatctatcgatcagagagctagctatggcggcggcggcggcgcgagaggcggcggacggcggcgacattaatgggggtggaggaggaggaggagagaggtcgtcgagccccgcggcggcggcggcggggaatagcgacgtggggcgcgtggcggtgcggcggatgttcgcgttcgccgacggggcggacgcggcgctgatggcggtgggggcggcggcggcggtggcgaacgggatggcgcagccgctcatgacgttcatcttcggcgacgtcatcaacgccttcggctccacctcctcgccggacgtcctcgccaaggtcaccaaggtgcgtgcgtgccttctgcgtgcgttgctgttgctaccccggtgttgccacctaacccatcgatcacctactgccattgctgggtgaaaacgttaccatttaaaaaaaaaagagaaactaatataataataatattttttatcaacggttactgtttctacaatttgttttttccaatttctaagttgatactaaacggttgaattcataaatataaaaatttcatgactgttt

SEQ ID NO: 60877 - DNA, 3376 bp, Oryza sativa
cgcgtccgccggagcatgcttcgccctcggcggcggcggcggctttccgcggccgcgacagcgagtcggcagatgcagcagggctatctgagccaaccacgggtggaatgcggtattccctgataaacccacgaatctgattaccagactaggttttgttgttgttagtgtagtttgcgatctatttgaggggcgatgatttctttctaagttgggatatactgaggtgaaataggcgttattcgtgctttcagaatgggcaggattgggatcaggtggtcacttggttgaaattgccttgatagttttcccttcatttcgattcgatttgggtatatgctagtaatactgtaaatctgtaatagtaagctacgacggcatgtaggcgacttattcttgtcaataatcagttctattttcaaaaatgtgtcagtaataaggttgataggatatgaatcagtagccaacaagacattccaatcacaatcatagtagttgtatcgacgaacagaatcaatcaatcacaatgtattttcagagttgcagcgtatagggcagaggtgaaattatcggtgcttgttttgtcatgtaaatgttttttcaacgtcttaacctctgaattaaggtgctctttctttttttctcaggtgattttgaattttgtctaccttggcattggagcaggatttgtttcaactcttcgtaagtggctttccaatgcaacgaaattaggacatcttaatatccactgttggacggaaaccatctctttttggattacgaatttgatgaataataggtgtagtaatgtacttgtgtttctgtattgatactacagtagtgatgttcatatcgttttaaggctactactagaaacaaaatttcctgatatattggctatgttttggtagaggtatcatgttggacaatcactggagaaaggcaggctgcacgaatcagggcattgtatctcaaggcaatacttagacaggacattgccttttttgacaaggaaatgagcactggacaagtggttgagaggatgtcaggggacacattcctcattcaagatgccattggagaaaaggtagtttgttttatctagtgtaaagagtgtgctttggattgagagaacacaaatacaactccctttctgcaatgcattgctagatacttaccagtaagtgcatcattagatgcaacagatctctatggttcatatggaaaatcttgctccaaatgattcttttgttgcacccacccacccacctgaacacaaactcaaagccagctctaaaaaataagaggtaactgaaaaaagaggacatgggggttcaaactcacagaaaaacaatttactttatttaaatttatctaattcattgcatacatggtttgaggtaataactcagtttagtagtcaatgttagctacatgaatacacccatacatcataccccacagtacagaaatatgagtttgagctccattctaatgtatgatatatttaattatttaatccttggctgtatgcaagtttgacagttattgagtcacactgtattcacatggatcaatatcaataatgtatgtaccatatttcttgtgaaataccttttcattgaagttagcagatcataaatggagattgattcaatcaatacgaattgtggatctataacatggactcatcctcagattttgcaaaatataatgaactatcgattttaaataataaataaatatgtactcctttttgtatagtataagcatctagcaaaatctaactagcactacatattcgtttaacacatcctttttacttagagtggcaagtgtatacaactcctttctaccttctttggaggcttcattattgcatttgtgagaggatggctcttggcacttgtgctgctctcatgcattcctccaattgcggtggccggtgcttttgtgtcaaggttgatgacaagaatctcaacccgcatgcaagaaaagtatggtgatgctggaaacattgctgaacagactattggggccattagaaccgtgagtgctagcagtacagtagataattaatatctgagtcagctatttcctgttcctaccaagttaatcagtttgttttttcttaattggcacattctatgaaggttgcttcattcaatggcgagaagcaagctataaacacatataacaaattcataagaaaagcttatgaatctactctacaagaaggtgttgttaatggccttggattaggtaccgtaatggcaatcttgttttgcagttatggtttggcagtttggtatggatcgaaactgatagtcaaccgtggatacaatggtggcatagttataaatgttctaatgtctgtcatgatgggtgcaatgtaagtttcatatattaaccctgctcccatgaatagttaagataagattaaaacttgttacagaatttacttgttagtgtagattatgggaaggtgggtacatgtcaggtggttattacgagcattgtaggcttgcatttacattttgtaaggagtttacaggtagatggaccattttgtttcttgagtttacataacactatacatgctaaaatatacaccggaaaagaacagaacatctgataaaacttaaaggttaatgaataattagccatatttctctgtcaatgtacctctctgtgtatcccatttgttgaaatgcaaaatatgttctttactactcccaggacaacatgggccatgacttactgagttattacagcaatcagagtttccaatagcagtgaaactagtcatattaacatgtgaaataaattatttccatgtcactgtcatttttcaggtcatctggttcctgatttggcttatatgtcttctgtaggtccttaggtcaggcaacaccatcaataacagcttttgcagaaggtcaaggagcagcatatagaatgtttaagacaatcaaaagacagccagatattgatgtatgtgataccaaaggtatcatattggaagacatcacgggtgatgttgaactgaaggatgtgtacttcagctatcctaccaggccggaatatttggtattcaatggattctccttgcaaataccaagtggcagaacaatggccctagttggagagagtggcagtggaaagtcaactgtgatcagcttggtggagagattttatgatccacagtctggggaagtcttgattgatggaattgacattagaagaatgaatctgggatggatacgaggaaaaatcagtcttgttagccaagaaccagtgttgttctcaagtacaatcagggaaaacatcgcctatgggaaggaggatcaaactcttgaagagatcaagagagcag

SEQ ID NO: 60878 - DNA, 3696 bp, Oryza sativa
caattataaaaaatcctaggatcttgttacttgatgaagcaactagtgcattggatatggaatctgagagggtagttcaagatgctttgaatagggtaatgcttgaaaggactacaattattgttgcacatcgcctaagtacagtgaagaatgctgacgtgatttctgttctacagcagggaaagatggttgaacaaggtatggcatttaaaaactttcgaaagagattatcttaaatttcatatcgattagtaacatgttgttcctgcagacagtatgagtacaaacctaatacccactgtgtagtgctcatgatacagggtacttttaaattctcaagttttctacacattttaattggctaattaacacatcttaactagataaatcaaagctgcttctgactactaatcaacagatagacaacaacctatttactttgggtatgtgggttttaaccgtcatactcccttaaagttataggccctctcttttttattcgacatgattcagcacgctacttgatctacaggtttaattttgacttgctggttgtttgtgttattcaattccgagtaggttctcatgtagaactgatgaagaaacctgaaggtgcttatgctcagctgatccagctccaaggggcacagcaggatgctgaaatccataatgacgacactgacatgataataagaagcgattcaggctctaggtctataaatgtaaaaccaagaagccaaagcacctcatttaggagatcaattactaaaggctcctcttttgggcatagtggcaggcatcctatccctgctccccttgactttccagatcccatggaattcaaggatgatctgggcatggaggagactacagacaaagtgcctcgtggccagaagaaagcttcaatcagtcgactgttctatctgaacaaaccagaagcttttgttcttgtacttggttctgtaaccgcggcaatgcatggactcatgtttccaatatttggcatactgatctcaagtgcaataaagatgttttatgagccaccatcagaactcctgaaggactccaggttctgggcaagcatgtttgttgtggtgggagcttctgcatttgttctgattccaaccgagtacttcctgtttggattagcaggtggaaagcttgtggagcgtatacgttcactgacattccgaagtgtcatgcaccaggaaatcaactggtttgacaaacctgaacactctaggtgtgtacacagtctttctctcatcatattattctgccttttgtcctatgatttattctatcaaaattccatgttccagtacttacaccaatgtcatggtgaatactctctagtctactcaaaacaactgaatagcaaagaatttaaaaatattgaacaaaagttttggcatgtaatataatccctactaatctttcacagtcctttgtttctcatcttcccatttgaaaagttcaacacctatgaaatcataatttatgactttccctgaaacaacgttaattttccactggttatgtggtgcaaaaagagtgtttcataaacaaaggcacattggaaaaaagagacaagtgcattttgatgaacagtatatactaggtagcattatccccccaaaatgaccagtactatattaattcaggtggatatttagaatggttttcatgcatgcacacacaggtgcatcatcacattcaccaaatgtgcctccagattgatgcaaacattcagatttcatactaaccatcccatcttctattccttggaataatatccttgcataaatctcaaagtgctttggatggttaagatagtacacgtactatacatatggttttagattttccagatctatacattaaaaagttaagaattgtgctcatcagctagcactatttttctactgttgtccttacgccataagtctcaacatttgttgtagtggatcgattggtgcaaggctgtctgttgatgctctgaatgtgaagcgccttgttggagacaatttggcacttaatgtccagactgtatcaactgtcatatcaggttttacaatagcaatggtggcaaactggaagctggcattgattataacagtggtagttcctttggttggtttccaagcctatgctcaaatgaagtttttgaaaggtttcaacaaaaacgcaaaggtacatacaatggattaatcatgagcattgtgctacccttacagatgctttctcatgcaacacgttgtttgatgttattctttgttgtaatgcagctgaagtatgaagaagcaagtcaagtagcaactgatgcagttggaggcatcagaactgtggcatcattttgtgctgagcagaaagtgatagaagcatatgagaaaaaatgtgaatctccagtaaggcaaggaataagggaaggtgtagttggtggcttgggttttggcttctccttccttgtgttctactttacttatgctctctgcttctatgttggagcaaagtttgttcaccaaggagtggcaacgtttcctgaagtgtttagggtgcgtaaattttcttatccattttacatagcattgacattttgatattttagtcaacttatccagtggctgtcaggtcttctttgttttagttttggctaccagtggaatctcacgaacaagtgcaataggcgcagacagcaccaaggctaatgaatcagctgtttctatcttcgaaatccttgaccggaaatccaagattgattccagcagcgaggagggtgtggtcattgcaagtgtgaggggtgacattgagttccataatgtgtgcttcaattaccccctacgcccaaatattcaaatatttaaagatctctccttgtgcattccctctggaaaggttgctttctatctgaactaagtgaacatatttagtatcattaacacattgctagcttgtgttgatcttaattacattacattatggtttcagactgttgcactggttggagagagcggaagcgggaagtccacggcgattgcgctgcttgaaaggttctacgacccggataccggcaagatccttcttgatggggtggatctcaagacattcaaggtcagctggcttcgtattcagatcgggctcgtggcacaagaaccggtattgttcaatgacaccatccacgccaacatagcttatgggaagcaagaacaggcatctcaggaggagatcatggccgctgccgaagcagcaaacgcgcaccagttcatctcggctctgcctgacgggtacagcaccgtcgtcggcgagagagggatccaactgtcaggcgggcagaagcagcgcgtcgccatcgcgagggccatcatgaaggaccccaaggtgctcctgctcgacgaggcgacgagcgcgctggacgcagagtcggagcgcgtggtgcaggaggcgctggaccgggtgatggtggggaggacgaccgtggtggtggcgcatcggctgtcgacgataaaaggcgcggacatcatcggcgtcctcaagaacggggcgatagtggaaaaaggggggcatgatgaactgatgcggataaaggatggaacctatgcttcgcttgtcgagcttagttcaagttcaaggtaaatcttctgaaagcctgaacattatcacctctaatagtatgaaaatactgacttgtcctgaata

SEQ ID NO: 60879 - DNA, 4894 bp, Oryza sativa
tcgttgtccaaggagacgaggcaggtcgggagcatggcggtgcggtggcgcagctcggcgaagaagaagcgcggagcagcctgatcatcggcgccggcggcggccctggcgaagaagttgacgtggtagtagaaggcgtcccagcagtccatgaagtcgctcgccgtggcggtggcggtggcggcgacgagctcgtacttgacctcgttggcggcgtcgccgttgtagtgctgcagcgcgcactccgcgagggactccgcctgctgcagcaccaccagcgggtccgggcgattctccggctcatctggctgctcctcatccatggcgtcggcgtcgtcgtccaagtagaagtagtccccgacgttggcgctcgtgatggtgtagctgtacgcgccgccggcgctcgtgaaggtgcagctgttcgtggtgtgatcggcatggtcgtcgtggtaggcgggagacgtgggcggcggcggcgactgtgccggagagtaaggcggcgacagtggcggaggacaataaggctcctcatcctcgaggtcgtggctcctgtcgtccgcttcttcgaacggcacgtagtacctcaccggcggtagcagcggcatgacggcggcgggcagtcgatcgacgatgagagtgagacggatcgattcgattgtctcggaggaagagaggaaatcgatcggtttgcgctataacgaatgcagcaagcggcgcacgcaccgtccgccgcctgattttatcgatgggcacgcctgtgattcgactccgactcggagtaacagctgtatcggccaatgcgcggtacacggatacgcctgacgtacgtacgtggtgccggcctcgactctccgctacgcatacgatgttttttttacgatttttgtacgatcaaacgaagacggctcttggcatcgtaacgctacgtggtgcacgcgcatgttgcagcccaagagctcatggatctgaagcccatacacgtatactcattattttcctttgcctttttttctctgtatccaaataaatacaaaccatgccaaacattggctcatacatgaagtttgctgcatcttatcctgatttgtgccattggaaatttagaatagttccaactaggggtgatgctaccagggtccgaggtgcaaggaacatatgtgtatgggtaatttacttaaactaggttcacatcaaaataatttacttaacttaagctgggtcacatgataagtgttgagcgacagcacgagtatataagattgattaggaaaaataaattactctggttagctgtgccaggaagcttaattataagatgtcgggacgatgatgtgattagcttgggtttttggatatgggctcaacgctagaaaaggtccagtgtgggaccagaacttacaatgttatgagcctagaagagaaacgtttgattgtacaactatcgtaacaaattagtcgtacgtatagcaacgccgtcgttataatgagtgggaataattcaactcggaataggaacgaatgtaataatgtgtgctaatccaaatatggttgggctagctagctaatcccattacatcctctaaaccccaagaccctaaaccccaagcaacttgcatgtttcacttatggcgccatactttttactaagaaaagttacacatttgaatgcccagcatcggtcgactgggggaggtgggaaaatcggtcgctcccccggcccttcccccatgtgcgcacctgtttgggcccacccacttctccctcccctttttcataaaagatgttttacctagtgtatttacaatattttactatttatagatctaatgttgcagtgtattaaaatattcttttgtaaaaaaaaacccaaactctctattaagggaatttggtttattttttgttctaccaaaaaatatttcaccttcacaatgtttcactatatatagatctaatgttgcaatgaacgaaacatttcattgcaacaaaaaacccacatattttggaaaccccatattaagggaatttggtttattttttgttccaccgaaaaatgtttcacgtagtgtactcacaatgtttcactatatatagatctaatgttgcagtgaactgaaacattctttcgctatttgctgaaacattgtttttatataaggtgaaacaacatccgatttaaacgagtgaaacattttcgatctatttagtgaaacaattccgatatacctagtgaaacatcgtgtaacatttaaaaataattcaataataagctaattttttttcgacgaaatatatccatgtgtggtcttctttgaagatttaattgcaacgaatttaatggtgcaatcggatcttgatttggataagtaatttaagagaaaaatctatttaaagtagttttgcacgtaaatcgggcgctaacgtcatgctgacatcagcgcccgattttaatctcctcccatcgaacgcccgagcgggagtcacgtccttattacattataaattatctatacttacatagtaattgctcgtaactttcaatatttacgttgtaatatttctaatacacaatgtataaaaataattaagattaaaagtaatttattatctatttaaaagatgatacgtgagagataagagcaatcatatagagaaaatagtgactaaaatctatacttcctataaagttataacccactagcaatatgcaaccgtgtcacatcatcacccactagcaataattacatattgaatcttatacgagcatagtgacatacaacattatctataatttatttaattacatataaatcaacatgcaaacttatccgatcatcaccctcatatcatttgcaatattttaacaaatatattatcatttttataatatttaacacatagttatcaatatgttgcacattaaagcgtgagtattatttgtttatttcatgataagtactaataaacactaatgttctattatttttttctttctattcctatttcctagcttgattgtcgaaaaatatatattgagagttctcgtagcaaattgcggggaatcacatagttaaaacaattactcttgccatttgttacttggtgtggtagaaatatttcgatatcaaccgatagtgtttctcgttggcaacattgtaaccgacccactgccaatagggaaacctacagtgataggccctacgaattggcagtgtagctggttctaggacggtgagaggtgacatcatggagttgaatatcgacctggagtggagatccaggcaatgatagtaagggagctggtggtgggctggccgacgaagaagaggcgagacacatgttggtatttgatacgatcacagataaatccataagcggaaggatagctgtagcacttcaccacagagtatttcaagggtatcgaatcacatggaacatgtgtgtataatacaagaataggattagaatagaaagaatttctatggattaataaacttgaccagggaggcatcgctctccctggtctaccatttgagtccgctctacggctttataatgtatccgaacatgaaggattacaaaggtcagacatagttgtcaccacttgccacctatctctacaacccatggaccacacatcaaacaaaaataacttctaacctagacacaacctttatgttattgattactactctagcctcgcacatgaactttcatttttatctagagttctagtactaaaacacttaatagaaatactaagcgataaacccgcaacgatgaaaatatatcttacttaataagaaaattaaataccaaaaggaaatctcgatcgaatactcactttattaaagaagcatttgccgaggtacacgagagaagggagtgccgacaactccgatacttctctagaactttccctcactctcactctattttctaatactctactagagagtagccttgaatgaaagtgagttgtactcaacttgagttgtgtgttgcaaatgaaatgaccccctggtttcatagtgtcaaatagcggttacagaggtcagtacacccacaaccatcattatcagccaatgggagattgccacatggaaaacgatggggcagagcgccacccctagcttggccgagaaaatggacatttagccactttcaaaaagcggtttcactggaatgccatcccgaaaacgcgtttcgctaaaatgccaatatgaagcgtgcactcacatccactttgccattttggctattttgtgtatttttgaaatcattttcactagaatgtcgggtgatgagacggaattacccctgttgggtgaggacgaagggaaggaggagaagccgctggtgtcggtggagcccgtgctcgccggcatcagggaaggcaagggagagaccacagcctccgttggcattggtgcccgtggtcgtcaccgcttgcttcggcgaggtgaagaatgagaaggcccctagagaggcaccaagaacgacaaggtgctgctgccgctagacccgtgggcgttgtcggtgtcctcgcctcgtcctccaagaacgcaaacatgttcccaccctcaccgcctccgccgcggccaccgcccttgtcccgccaaccaccggagcagaaggaggcatcttcttgtgcgggaacgagggcaggaggaagcatcgccgccgggtgcggcgcagcgcgtggagaaggcgaccgcggagtgcgcgtgctttatgcggagctcggcgaggtggtggcacgacgtcgccagcggcttatcgtgctctcttcaggcgctcgctgtccccgccgaccaccttatccttgccaccgtcgaggatcgtcatgccgcccctgccccagccgcatcaatcccctttcacccggctgccg

SEQ ID NO: 60880 - DNA, 4429 bp, Oryza sativa
cctgcagcctgtttaaatccgcaagcagttttattacacggaaaggaattaataagagacatgctatatacgtatattgtcccgatcgaccagctacttattcaaaccctttggatgcttgatgatgacatcaaacggctcgtcatcaaagcaaccggaaggctggggatccatctgtatctcgtcgtcgttgttcaatgagacgacgcaggtcgtcgggagcatggcgatgcggtggtgcagctcggccaagaagaagcggggagccgcctccgccgcgccggcgccggcggccctggcgaagaagctgacgtggaagtggaaggcgccgcggcagtccatgaagccgctcgccgtggcggaggcggcgacgagctcgtacttggcctcgttggcggcgtcgccgttgtagtgcttcagcgcgcactccgcgaggtattccgcgtgcttctcatccatggcgtcgtcgtcggcgtcgaagtcgaagtcgaagtagaagtcgtcgtccgcggcgacgtcgacggtgctcgcgaaggtgatcaagctgtccgtggtgtgatcggcatggtcgtcggagagaggagacgtgggcagcagcgtcggcgatgccggtggcgatgtcggcggcggcgacggctgtgccggggaataaggcggcgacagtggcagaggacaaaactgctcctcctccccgaggtcgtggatgtcgtccgcttcttcgcacggcacgtagtatctcaccgccggtggcatcggcatgactgtctctcggaaagagagcggaaatcgattgatcgatcggcttgcggtatagcagcgagaaaatgcagcagctagctagcagcgcacgcaccgtcggccgtctccgcgcggcgcctgattatatggagtggcgcgcgtcgactccgattcgatcgaatccgactcggagtaatagcctggatcgatatcggcaaatgcggcacattcggaggggggattcgagtcggaacaggaagacggtggcgcgcgacatccgagctggagcgtgacgctcggccgcatggcctcgcgatgtcgcctccatgagtccatccaaatctgattaggcttttttccttaaaaaaaaatcttattaggttagctaattactccattacatccactatgacacttgatacgtacacaagctagcaagccaacttgcacgtttctttccaacgttagagcagggaaaatcactacctaaaaatgattttttttacgagcatcctaataggttgagttccgcatctgcaaaaatcgactctaatttttctatatgacttaaaaaatatgtatgcaaaaatcaaattttccaaattgaccacttaaaatatccgcacgcaaagggctcttactcgcccgcatgcaaaaataggagaatgattaggatcagtcgacgggggaggtgggaaaatcggtcgttccccctcctcccacgtgcgcacccccactggatccacccacttgtccctcccctttccatagaagatgtttcatctagtgtacttacaatgtttcactatatatagatctaatgttgcagtgaattaaaatattcttttgcaacaaatcacccgcatattttggaaacccactattaagagaatttggtttattttttgttccacaaaaaatgttttaccgagtgtactcacaatgtttcactatgtatagatctaatattgcagtgaactgaagtattccattgcaacaaaaaaaacccacatattttggaaacccccaagtaagggaattcgtttcatttttttccaccgaaaaatgtttcacctagtgtatttataatgtttcactatgtatagatcaaatgttgcagtgaactgaaacattctttcgctatttgctgaaacattgtttttatataaggtgaaataacacccgatttaaacgagtgaaacatttttgaatacttagtgaaacaattccgatatacctggtggaacatcgtgcaacatttaaaaataattcaataataagctaaaaaaatttcgtcggaatatatccaggtgtggtcttgttttgaagatttaattacaatgaatttaatggtgcaatcggatcatgatttgaataagtaatttaagagaaaaatcagtttaaagtagttttacacgtaaattgggcgctgacatcagcgcccgattttaacctcctcccatcgggcggctaagtcggagtcacgtcctgcaaaaatacctccagaaaattcccacttttttttttatttattatccactctctctctctctcctcccatcaccccactcctctcctggctatctctttctcccactcctctcacccacttctctcccctctcctccctcccagcggcggcgtgcaaagacgacaacttcctcttctcccccactcctcctctccccgctccttcctcccgatagcggggaagggtgtattcatcccttaaggggatctttcatgcatatgctatctaaatagtcatcaaaaaaataaaaataaattgacaagatagattaatacgaaatatatcactccacgaatatgtaagttaaaatttaacttgtacaagttgtaacaaaaataacaaatataactacaaatgtattataactatttttagtttaattttttccttttgttacaacttatagaaatcgaatttagccttgcatgtttgtggagtgatatattttatattaattagttgtcatttttttcaaaatttttataactatttagatggcatgcatgtaatgagagttcatccccacggggaatgaaaatccaaatctgttagagcagacgtgtagtcaaaaggacagatgatcgagcccggtgtaagcctgtaatagagctaatactctaatagagtctagtgcgagtctctaacagacttatggctggatgaaagctataatttcatctcataccttgtgtgaacacttgttagctaagtaatcaatttccctttgtaaaaaaaaggacggaggatctttaataatagatataatccgaagctcaatcactattgattatttacccatacaatttttgtaaaatgtaaatatattataattgtagtgtaattatattgtgattatttacctatacaatttttataaaaatgtaaatatattataacttgcatgtagctatagtattacttgtatgcaactttcacataattttacaccgttggatttactttaagattcatgcaaattgggaagaaaaaatcatagcacgcactgatgaggactttcggtgtcatgatatccgcttcgagaaaatagcttgtaactgtaagatttttgaagttgtagtatagatataaacaagttataaacccataatgcaattacaatgtaattatactatatttacaagttacaaacttttaggattcccaacctatgttagattttgctatatctatagcgacatattttcttttcaatcacatagtacactttatgatagtcctgatatcattgtacccatcgtgaaagttactaagaaccaagattttttagataatggaatgaaataacatctcggcctttgctcaaaaaagctacagccaattattacaaactagcactctgtaagagtgtagtccaaatgaaagcaaacacaccaaccaaaaaaaataccaagataagagcatgattccatattttcccatcgatgcgtgcaagttaaaataccattgtataagacaatttatctaagaaataacatcaccatgcattagggttccgtcaatttcactccgttagcctaagtagtttttttttcatcttcctctcatccatcggtcattttctctcgtctacgagtaaaggggaggagagtaacaaagaggacacagagttgagctaggcggtagggcggtggttgctgatagcccgcagaaggaagagattcgtggtgatggcatgttgcaaggaggatccacaggatgggaggggcttaggcgatgaagaccatggggcaagcggcaacatcatggagttgaataacaactgggaatggagatctaggctacgacagtgaggggaaaaatagatggcggtgggctggccgataaaggagaggtgagacacacttgtagaaaaatgatttttgcaggcctctccccttaatttcatagggagagaaaaaatacaaaacacatgctttaggcttacggtggtagtgtgtgtgtgtgtgtgtgtgtgtgtgtgtgtgtggtgatggtggtgggaggaggggggtggcgggtttgagaggatggcaacaacactggttgatccagagcagctagccctgcgagccagtttaagttgtggggtggtggagtgggcttgggtggtgatgggatggcgcggtggtccgacgatggtcgttgtgtaagatggttgtg

SEQ ID NO: 60881 - DNA, 2031 bp, Oryza sativa
agagagagagagagagagagagagagagagagagagagagagagagagagagagagttttctccatttctaggttggattcattttagtcttgacacaaaggcagccggcacagaggcttcgtggttctactccaccgagctgcgcatgcacaccaccatgtcaccatgtttctgactgtactgtagcacctatatactcttgttaaattttagatttacttccatgtaattaaatgcttgaatattgtaagaactcatgaattgatctatgcagaatgaaacaagaaaaaacaatatggctgttctgtttgttaggcacaaaatgcacgatatggcagtatatatagaattttcaaaaccaaacattcacttgtacttatatattcagctaaatttaggttgagaaaaatgggcagatagttgacttaaaatctgcaacaaaatataattcagtgcatattcaacaaaatttctaacatgcaaccaaatatgtcatttctgtttaattgtatagacaaatactagcagtaaaaatttacaacccaactcttatatttacacagtcacaaacagttaactcaatctattaataatcactaactcaatccacactcgtaccataaaagcaaggtctaactcaattcataagcagtgtcaatcaaaatcataataacctggacaggtgaagtgtccacctatgtaggatgctctgttctttgtatgtagtaggtcagaactacacgaataacaaaacttcatgtcaatctccaattaaggctcactaatttcattgtctccaaattctaacccacctatgaatttaaaggttaggttagcaaaacaaataatgaatatagtcagtttgtgcaaaaagcattaaagaatattctcgccaactttatcttcttaatgtaacaagcagaaacatgtcggaaccatagtaccatcttcaggattcaactcagcatagaagagttcaccttcagaatcctcatgcattgcccttgcaataaagttaacatgtccaaatgaaccttcagcatctatgatatagcaactcttcgtagcttgtaccaactcatatttgatctagtttgtaatatgtgataacttgtagtccaattttacaattgaaatgtaaagagaaaacaagagatatggtccaagacaaatatattttattaaaatccagttgagtaataagataaggtgagaagacagtaaaacagtttgggtcaatgggaaaatgtgaaaatatgtgtattccacatattctatgcagtctataatcagtagagagacaaggagatgactaaacactttaaatatactaccttcagtcacaaagaagtgacatatactaccttcagtcacaaagaagtgacattttcaattagttcgattattaatcctcatgcgacatccccacgagggatgaaaatccttatccttgttaaaaggacggaagatttgttgactaatagattttttttagctgagtaatctattcaaaaaaggacgaaggatctttaataatagatataatcagaggctgaatcactattgattatttacccatacgatttttgtaaaatataaatacattataactcgtatgtaactacaatattttacttgtatgtagcttttacataattttacacccttagatttattttaagattcatgcaagttgggaagaaaaattcatagcacgacttatttattttactggtgaggactttcagtgtcactacttccgcttcgagaaaatagcttgttactgtaagattatctttaagttgtagtatagttatatacaagttacaaacttataatacaattacactataattatactatatctacaagttacaaacttttaggattcccaacctatattagattttgatatatctatagcgaaatatttcttttaattgcattgttgtcgaaagacaactgcatcacgtcgaacaatgtggttcactcaatgaattgatggattagtaaaagcaatatattaattg

SEQ ID NO: 60882 - DNA, 8234 bp, Oryza sativa
  unsure (1)..(8234): unsure at all n locations
gatggagggcttggtggcgaaccctttggtctttgtcgctggcttcgcccaagcacttcaccctatggcttcgctaagaggcaggtgtctgtgaaatttcatttttgctttcctgggcagctgccttaagaggccagcggtggtaacacaactttcgcaggctaagatgccatgtataaaaatcggtttatatgcacatgcaactcagtaagggttgtacctccctggtgcaaaacacaattgctgcactatttgtagaaaacgataagaaacaaaagaataaattagcggtgatgctctaccaatttgggaagacgtttttttttttcaaaatgaagatctgaagaggaattgtatcctgatgcattaatataaattttaaaatatggaatgtttaatgcctctaacacacgttcacatcattgtcatgtgccatagctctttgctctttgaggtagccatgatcacctcaaacacttatcggatatgaagaaaacatcatcgttctagccaaataaataaagatgtaaaagtcaaactttttaaaaatagagcaagagtcctttaaacacatcagaacacattggcatcgattaaatatgataaatttagggcatataattttttggggaatgttcggtcgccacttcgcatacccttatcattgggtccacaatgctctttagattgtcgcccgtgtccatagcattttctaggcggacgttgttcgttaaatgtccacctgtgtgttgttgtttgttcatcttcctcaccccactgcttcaactacatcaacaacattggttgtaaagtgcatctaagctccctagtgggttttagctaattgatgacaaatggttaattgactaatgtgttcactactacaggaaagattttcctgaatgccatacccttttgtttccaggcagaccgtaagtgaaatcgcacaggaaaatagggggggaccggcgccaggccatcgcctgcacaggaaaatcaactttcgtgtgcaggtcagttaacaggcccgcacgtgaaaataaaatagcccaccctacatcaagtgctcgatatcccttcgcgccccttgcccctccgcccactaccccactacctccctctctcccacctcactctctcccactccactcctctcctcccactcctttcctctcctctcctctccctgccggccggcggcgacagcaggcggcggtgctcggccccttcctccctctccctcagttgcgggcgggaagaagggcggcggcgggtgaccacggcagcgcgtggcccctcctctccctccccttgcagatccggctacacgccgcccctcctctccctccccttgcagattcggcgaagaggaggcatgggggcccgacggatctggcagagcggcgagaggcggcgtgcggcggcgggagggaggcggcatgcgcccctcggcggtgagaggtggttggacaaaggcggcctgcgccccttggcggcgggaggtagtgggatagaggcggcccttggttcccctttccacttggtttcttttttgtcactgcattatttttcttttttttaagtaggggcaattgtgttcatatagtttaattattattttacacctgttttttagggtttgtgattttgcccctgctttttttaaatgaagcagccgtctacctctggttttgacggtagtttagtgggttcgaaatttccgaattaaacgaataaaaaaatgatattataatttgtgaatgacatcctacccttgtttcactaaaacagtcaaccacttgctggaagtgtaatttccccaatccaaaaccctagagcggcggcggcgacgcgcgagcacagagaaggggaggagcggcccgcgcgcggcagggagacgcagcgacccggtgggccaactgccgcggggccagcgcggcgcgcggcgcggcggagaggagcggcggcctcgcgcgcgcgcaggtaggcgtggtgcggcggacccgcgggcgcgcgtgcagggaggcgtggcggccccgcggccagcgcgcagggaggcgcggcgcagcggccatgcggccagcgcgcgcggagaggagcggtggctccgtcggctcctctctgttttatgcagttaagtaggtgcttctttttttttttttttttttttgacaataagtagctgcttcttcatctgcataaaagatgatagcattgagggaatttatgatactctttcagaatgtgctaccataagcaaatgtgctggtggaattggtgtctcaattcacaatattagagcttgaggcaagagtatggatatatttgtccattcaccacacacttaacacccttaccatgagttaaacagagtatgggcaagcggctgcttcattaaaaaaagcaagggcaaaatcacataccctaaaaaataagggtaaaatcacaattgaactgtaaaacaaggacaacaacacaattgccccttttagtaagtttatacacctaaaatttacacatctaaaatttatatacctaaattttatagagctaatgtttataagtcaaaattttatatagtcgattcaaattcaaattcgaatttaacttgtacaagttgtaaaaagtagcaaatataactatgaatgtacgatgattactttcagtttaatttgttaattttgttacaacttgtagaaattgaattttggcattgcattttgtggagtgatatatcacatattaacctatgttattattttttttcaacttgtagaataatatcaaatatatcactgcagtggaaggagcagtgacctccgtgggctagagaccatcccctctcacatccgttgactaagcccgtctctactcaatgcctagacatcgcagctcgccgccgccaccaagagagggcgagggaggcgcatcagcacgtgaggagctgatgaagatgatgccgacggctggttctcccatcttcactgcgtgcaggatgggggagcacacgatgaggtcgagggtgggaagtccgccatcagaatccaccgccgacgccatcgtacctccagctagcgccgcacgtccagatccggcacagactgccgccgagaggcgcggaccaccatcgtcccacggccgcacgccgcctcccgcccctcaaactgcctccgtaccgccgccgcacgccgcctaccgccagatccgacgcggactgccgccgtcccaccgccgcacctccagatccggcgcgggccgcctccctcccaccaccggccgccaccgggtcgctgcctcccctcccgccagatttggtggaggggagggccctgccatgttgcagctgtggtggatgaatggaggaggaggagaaggaaatgtggagaggatgagagaaggaaggagagaaggaagaagaagagagaggggaggggcggtggagacaggatggagagggagagagagaagtggataaggatggggcgagagaggagtggctcgtcttaggatgggtgtcggttttaactgaaaagtggcatctatttcttttgcctacaaagatgctggttatagggtaggtcccgtagttgggatagggactaaaatgccggttttagtttagaaccgacatctatatctaacaggggtaataggtatcggttttgtttaaaaaccgcgcaccttttaagtgataaaggctgacggttcttgctggtttggacgggactgaggggcaaggggcccccgcgggccagggggaggcactgtagcgtgcgtgattttaccacttcccacgacctatagagctgacttatattaactattctgcagtattaacaagtattattaactttagaggagtagggtatataaatgttatgtctgagtatttaagcacgcggcaggaatccatgccgtcgccgtgggccgtgcttctcctggacctgaaatggccagctggtgcgggattctattctcagatgaacgtcgtggagctgtgatggtggtgggacgttacgcggtcgggatcggatcgatcggcgctcagccccaccggacgacggcgacggcgcgcggcctccgagtcttggacgcacgcagggggacggcgacccgtttgtccgcgcccgcgtgcatgtacttgcagtgatttttcctcgtttctttccttcgattaccgtgaaagtttcgtacttcctctatttcataatataagtcattttaacaattttgacatatatactgatgttaataaatctagacaatgtaagtccatctaacatttttcatatttatattgatgttaataaatctggactgtatattgatgttaataaatctagacagtctagattcattaacatcaatataaatgtgaaaaatgctagaatgacttacattatgaaacggagagagtacaatacttactatgttctaatataaataacgtctttgattttttaaataatatttaactatttatttaaatattttaagtacatcagtgcatcaatctctgatttactggtagtattggctatatactgctcgtattgtggcagcagcatgaggcctgagcatgagcatatatactccttatgcctgattgaattgatgatgctattcttgctatctctgcacctttgagccaagctctgaacgagtggaaggatattgaacctatcaattttgatattggcttttctgtactgaagaatccagagtgttgtgggttgatctttgcgtccagccaccgaagtcacgtagtgatgaggtagttctcgtacaagcttcgtacgaatttcttcgtgtgtacagtagggctgaggggaaaaaacatagggcgagatttgtgggaccgatatggcgatcgaacatgcaactggctagacattgttacacaggaaagtatgattatagaaatggacgtttcagatttgtttacgtcaccataagtaaagttttctctcagatataaccgtgagatctaagacgtttattttttaatccaattataattttcagatttgcactacatttttttttccttatgattagcctactacacatacactatgggtagtcgtcatcggacattgggtgccggtgggactgtgggaggcacagtcccgtagcctgtaggtaaccataccgacatctcggccacggccgcacgccgacccagcgccttccggcctacggtcttctcccccattttctcatttcggtattttcgattgtttacactataattagactgttttatattttataaatttttaagaggaaatttatagatacatgtataaatagttactgctttcaaatgtttttctttgggaacgtgataaagattgaaaggcccaaaacgaatgtacccgaattcaaacaagagcgagagactttgggccatcgtagtgttctgatcttctggacttatggcccatataccaactgaattcaacaacagcacacttctctcccagtcccagcctccatcacccagtccacctccccacctccgccggccggcggggccatgactgcggcggcagccaagggagacggcaaatgcgccgccgccgccgcctcccctccggcaggatgaattgagcagtccgtcgatggatttcggtatttccagataaaaccctcaactcactgttttctctgtgcaacgagcatctcttgaggggaaaaaagaaggcgataatatcgtgaaattgggcgtctttttctgcgtgtgctccgaataggatgaattaggcaaccgctggtcgctttggctgctgtgctggctatatttggtttacttgtaatatttttgttccacttctttatcatttgggtatatgctgttcttgtgatgggcatatatgggcccaaaaccaaggttgcctcagatatgattcagtaatctactccgtagaatgtattccaggaaactattcactcgcaatgcaggagattgattgaatttttagcttaactctgattattcgtttgctcgtactgtcaagccaatagagtttctgttaagattatttgtccttcgtattttatcctgcacactatcatacatattttatggtgaccaaatttacaattctcatctagtactagtaatctgctcagttatgttttaggctggcaagtcacatctgaactctagaaattcaaaaggtattactaaatgttggaaatgaaccttcctcttcttttttaaggggaacaaagtgtatgagtttcctgtgatgggtgcctaaactaattagggtatgccatttacgtagagctgtatattgagccccttgtaagttgcataatgatgtaatgtgtttctttatgagtatttgcaaatgagcagctcccaatttaaatatggactaagtggcaactattctttcagaagaatacgtcttcatgtagagcagtagcctgtatgacaggggtaaaattatctgtgcttgttttttcattgatttttaaatttcttaatcgctaattaaatcactctttttttttaattttcaggtgatcatgaattttatctatcttggtgttggagcaggacttgtttcagcacttcgtaagtgtctatcttatgcaagaaaataggctatcttaaacatctatgtttgcatagaaatttattttatcttttgatatagaaattggagaataaaaatgtacaacgtgctactagtacttgcagttcttttgtcaggagctttttattggaaatattattagaaacaatgcttacttgattcattatgacaatttggtagaagtatcatgctggacaatcactggagagagacaggcagcacggattagggcgttgtatctcaaagcaatactgaggcaggatattgccttttttgacaaggaaatgaacactgggcaactagttgagaggatgtcaggagatgcattcctcattcaagatgccattggagaaaaggtaggcttgttttcagtgtgtaatctaattgattaaccaaaagtagttcttttgagaagttcagttacaatatttcctatacaattgatttggttttgtacaaatatttagtaactgaagaaagaagacccaacgaatcccttttaattgaaatttatgtagtcaattttctgtagcccatacccaattgcatgcatcatacatggtctatttaggagtttacagagccctaaaaagaatctaggagttcagagaaataacttggtttcatgtgtcacagtcaactgtgtgaatcgcacatacattgttctaactacataatatgagtttgtgcttgactcaagtaactctttggtcatgcatcatatatgttctatgtaggagtaaaaaatagtcaagatgcataatctttgcctgtatgcaagtggagacaaaaagacatattatatgtatcagcattataagttcaatgaatctttctttttttaaaaaaaaaatcccagttgatggattttccagaccataaatgcagttgggttcagtcaatgggaaatgcatatgtttaacttgccaagtactgcattatatttcattatcctgcttcaatgagaaatatgtacatgtactaattctctattagcatataataacatgtaaattttgttatacatgcgttgtctattaggctggcaagtgcatccaactgctttctactttctttggaggcttcattattgcgtttgtgagaggatggctgttggcacttgttatgctttcaagcattcctccagttgctgtggctggtgcaattatgtcaaggttgatggtaaaactgaccatccgcatgcaagcaaaatatggtgatgctggaatcgtggtcgaacaaaccattggggccattagaacagtgagtgatggccgactcttatatttggctataaaatctttgctatcgcgtgtatattgatcctgttctttttatcttcttttgctttgaaggttgttgcattcaatggtgagaagaaagctataaacacatataacaagttcataaaaaaggcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60883 - DNA, 13881 bp, Oryza sativa
tggatcccccttttttaaaaaaaagataaatatttgatgattactgatcattatttctccatggatgtacatatttgtgtcttccattgataaattcaaaatattgttggttaacactccccaaggcaactctcacagtgacaaagctaaactttccagcggagttaaaatcactaaaaatatgcaatatggtatttatatatctgtttcacattgtgcggtttatggtttgagttatattttgttctgcaggtccttaggtcatgcgacatcatcaataacagcccttgcaggaggtcaaggagcagcatatagactgtttaggacaattgaaagacaaccagatattgatgcatgttgtaccacaggtgacatatttgaagatgtcaagggtgatgttgaactcaagaatgtgtactttagttatccttccagacctgaacatttggtatttgatggattctccttgcaagtaccaagtggcacaagaatggccctagttggagaaagtggcagtgggaaatcaactgttatcagtttggtggagagattctatgatccacagtctggggaagtgttaattgatggagttgatattagaagaataaatcttggatcgataagaagaaaaattggtcttgtcagccaagaaccagtgctgttcgcaggtacaatcagggaaaatatcacgtatggaaaggaggacccaactcttgaagaaatcaatagagcaatcgagcttgcaaatgcagcaaagttcattgataagttgccaaatgtacaatgccaaagtaaaatgttctaattgttaactccatttcagttgttagttgacatcatgaaatatcgcagggtcttgaaacgatggttggtgagcgtggaattcaactgtctggaggtcagaagcaaagaatagcaattgctagagtgattataaaaaaccctaggatcttactgcttgatgaagcaactagtgcattggatatggaatctgagagggtagttcaagaagccttgaataaggtaatgttagaaaggacaacaattattgttgcacatcgcctgagcacagtaaagaacgccgatatgatatctgttctacagcacgggaagctggtggagcaaggtataccatacaaaaacctcttcagagattcacttttttctttgaagagatttaacttgaaatctgatttctagagtgtacatactacatatgtctgcgtatcactattgagatattgtgactatgcacaaggcattttcaggtccacattgatggtctggtgtgtatgtttcagaaaactttaaaatgaatttatattcgacatttacaatattttaaattcagctcactggataatttcaatttgatatgaagatagtaaatagaagttctttctgacccctaataaacagataggtaatagttcacttgtgtagcactgcttttgtaccatattagctgtaatattcctttgggctttaacaaaatgttacacctttttgttcaagagctacttaatgcacaaattttggtacataacttaccagttgtttatgaattatgaaaaggttcacatgaagaattgatgaagaagcctgaaggttcttactgtaagctgattcatctccaggagactcggcaggaagctgtggcacctaatgatgaccctgatatgataataagaaatgattttgactctaggattataaatagcaaaacaagaagccaaaatatctcatttaggaaatcaaccagtaaaagctcctcttttgggcacagtggtacccatcctttcacatctacttgtgacttatctgatcccatggaggtccacgatgatcagcacataaaggagaccacagacaaaatgtctaattgccaagagaaagcttcgatcctccgccttttctctctgaacaagccggaggcctttgttcttgcacttggttctataactgctgcaatgcatggagtcatttttcctgtattcggcatactggtttcaagtgcaataaagatgttttatgagccacgttcagaattactgaagaactccaggttattgggcagcatgtttccggtgcttggaatttccacatttcttcttattccaacagagtacttcctatttggactagcaggtgggaagcttgtggagcgcatacgatcattgacatttaaaagtgtcatgtaccaggagatcagctggtttgataaacctgaaaactctaggtatacattatgtctttccctaatcgtgatgtggtacattttttcctaggacttgttatatcagaatttccttcaagaatcaagatgcacaactgcatgaatattagacttattatggttgttcatgctctcaagctcttaaaccaaatgtacgaataatataattttacgtacctaacaaatactctggcatatatatattttgcttgttaatatatcagaattctttgaaaaacatattctagaaattaaaatttcaaaaataaaatatcataagagctttctgaaaatttgatgggtactaaaattagttaaagtggattttttaagtggaaaaagaaaaggcattatacttgtcagctagcaatatatttttacaggtgtacttatatgggtttcaacttttttttttctagtggatcaattggtgcaaggctatctactgatgctttgaacgtgaagcgcctcgttggggacaatttggcactaaatttccagactttgtcgaccataatatcaggttttacaatagcaatggtagcaaactggaagctggcattgattataacagtggtagttcctttggtgggtttccaggcctatgctcaaatgatgttcctgaaaggtttcaacaaaaatgcaaaggtacatgccttgaaattaatcatgaatattctccatacaggtgctccaacacatggggagttgttttgcctaattttttggtgcaatgcagtcaatgtttgaagatgcaactcaagtagcaactgaggcagttggaggcatcagaaccatcacgtcgttctgtgctgaacagaaggtgatgaacgcctatgagaagaaatgtgcatctccaataattcaaggaataagggacggagttgttggtgccttgggttttggcttctccttccttgtgttctactttgcgtatgctctctgcttttatgtcggagcaaagtttgttcaccaaggaacagcaacattcgctgaagtgtttagggtgcgaactcattcttatttcattttgcatagtgttaatcatgctgagggtgtgaactcattcattttgcatagcgttggtcattattaacattttggttcactgatcatatgctaggtcttcttcgtgttagttttgggtattaatgaaatctcacgaacaagtgcaataggatcagaaagcagacgtgttaatgaatcggtagtttctgtcttcaaaattcttgatcgtaaatccaagattgattcgagcaatgatgagggtgtggtcattgcaagtgtcaggggtgacattgagttccagaatgtgtgttttaagtaccccttgcgcccaaatgttcagatcttcaaggatctatccttgagcattccttctggaaaggttgccttctgtctgaactaacaagtaaaatatttatttctttacaaactgctgtttggtgcataactttattgacgggattatcatttcagactgctgcgctggttggggagagtggaagcgggaagtctacggtgatttcactgcttgagaggttctatgaacctgatgctggcaggatcctttttgacggtgtggagcttgagactctcaaagttagctggcttcgtctacagattggccttgtggcgcaggaaccggtattgttcaacgacaccatccgtgcgaacatagcttatgggaagcaaggtgatgcatctgaagaagagatcattgctgctgctgaagcagccaatgcgcaccagttcatctccgggctgcctgatgggtacaacaccattgttggcgaaagagggatccaattgtcaggtgggcagaagcagcgtgtcgccatagcgagagccgttataaaggaccccaaggtgctgctgctggatgaggcaacaagtgctctggattcagaatcagagcgcgtggttcaggaggcgctggaccgggaggtggttggtaggactaccgtggtggtggcgcatcgcctgtcgacaataaaaggagcggatatcatcggtgtcctcgaaaacgggacgatagtggagaaaggcaggcatgaagaactgatgcagataaagggtggaatatattcttcacttgttgagcttagctcaagctcaatgtaacctttctgaaagccagaaaaccactcttcttcaattggacactgatttagtccctgatatggattgttggtttgcattccaaagttttatatatgtatgtttgtactaggaaagggttgttccttatgctgtctgttaatgcgcaactaccatggaagacatgcccagtttgtagtttgtaatatttaaattttgtacaatgtgtaccatcaactcagtatatatgaatgttcaggctgtagcctatgagcctatttggttgtgaatgctttttttaaaaaacaaaataggtccatgcagcttttatttctgacgtaggttgaatcaaacgatctattatgggttatttccggactgtgtatcaactacctgtgccaattcatggaattaagaaaaaatggcacagcccgccttccatgcttaacccataaagaagttgaaaactgagaaagattcatgatatatattgagttgagcagattacggagttgaaattgaaccaaatttggatttggtatgaccgtattggttaaagtaattccctatatctacaaatattcaaaacaactaacttaattaggactaacatctggtataagtaagactactaactcaataaagatgacttctcaataaaatttcttttaaaatttgtaaacttcattgtactgattcttccatatagtaccacatacgagtcatatgacacgtgagtttgatggtgaatgctttctatcggtagcgcgagggaagagaaaatggaaggcaacttaaccactatatgctatacaactacttttttttatctatgtatttatttatccatatatgtgtgcacatggttgtcttcttaatatttttcttctcaacaatttcttcgattttttatccaatcatatcgttgtatttgttataattaaatctttataacaaaatatcacatgattatactctgatgaaagaaaaacatatgtttcaaaccgttaaaactcaatgtttcatacgcaatagcgtcatgttttaactggtgttttcattgtgtttcacaaaagaaaattaaatgtttcaataacttttttgtttcaccctgtataactcaacgttcacaagtggctgacaaagtattgatatattatccctactcactctttcttctgctatatacttaattttctctccactctatccccgcatagggaatatatatatatatatatatatatatatatatatatatatcatatgcgcacaagcttctcttacacactccgtacacaccaaataataaatgtcatgaaaaactatacaaaatattgaacatttactcctaatagtattacacatatatgcaaagtatcatattcaaattcactatattttagccataacaaaaaaagagaaaaatcttttttgttcacttacatcttttcgttgactcgagaagttcatgtgaagggatccttttatttcgataaatatctattatcatatccgtgccattcgtttttgtatttaataacattcgattttcttttatccgggttttttgtttcggctccaattcaagaaaaaaaaagagtaaattgtagtttggaccacatatttttaccattgttacaatttagacaaggtcctagcaatggttttcactttgaaccacatatctttaccattggtttcactctagaccaccccctcatcttctccaagtccggcagcccatctccaatgcaagtactgttcgtctctctctcccccctagtctcctgctatctgccacgctgtcagaggaggtggtgactgctcccgagacatgcatgatccaaagtggagcatgtcagcaagagtagggcagcgatggtctcgtccagaactccggcagcccaatcttaaaggaaagagtacggaagcggcctggaactccgggcacccaatctggagggacgagcagcatatcatggatcggcaacatcgaaaaagctcgagcacgagcgaacggccaatagcactggaggtgctggtgatggagctcaagtagggaggcagggcaagaagggctggtcttcatgttgaggtagccagtggtggttatcagttctgtgggttcgacacgtgcaggactcaacctcaacttctcaagcatcgaaaatttgatcctcgcacaccagctcagctacagatgacatgattatgaatagccaaacaatcatggttcaggcaactccaactgaagcgaagcaatcgatgccgccaaatcaaatgtggatgattgaaatagccgtggtagcactagcaccgtagcagctcaagcaatgccctaggtccaaactgctatgctttggcaagtctagctggtgtgaattgaaaattttgttaaaccccttgtccattgtgaaactcaaaaaaaaaggtccaagatgaaattcactcaaaaaaaaaaagagaagaaaacggaaacggttgggtggtgtggacccttttccgtcccaatttacacttccgtacctttctctctgacaggtgggccctgataagcagcggccgtgcgtccgcagttacgtcttgtttcgtttaccttctccgactcctgacgcggcctcaacaagaagaccagaagcttcctccaactccggccgccaccgacccccctcgacacccgactccctccataaatttccccccctcccgcggccgccgggagatcatcgccgacgacaaccagagcagaggagaggggaggggaacccaagcaagcaatcagcgtggaatcggatcgggtacgaggaggaggaggaggagggggatggatttcgagctgcgcaaggcgcgggagaagctggagcgggagcagcgggagcgcgtgcagcgcgccaaggacaaggccgaccgcgagcgccgcgccaaggccgaggccgcgcgccgccgcgacgcgctcgaggcgtcccaccgcgagcgccgcctcgacgccgcccgcgcgcaggaagaggtaataataccaccacaaaagcacacaacaaccacgttcctaacctgctagggaatctagggttaggatcacttttgctccccccgtccgtgatccattttgcggtcgtttgtattggtttttatcctgtttgatgattgtaaataggcttctcaagtggagtaattcgattcccaaacccaaatttgatcccaaagccttcatgttaattctgagcaaacacatgcggcaaagattatgcattcactcgatcgcccaatgtcccctttgttgttatattagaaacaataatttcttttcctgatactttggtggatatcttgaatgtttgattggttcaacttgttgaattggactgcttgctccccatgacaatttatcgaaatgcttgcatttgttttctttggtgtctactcctgccttttgatgtgctaccggctcgtgttaatgatctgttttatgtatttgtgttgtaataggctcagcagaagatggaagaggtgatgcaacttggaaaggggatttctttcttgcacatgtttgaagctcttcgatatgatggtcctggggataagatcaagttgccaccatcgtcttttaaggaattgtctgatgaaggagcactggacaaaggtcccatgtacttcaggttgtcaaaggttagagacagtgttccgggtgcccctcaggataatgatgccgatgaggcaacatgttgtggtgttcttgagttcactgcaagggaaggctccgcagaactcactccacatgtgtggaacaatctgttccggggtgatagcccagatgttcctctgattgaggttaggtatgtcagtttacccaaagggacatatgcgaagctgaagccagaaggagtggggttctcagaccttcctaaccatagggctgtccttgaaacggcactccgcaatcatgcaacactatctgaaaatgattttgttgtggtgaattatgggcagctgcaatacaagttgaaggttcttgaattaaaacctgcatcaagtgtttctgtcctggagacagatgtggaagttgacattgaaggaccagattcagttttggacaacgtagagaatcaacatgtgcttgtgccacttgagactggaaaggttgaatctggagttgtggaagaaggaaagtttaggtactacaaatttcttgttgatgaaggtatgggtgagaaagtagcttctaggcatgcaaatattgaggttaagatagagacatatacaagtggtggtgacactgatatttatgtatcaaggcatcctttagttttcccaactcagcaccgtcacgaatggtcttctcatgaaatgggatctaaggtcctcatactgaaaccaagggatgccagtctctccagtggtacctacagtattggagtttatggtttcaagggaaccactaaataccaactttctgtagctattaaagatgttcttaatggccaaaggattggtgagcaggctagtgcctcatctagtgttgatgttgattcagtggtgtgcaagaactgcaaacgctatatatccaaccgaacttcactacttcatgaagcatactgtgtgagacacaatgttgtttgcatgcatgatgggtgtggtgttgttcttcgaaaggaggaagcaacagatcacgtgcattgcaacaagtgtgggcaagctttccagcagagagaaatggagaagcacatgaaagttttccatgagccactacaatgcccttgtggggtggtccttgaaaaggaagatatggtatgtattttgccttcgctacttatattctttgaacattcttcctaacttctgaagttcttttttactcgttgaatcccgccaatgatttgagtacacccagtttaccaagcgtaatattgtctttacttctaaacaaaatgattgcaatacctttttagatgtaataattttatttgcatgatatatttttattgccaatggttagttttacgagtattgttcctcactcaatacaaacagtagagaaactgcctaccagcttttgtttcaaacagttactgtaatttactggtaatgtaatattggaagtcacatgactaatttattctgttcttaaatctcaggttcaacaccaatcctcaacctgccctttgcgcttgattgtgtgccgattttgtggtgacactgttcaagctggtggagaaccacttgatgctcgggatcggcttcgcaacatgtgtgagcacgagagtatctgtggatccaggactgcaccatgtgattcttgtggacggtcagtcatgctgaaggacatggacattcatgtgattgctgtgcatcagaagagctaactattgtaaagcattggctctgagaaagatggcctgtcctttatcctgctgggctttaaccaccaaggccatgaagtttcagcactgctggaccaaatgttatttccttttgtgttacatatatcttgtgtcattggttaaattgtaacactgcgtatgggagcatggaacactggggcggtgtatgggagtatggaacacagtggcggtgtctccttatgtatacacaaaccatctataatatttgatttgagctttctcatattcaggagctttattagaaactttcatttccgtgtctatacttccactgttttatcattagggcttttttttttttggctccgatggataatgataatttcgttgcgtagtgtttgcacacacgatgcatttgaatggaaaaaaaaagttgacaactgaacaaattttcgctgaatcaaaaaagtaactaaattttggccagagacatgtcctttggctatggggacccatcgactcatcgagcatcgatagaccaaaatttgagaattttggcctaaaattctctctatattttatattataagctggtctaacttctttttagttaaactatttttttttgtttgatcaagttttcaataaaaacaaatatattattaaaatatattcaatgttagatttaatgaaactaatttagcgttttagatgttgctgaaattttttttataaatttagtcaaactctttttaagtttgaatagcaaaaaaaataaaattaaaatgatatttttttaagatttatggtacgaaacagtgggagtacttttcatccgtatacaaagtttcttatgtcgaggttcttttgctggtgatgctagctaatttgccgtcgagtttatcctccttgagtgccgtggatggtagggcgaagtgagagccggtgccggtttgatagccacacgacaaagatatatctccaggtattgtgccgaacatcaattcattcagatcaaatagcaaaagatattaggcgcgggcaaaattcgtcctagtcgtttctctcttcattctctcgcttagctccagatttgctgcgaccagcggcgaaggcgcaagaactaattgctacggactcaatccggggcacttccgttgacaaggtaacgatcgtcgatcagtgatttctctaatatctcctccttcccttaccatcctaatcccacatatataaaaactgttaaaaaaactaatctctactattataaaaattaaagatgtttttgccagtactttagtatgtcatccgtgtatgggttggtttttaagttcgttcacttttgaaaatacatatccgtatttgagttggtttttttaagttcgttcgattttgaaaatacaaaagaagtcgtataaaaaatttcttttaaaaatctcacatgcttagttgagacgatcggactcctaattgcagctcatgattttctaaaaaaaaagataaatccaaacgaattcccacagtgaatttcatctcaactaaaccatataataataaaaaaattaaaatagccttcactcgttacaacgtacgggcattttttcagtgtgcttaaaaatgaaaactgatcaaccgagagaaaagaaaagggaaaaattacaacagccctttgctttgagttagctcagtatttgtcaactgatgcgttcttctaatgtaacagtggtcttgattgtgggatgtgattgattaagtggggcatgcgagtgaaacaagcgccagcaagcggcaggcagcagatttggtggcttcgatatttactccgtatttcttttcatcttgtttagttccagattcctacaaaataaccggagaatttaccaagatcttggctaggatcgtgcgaccacagattcataaccgcagaaaacaatgaaccaggggatagcaatttacaccaccacatcaccaggaaaacagtgaaaaatacaggaaagcaacatcgggagcccattggtatatatatatatattttgccattcctccttgctgtaaacaaaaccgatcctcaaaaccattattggtgctctttaatgtacatgtcgaaactacaaacctactagccatcacctctattatatttatagccgttgatcatttacaatttcagcaagggaaggtgattcagagccattgtatttactcggaactggggtgttccgtctggactggcgctttgtcgccacgagaacctgctccgcctctggttcgtcggagatggagaacttctcgtcgtcctcgtcgcctttgaacaccgggtggatgtaggcattcatcaggtatcctttgaggtcgaaccctggctctcttgcgcgttctagggtatccttccgcattgcatcctggaaaagggaatgatgagacgttattggttgatttcagtttgaaggttgaattccacagtttctctaattcacaagatgcacattctccttttgacatagaactgacaatgtccaaaataaaatatagaagcttcaattctatccaagttatggctcccatcggatggcctattcagctaaagaaaaagccaaaatttgaattttcaaacttaattttgacattgattttaagatattttcaacgtagtttctttttcaacattggcttttaagtcaccgagaacacatatataaaagttttacctacaaattcatttttattctctaataagccgttttggcttattacgaaaaaagccaaacgatgaggctgtatgttaagacatttattttgcatgataaagtttcaacaccatctctgtagatatcactacaaatgatttcttttgtaagcagaaccattcaacagcagtagccttgttgtaaaaaaaggcacgtcgaaaataatttaatggcagagtacttatgttgtactattggtaaatttgaacacataggaccatcacacacacttggaaaggatttaaacagatgccttcagatatcttgttagttgcagacttgtgcttggcatatttcttgcaaagcagcattcgatgagaatagccacttccatgtactcttattcttaaaaaaatgtgaatattcatcgactaaataatactacttcagtacgtcatacacccaaatcttactgaaggcaactatatgccaatcctgctaacaagattgtataaaacattttaaacttgctggctgttaaaatctaccatttctggatatttagttcattttactacaccacgacagctttggctaaaaagcaattctatagggctctagacaaattatggtaacagacatctacaatgtttttggttatttacagttcatttcaaatagaaccatgggtgaattggtgataatacgctcatatgttcttatcaacatgtataggaactttcatcccaaggtattaactacgaaaacttcagaattttaatattgttttttatttcacaagctaaggtttaatagataaaaacttaaaatacatagtggcatgataaactgattctgagatgagcattacctgtaatggatattccacaaaagcaggctcatagcgattcttgcagtatttatagaaataaaaggttacaacagggagaacaaggagcaccggtgttgactggccagcaccttttgtgcttagtaatccaaggagaagcagctgtgatacgattaatgctacaattatgcgtccatgaacacttggccaaaatgctgctgcactttcatattcttggttgtacacatttattatctgaaacaatgaaccctcagttaggaagtcaatcattttaatacataatcagaatgtagaattacttgttctattgcaccgaagactaaattgtcacacatttaattcctttgaatacagtgaaaggcgagagtgctaacttcttacatggaaataatagtagacaacatagccaaagaatcaaaagaactatataattgtggactagcaaacacatagactatcacacctgacaaacaagtacagacagggtatgcgattgtatagcaacatgataaattatatggagctacctaatgcaattggttatccattatttaagtacaaaacagaaaacaacatcgttttgattccaaaatgggggaaaaaacagtttgaagtgtccttgatgtagcagaaacgcagtcaatt

SEQ ID NO: 60884 - DNA, 6432 bp, Oryza sativa
agaatgtagaagaaaaaagtagtaaatcaaatgtaaagtttatgaacttgtctatttagggcattaggtgctcaaagatatactttggcttggtaggttccatgacttgcttgctcctcaaagtggtacattaatggataagttgtgagattggtagattgccaaaacattttcataatagaggaaaaataagatgcaaaaaacagtattgcttagcatcaaccattcaatggacagatttcagcaagtactggatcaggtgtatagaacagactttagctgcactagaacatcaagttattgatggccacaggcaacaaagcaggtgcaaaagcacaactgatataatgctaattaatttcattctagcaagtttcagttgtatttccaaaagaaagcaagaatgaaatgttaacaaacaataaatttgcaatgactggaaattcacaaattatgtgccaaaatatataacagaaatacatctgtaaagagtgcacagtgcagcaggactaaaccccttcatagcatccaagccatgttttcaattctttaacagtaagttcaagttcaaccgtgatttcatgcatacatttcctcagtttcattcggtaggaaaaagcctctgttacctctgcatgatatttatcttgaagcttacttaaagccttaaaggacaactgaccctatgatatcttgaaaggatttgatcatcaaaagttaacaaaaatatattttatcattttttttctgcaataacattccttgcaagttgcaacccacacagaagtctaatttattacatggcagtagcacttaaatcatatattggatgatgataagatcataaagccatgttctgaaaatccaatactagaaaagcagtatgtggtaagctttcaactgaaaaaaaaaattgaggaacaactgataataattattgcagaagaaagagataaatgcacgtacatttcaatcaaaggcttcagaaatggagctgccttctcaatcccttcaatatttgcaagggactgaacaaatgcaatcgggagcacataaaagaagttcaggaagaagaatgcaaccgcaattatcagcctcctaattgtcaggtaaacaaaaggaatagagaggttatcccaatagacatcacgaggttctggggcccactcggtcaaccagacagttggattactggtttgctgtgtctgagcacacactgctgctccccaccgcgatcggaaggaaacaaaggctgctggcacaactgattttggatccttcataatctttccacgttcatcagtttcctaaatatcatttataagaagttaatccggtggtttatggtactggggaaatccttttaacatgtgaaacacaacattcaacttatacagtgctaattactaataaaagctaacacatatttgccaatattgatggatgcaaagacaagaaagaaagacactatttgcttcagtaaaatagcaagaagctttacttttgttaagacactatatgaagtcaactgtagtattttgaaataacactagactcaaagcagaataatgcattaggaggcacagcacaaagatattatgacttacttccttttctatcctctcaatttcagatgtgtagtattcaatagcatccacctttgaaccaaaacatccaagaaaaccagtctggaaaagaagtatagaaaaataagaagaataaataaggaatcataaataaaaattattcttttttgttttgataaaaacaacaagaactgtgtaagagaagtaaagagattaacatgatcaaatttagcaacaacctttgtagtaggcctttgagatgtatttctttcatatttcagctgatagtaatcaagccaattctgcattttcttcttctctttgaccatcttatcaagcttatttgcattatagacaacctataccagtccatgaaatgaatgataagaacatggtagtggtaagccatatcagagcatagattttttttttttagtaacgataagcagttaaaactaaggaatcaaacagaactacatttgattgcagaaagataaaaaggaaaggcatatatgaaagaagttaatggcatataactattcacatgacttcgctatgaactttgaactgaccagacagaaagatccagtgaagcataaataccagactgtaaaatataaatattacctggtgcgtaagataatggtcaggatggtttacaaggaagaaatgttccacaagctcaccaattgattcatcaggatcaggcggtatattccgcacaaggacctaaaaatcaacattggtcaattagtatatcattgctcttcagtcataatcagttacaaaatcttccttcaccagaggctttccaattttaaagatgagttctcccaccaacctatcttggttagccacattcagcttagttaaatatctggatagaaccaggtacttgcaagttcaaaagtcacattaaaaattatacccagttggcagttgaaactattggtgccctaactaattcgtcttttcttttggatagaaatccatttcttagagcatctataagaataaacagtgcaaacatacctaacaattttcattttacagaatgagcagtatacagcaagcattcaataatgatacttttatggttttgatgtcaacaactcaatgtccataacatttcaagaatagtggttttcatgattatcttttttatcagctgatattttacattattcaagttcccacgtagtccctcaatcactatccatgaggtgaagcttttttgtcttccatagatgtgtaaaaagacttaagtggcattattagattcattgtgaaatgaacactgttagtgacatgacatgctatgaactaagtagaattggaaggcacattagaaagaaaatatcaagtaatataaattgaactgccaaatgcatagagttcacaagatcataccgtgaactgatctgggcggcgcttctctgatgcaagaaagcgcagacgcattgttgccactatttcatactcccgtaacagcacatagcatgtccaaaatgtgaaaacataagccatggtcaggtgagctgcgaacctgcattaaaaaaaagtcacaggcatagtgaacactaaaacaatagtttcagagttgatgaacagggtatcctgcaagactaatgtgctgcctggaaggctaatatcaactataaccactcacctacttatctatggcaagatcaaacctttgcgactatttgtctaattactattacaaagtatcacaccaaactgacacaacaagctaggttaaaattaatggccttcagaattgcacaccccacacatgcaagctactaccgtttctgactcccagctcatgtattatcacagaggctgggtggttgttcatactgcatggtcatctctatacatcttcggatcttcatgactttcctaagcccaaatggggaaagaaagtaagagcaatcatcattccacttaccatttgaaccaaccccatactcactatcttaaattgtgtttgaagtaatctatcaggcatgcccatattttagccaaagatggtacacaacattaacagtaatatgtaggtatattactatattttaagacagaaaaattatctggtactaacctctttgaccctacaggtatgttggatattgaaagtttgtcaatatcactgtgctgcaccttcgagctttgaagggtaatattggtccaattaacaggcacaagaataataaatgctagaactgtgattggagcaaatattttaagcctgcaacagttaatagtaaaggagattagtgtaaaagtattggcagagaaaagtaacagagatgggagatacccagtggataaaacagaaacattcaacaaaacaacattttcggtactagaagtacacttctacatatgtaagaaatggagaaatagcaacgatttagaatccataaaaatataagacaattaaaatgaatagtatgtaaatattagaatatggtccaacactaaagcccttcccttctgtcaagaagaaaacctgaaagctaaacccccccccccccctcccttaaatatatgtctgacctaaagtataattgacgacttaaaaagttagcagaatttatgaatataaattgcataccctattaagtagatccgcagatagacagctgaatcaaggcctgcatggctaattaactcatcctctggcattttgagagcagcaggcatccaacttaagaccttcaagtatgatcgcatgtccaaattgacaaacttccgcacaaatgcacccccatgacttggactctctcttgcacctttgagataccactttgggaagtaaaccctatcgttgatgggctgtagtcgcaggaaagcaaacgctagcaggaaagtgatggcactcagtatgttgatagctgcagagacacctatatcttgaatagtagccatatttgtccttcaaataacttgcgagaattactacagatgctagctgaaagatgtaagaaaacaatactacggttacagggaacaaacttttatgttaaacaaactataaaattagtgaacaaaatagcaaaacaatgtgacatgttgagtggggaacacaaccacacaatgtaaagaggggtatagccaccaatcttggaaatttcatatcatacattaagttctagtttgattcatagtatgattcccatataagcacaggcttgaatcgaggtttaactccacaattatgttcaacccttttagcaccaagatcatgtaaaataggtatgtaattccaagatatgttttgtttgaatccattatcctatatcaatggtgactgcctcaattgttttcttcagcacaaaggtatgttttgtgtgaattccagtatcgcatcaataacggcagaccaaattgattttttttagcacaaagacaacaagcagatctaacagatgaaaatgcccatttaaaaatactgattcaggggttaatattgtcaagaggatcgcaagacattgataagatactttcagagtttcgcatggtataacgtacattaactcgagcataggtgcagcaatcctatctgactgacagctacagaaaggaagtaaatgttgattttattcctaaaattatatttgacaaccagaagagaaaccactaatattcccatcatatcagctctgcgatgctcaatggattaggctgatacgaactttggacctccagcattttttttaaaaaagaactatatgagctgcaacaggactggaattatggatggttagatataatccaacagtccttataattagtattattgtagcacatgtgcgagtaagaaaacaaaatttggttttaggtgcagaatatcagccgtgtgatcgggacaggccaaaagatcacaacttgggtataaattcattgaattgaaaaaacgtccgcttgaagcctaaagctttcctaaaaacaaaatcttgaaacgccagcctagaaaagtaatttaaatttaaaaacggcaggcatttaaaggtagcattaagcaggcaggtttcttactaactttaatttgccaactggacgaaaaaaatcataagatcattactactagtagtataatggtagccaaagccatatcttctaccattatttaatttgtgaaattgacagcgaaaaagcaaaagaaaattgcggtggaagccaaagccagttcatctggtagtagtactattttgtgctaacagttgggatttagcacatgaacagttaaacaagaaagacaataatcttagattagttgcggtaatagtactctactttgtcatatcagaaaataaaagaactctactcctactactttgcagcagagtcccaaaggggagagcttttccgagtggcatacagcaaaatttccctattttgtttgcaaaaacaaaacaaaaaagattcgtttcccccataaaaatcggaaggacaccaacaaaatgtttctcttcttggactcccccgtaagaatagctgaaaaaaagttttaagacaacagaagtaaagcaaagtcgtatagcgctatagccgcatggtcacccatggaggaaacggattgaaacaatcaccaaaacatccaaatgcatcggagacggggggagacaaaatttgaaagggaggaagcacccggagaccccagatctgaccagcaacaggaagcgaagaacaggagcagagagaatcgcagggagagcggagggcggggaaggagacaacaaacccaagaacgaacgaaaccccgaaacccacctcgaagaacagcaaaccaccaccctagccgccgccgccgctacacatccccctccgaaatgcc

SEQ ID NO: 60885 - DNA, 4084 bp, Oryza sativa
ttcctgcagccccagagcagggcgagggatcgcgatgggagtcgggaggacttcttcttatgtaggagtagtaccaggagtaggaaggagttgggctggctggcaatctacccgtcgcttttggaagggtccgactcttctgttcgaggaggagaagaaggcgacgaagccgagaaggggaaacgggcgaggagagggagagagagacgttgctgttaaccgcatgcgcaaagctgtcaccccgcgtggcagcgtacgccgctacttgatggagttggagtttaccttgggttaggttgggttggggttcgcttcgctgcgtgggagacgtggcggcgaagcgtggccgccgcccgcacgcgagacgccggcttcgtctcgggggcgtgggtgggaaacgggaagcgggggtggtggtccaccaccggagcaggtaaagaacaaagaaaacggacacgatatgcaacgtcagggcctcaggggggcgcagcgcagcgcaggtgcgcccttttttttcacttttgttactgctaatctggtccagatgcaaaacgggagttggagttttgtgtactgacatttttcggggtttttttttcctactagggctctaggagtaccatatggcagtgagattttgcttgcgtgtggatgtaatgagtcgtaggttctgtttttaggtgagcggtgtttcctctgtagttggtacaagggtacagcatcagccccgtttgtagcactatgtttgtgttaccaccaaatgaccagattgactaccagcacaatttcaacgtgcaatagatgtacagcagtagcacttgaccgcttaggcagctcctaattacgtagtaagagtagtaacatcttacgcaaaatagcactgattttaagtgcggtgcatatcaagagccggaacggatcggcagggaataaagtccacacgagaacggtgacagcctcgctagtaaccaccggacacttattaccagaaagagatgtttagtccgtgaccaccgatccatcaatgttttgtggtgtagtactacgtactggtagggtaggaggggtactgctagaatcgtacgtacattgttgcagaaaagattgctcgcaagtgacaaacagaaaccggcgttgtcaatagttgctccataagctataccccacggctttttcactaacacccttgtaagtactaatttttccatataaacctacttgattttgtgtaaatgatcccactaaaatatcaatcaatcactaaaatatcaatcagtaatactcctcaatcagtgataattgatctcacggggtgctggctctgtcattggttatcaaactggtgcgaaatgggagtatgcgtgcgtgtggttgccgtgccgacacgtacgctgagaattctcacgtcgatggaacgaactattttaatctagaatccaatccggacgggcgtcgcgtcaccatccggatacagtacggcctgtcggcaaaacacatgtttttttgtccgtgtgaccgtgtcggcacaccgtacctcagctgcccaaccaaaacaaccggtatcgcctcgccctcgcctctgcacgctcgtcaaacgccttgagttgacatatactactccataggagtagagtaatgcagtataacgtgcgggacgcggccgcctccaccggatgcgacgcggacgcctcgtgaaaatgggacggcggcgcgagaaaacgggaggtttcgccggccaacgaggcaacgacccacccgctccagatgttgcgccagcgctgcgcccacgagaccgaccacgaatcctttgcttccggctgcggcctgcggcgttctgacgtccgatcgcgggggttcggttgatttctcggtttctgcttttaacggctgcatggttctggagtctgtctgtacttcacctggattctgttctgtaggtgtacgttctactacggagtactagctgcttcgacatgttgacttcagttaattttaccggcgcattgtgtagggcgtgcatatagtaatagtactagcacatgtcgggaggattatatacagtacttgagacaacgtgcggccggctcgttgacatgtcaaagattttgtgtgcatgtgctaaaaagtgtgcatacccgttcgtgctcctcgaattgacatgtgcatcggcattatattagtggcacccgttcttttctccaataaaaattggaggaagaattaaattttcgttgtacgtttttcaaactgctaaacgatgtgttttgtgtaaaaaatttatatataaaagttgctctaaaatatcatattaatctatttttcaagtttgtagtgattaaaacacaatcaattatacattaataccacctcgttatgcataaaaataataatcttcatcttcaggagaaaagaacaccaccttagtgccctatttagatcccacctcaaaatttttcaccttgtcacatcgaacgtttgaacacctgcattaagtattaaatatagactaaaaataactaattacacagattgcgactaatttatgagacaaatcttttaaacctagactgtgtttagttcacgctgaagtttggaagtttggttgaaattggtacgatgtgatagaaaaattatttgtgtatgaaaagtttgatgtgatggaaagttggaagtttgaaaaaaaaactttggaactaaacagggccctaattgttccatgatttgacaatgtggtgctacaataaacatttgctaatgacggattaattaggcttaataaattcttcttgcggtttactgattgattctataattagttttttattagtgctcgaacaccccatgcgacataataaccgatgtgacacgccaaaactttacacctatggatcaacaccccctaagtatgctttcacagggctaaatttgttcccacccctaggttaaataatcgtttgctgaggccatgttctaaagtagaggtcagcttggctactttttttttaactaccagatggtgtgttttataaataaataaataaatatatatatagaagttgctttaaaaaaatcaaatgaaaccattttgtatttattttaataattaatacttaattaatcatatgctaatcatgtttctcattatgcgtgaggctaatcaaccctttccaatctctatttagaatgcaccctaatttttttagtttgttaaaacaattggtgaatagccaatataatcccaaaagttttaccaaaggccctattttgacttacaattatcattgaacccacttgatgtaccacacggccgatcctaatcatcatttgtattagcaaatgtccattttacccttaatttacatatactagaaagaaaaaaatgaataaaaattttatagatgtagtactttccattatctcaacctgcatatgggggttgtgttttaatgtctatcgtatacttataagaaaatgtattattaaaacttttttaaaaagcgcaatgtagttattgaacgtatgtctaaaaattaggtttataggggttctcgttatgtaggcattttttcttatacatgtgaaaaggggtataacagccatttaattaatcaagagaggtgttgattagatttagccatctgactttctaggtgggttaaagatgagtttaaagtgaaacaagaacttgaagaaataaaatagacgaattgaaatatcaagaatcaaattgagaggcttagatgaacttgaaagactaatctacaattcttcgtaccagaaaatgtcagtataaaaaacactgaacattagtctatactttatttacgcccataatcatccgcaatctaacattttcattgttaggctaactgcaaacactggacctagctaattaattatattctcctacttccgtcttataatataatacatcttacccttttaattaatttgtcccataattgtattaggctatgtttagttccttccaaagttggaagtttaggttgaaattggtacggtatgattgaaaagttgtgtgtgtatgacatgttgatgtgatggaaaaagttagaagtttgaa

SEQ ID NO: 60886 - DNA, 2252 bp, Oryza sativa
atctgaaagaaacaaaaggagggcagccagctcggcggcaactaacggttggggtggttgcatcgcatcatcatggctctcccttctgccgcagctgaagaaagcggcatcgatcacgatctgcttccgctggtccccgtacgttttccccaaaatcttgttgcgttccggagcatttaggtaaacctcatgtgtggggcccgctctccctcgacgtgattgccggccacgtgacgagccgagccgagccgaggagtttgggaccgttgctgcggccgccagccttgcaaaatgcaaacaccaagatttgattaataaagaggaggccgtggttaccgttatttgtgcgctactctccacgttttcgtcagctgttaagtttagtaagggtaattgtgttgttgcacctgcttttgaattgtaagggcatccacaatgattatctataggctctctacaagatatccatgtcaacatattttcttacctagaagagattaaatgaagagagagagaacaaagctatctactaatatgaagatagtctatagagaaaaacgagacaatggattagagagctatagatacccatgtagacataccattgaagtgatttactattaatctagtctattactgagatgtacatgttttatagatgacaccttactttattattgcgggtgctctaattgtgattttgtctttttctctttggagtttgtgagtttgtttcggatgaacggcgatgtatgtttggaaaagcgagagtaaaatcgcaaaccataaaaaaagataaaatcacaattgaatacaattattccgtaatagtagtataatctgatgtaacttagtaagcttgagatgttaattacacacaaaaatacaaaatcattggaatatggccattttttctattaattatccaaaaatatatgacctgttaccccaattaattagcagtggcaaatgcaggttgggcttgattagttgattggtacgtgggcaattggacctgaaaagaatccatccctcgccttaatcatggcatccctgtactacgtcgtcgtccccatcttttcgttggcgccaatcgaacgatcgaccagatcgatcgcgatcgacgtgtgccggctcatgaccgagcaccgatggtgacgcgcactgctgctgatacatacattaacatatataatcttgggcaatttgggaggagcgaaaacgaaaggtttggagggagatatcgaaacgagcggcgtatttgtcaaatggaggaaaggtacgcagtgtggctttaatcatacgacaataagatggatattaaattacattattcatcttgctgataaaaaaaatatcagcaagatatattcatgggcgccacttcgttggcagcgtgtatttgcctgtgcggtgattggttggtgaatatgtaagcgttagagcaattaccgtgggcatctaaacataaaccaacataaacctctaagataccacgtatgactaagtggtatgtggacaaacataaggttaaacttttataactttgaggatcaataacatatttagtttataagaactataacaacatgtatggatttgttttttaaagttctataataaaagtaaatatttatttatttattatatatattataatagaaaacaaggttaaaaaaatatattttgaaaatcatgtcattgtttaaaacgtaaccgaaagaagtaagatggaggagagaagagtggagagagaaaaagtgccacccttctagcttaaaatggcaattgctccgcaagcagctgacatggcacactctggtctcgtttggctgtccaaatcccggtcggtccacgtgtggccttatttggatggtgtgttaatcccagcccatcattgtgtactgcatatgtgtagggctatttgggagcgaaaacgcgaaaggtttgtgggctaaatgaaacgagaggcgttttgtcaaaatggagaaaggtacaggcatgtgcctttaattaaaaaattgattaatgcggaagaaacgaacaaacgatcgctagcaagatctttaattacatgcatgttgctataaaaagtctatttcaaagatttttttaggtttttcttgagacatacatattccacaaagttgactagcgtataagttgatgagacatacatatggaaactttgttgctggcatgtaatcctgcggtgatcgtactctttatattcttcaaagggggaataaatc

SEQ ID NO: 60887 - DNA, 4660 bp, Oryza sativa
gtaaaactagattttttccgtcctccacttcacaaaaccgttgcaaatgactccttagaaggtttgagaggcggtttcttccgacgtgacattttgatcatgcgactggttgagtcaggacatgaaccccacatgttagtgtcttgtagagaacgtgtggtcggtgaaaactcactgagtgtcgaaataagatttcggcaatacttaaagggggtggctatcaagctagaaaagtagatgggtttgaagacaaggagttttatacaggttcaggccttcttattcaagaagtaataccctactcctgtccggggatgattccgccgagtatattgttgatcgtatgatctgggggaaaaaaggtgtcccgagaggaacccggacccctccttatataggggaagggtccgtattacaaaatacagtccatatccctaacgaaatatgtgattacagataaaatacaatcgtaaccgactaagatcccgggtatttccttgataaacaagtctagaaactaacccgagtcctcataaatatattctatctatatttgataccgtgtacccaactaaactataactgccacgtagatattggatatccataatctccacagtagcccccgagacctttgcagtcaacgaaatagctttctcagaacaaaaagcaataatccgagtgcttcaattcctactgctctggcctgccgagtactaaaatcaaagactgtgaagggcgaaaataaaacatggtgcatcgagtagatgcacctaattaggtgtagcccctgactatgtggttagttgaaaaactaaacatgtagtcaagaaccgagtggtcttataaccaaacatcatatagcaaagcatgcatggttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaaccagcggaaaaataagataaacggcgcagacgactccactccacaggcagcttgaccagggctacacctaatcctccacaccatcagcatcactgtagaactcctcctctgatgaatgattgcaaggtgagtatatgacatacttagcaagccacgcagcaaatatgcaagtgcacaggataacaaaggatggcatagtagggtttcatttgcataaacagcaattaataaatatttcagaatttaataaaacagttaagtaataattaaacaatattaatccaacgctatacaacataccctgttgcataggcccaaccattctgaacaaccaaccccggctgcacagttctatctccaaaccaggaattaaccattccaaaccaggagctaaataaattattaccagttatagcatcttttattatggtgagaagtgtgagactaatcacgaaagacattgttagacccgccattaccgcgggcacggctattcgaatagttttactctggccagaagtgtaccactgtacccacaagacacagccccacaacatgtcaccatgtgcctcaataccaccacggtacctcggaaaggagctgtgacagtacccctcgcacaacacaatccaccacagcgcaccgttcctggatcataatcacccccttataaacaaggcatgtacttcccagcgacccccgtgggcttatctccgccacttctcagtctggtgctccgtaatgaaccatgctatacaaaaggtaaagccgttgcccacgctggcttgtggttggcacggttaatgtttcacaaccgaaaatcgtgaaccggtccttaattgtcatgagcacgaccatcaaaaccatgtgctcacaacccaccattatcaagttttagttggcaatttaattaattaaccagtcacgattgaccaccatgagctatcattaagccatcattaaataatagtgaatcataagttgtcccatttatatgagctagtgtctctaagcacggctaagcatcctattcactttagctaaaaccatataatgttctagctaatcaatttattaaccaagtgacaaggatagggaatcaatagcaaaagggctataacaaggcaataggttatttccacccaatgacattcaaaaataaatgcagtagttgaatagaaacaatagctttaaacgggatcaacatgctcaaagggttgtttgggatctgtgtgacttgccttgctggccttggaactcttcaaattcttctcctgcgaaaacggactctccggaaacgtcggaatctaaacagaaaagagcaaaatcaccaaaacagcacataaacaagcatgaacagtacatgtggatatttttaacatgtagatctcaattttagaaaaatttagagacttgaaacaactaaatccgagctaagatgaattagttatgaatttttaaagattaaatcggattaaaacacttatatggattttaattgaattatgacgcaataatgaattatttttgaaaagaaaaaagggattattgcgtcagcggctagggttcacggtagaccgggtgcatggcggcggctcacggaaacgaacggccgagatcgatccatccaaaacgaacggccgggatctatcggcccacgaccggtccacgggacatggcgacgatgacgtcggcgatgacgtcatcaccggcggcggctcgggcgcgcaagcttgccggcgaacgacgacacgacggcgctaacgaaggacaccaaaacgatgcgggcgacgcggcgaactcaccggtgaccaaaacagtggcggaagatcaacggacggcgacggcgacgaggaagaagcggcgacgaccttcgggttgacgacgacggcggtcttccggcgatcctcagcgacgacggaggggcggacgaggatggcgacgacttggcgaacccgacgatggccttcccgagcgacgacgacgaccggagcggcggcggcgcatggctggacaagcggtggcacacgggctcacgaggctagggctctaccggcgacgagagacgaaagcgagggtggcgacgggtagcggaggcaccgggggtccttttataggggctaggagcggcgatggaggcccacggcgaccggcaacggcgaaggaaggtttagggttcggggagagagatgaatccgattcgagatcaaatccacggatttccaaacggaattagccgataattccaaaagggaaaagatagaatggatcacggggaccattttccctctatcaatttcgccgaagaaggaaagatgcggtcgaatttggaaggagacggcggcgcggctcggctagggttcggccgggagacggcacgaggaagacgacggccctgacaggtgggccccacctgtcagcgggcggacgcgtgcgcgcgagcgggcggctcggctgcgggccggattgggccaagggagagagagagggatgtttcggccgactttcggcccaaagccaaaagagaactttcaaaactttttccaatttaaattattcatgaaatgcaattccatttattaaaaatacttccttggctcaaataaatcccagaaaaatctaggaactatagaatcaagtaaagtatttaataaaattttatctggaccaattttatattggaatttatcatttaaaattatatcttctcttctaggcttttaaaatcaattctaataattccaattaaacaacaatttatatatttgagatttttagtgtgtgacaaacctaccccccttaaacagaatctcgtcctcgagattcggaagaactggcgaacaaatgcggatgagctgactttaattcatcttctcgttcccaagttgattcttcctctgagtgattactccattgaaccttgcaaaaacggataactctattcctagttcttctctcatctgtttccattccaagatacggattggtttctcaacatatgccagatcctcttggatttctatctgttcaagattagcttcctcagtgggtacccttaaacactttttcaactgtgacacatggaacacattatggacacctgccaacgattgaggtaactccaactgataagcaacctcacctcttcgactgacaaccttataaggtcccacgaaacgcggtgccaattttcctttggtgcgaaaacgatgaactcctcaaagaggcgtgacacgaaggtacacatgatctccttcttcaaaactcaaatctctgcgacgattgtcggcataactcttttgacgagactgagccacacgcaatctttcttgaatgatctttaccttctcttctgcttctcttaggatatcagtcccgaaaacccgacgttctcccgtttgatcccacaaaagcggagtgcggcacttccgaccatacagtgcttcgtaaggagccatttgaagactagcttgataactgttgttgtacgagaattccgcgtaaggcagattcttattccaacttccaccgaagtctaaagcacaagctctcaacatgtcttccaaaatctaatttaccctttcggtttgtccatctgt

SEQ ID NO: 60888 - DNA, 730 bp, Oryza sativa
tagcccacctagagcagcccaatctacccaatcttttacaaagtttagaattgatcctagggggccacaccccactcaaaaaccgtggatttctttgcttcttcctccccttcacgcgcgccccccggtcatccgacttagccgcgcgccgtgtcgccgcgcgtaagcctcggggccgcttgcgcgtgcccgatcgccttggcgtgccgctagccgtccgacgccctcagactgccattgccgcaccaatattgatgacgacaaagccgggatgacgaccgccgcaagaaatcgccgctcgacaccgtgcgctcccatccaaagccgccgccgagtccgattttgattctacccagggtgaatcgcaccaattcttggattaaagttagatggtggtttcccctctcacaattcaaatcattcacccccgagccggccgttttcaccctcgccgccgccgcgcgtcgcgcccggattggcgccaacacgtcgctagccgtttctacttgcggtcaagccaatctttcaccggtaagtattcaaacgtggcctcccgccactcaaatttatcttggccgccctctcacagcccttgccgccccagccatatctaaagttcgagctcatccatggcgatgacgggccgcccgagctcatctactccttctagccctacaaataggacctcaatcccttccttgttcatcatcgatcatcaacaaccatagtc

SEQ ID NO: 60889 - DNA, 2129 bp, Oryza sativa
tgtcttgagtagggctgtaaaaaaaaaacctcgaggctcgtgagctgctcgagctcgacttgttctaggcttgattcgagctctagacgagccgaatctgagcctctccctaagctcgtaagctttgtcgagtcgagctcaagcttacaacgagtctaataatatatgatttttttgttgttatttaataaattagaagatcaaatatgttatttgtatgtcttgtattgatatcatatactccatccattccaaaatataaggcataaccacccttaatccaaagaccaagaaaataattattatcatcttgtagtttggatcatcctaataaatacaatgcatgcatccaatagaattagagaacatgagagtggaggattttaaaaagtaataatataatgaagaaggggtcatagttaattgcctacatgcgcatgtcttatattatgaaacatctagaaaagtggttgtgccttatattatggaatagagggagtatttattttattcttttttcctattctattaatacgataaaatataaattaattattatttttaaatattatccttgaaatatatatcgttttaattaaaaatcatgctcggtagtcgagctcgagcttttgatcgagctcgagccgagcctgctagacagctcgaacattttataggcttggcttgagcttatatcgagctcgctcaagcttgacttgttgacagccctagtcttgaggctaattttcaacaccattctcaccctagtcttcgtccttggtgtcactatcgtttctcatgttatcaccaaccttcctatttcaaatgacaaagggaatgatgactattaattagaggggcattgtttttttcttgtgcttatgccaactaacttttatagattctttttctgtctctaccattgccatgatgatatggcaatttgcctcaacagatcaaaactcctcttaatgtattcttttaggaagggcaacacaacaatattgtaatggacaacatatcgacccaccacaccttttcgataccaccataatacttggtcctttccattaacaaaatatactccctccatccacaacaattaggcatatttcatagtttaattttttaaaataagttgtttctatttgtaatctttatatattctaaacttgaatgtagagctaaattaaatatttgatcagaactcgaggaatcatcttaatactcattagttacatgtgtacatacactacttatctttgttacatataatataagttaattttttattagttttggtgataaaaataatatgtgtaacttttatgaaaggaggaagtaaattacaagactattaatagcaaagacatctccctttatttgtagcactttaatgaaagcatcatgtatcatgaatatattggttggttgaaaggagcttttcaccttaccctttccctaactcaagtttcatgctgatatggacatgcgaaaaaaagtaaattacatctgtggtacacacaactcgagattgcaaaaaaaaaaaactagaaatttaaggtagtgcatgcttgtgaggtagttgcacgattaaagccctgccttttgttttagaaaaatatatggcacaaataatggttatagcttataaatttataattcagaagagatctgaatcgtcggataatggacgcaaacaatatttattgtttccaagtttgttagtagtaaactacagttggcacgtaggagtagcaggtacgagccaactatgaagtagttgtttccaagttggcaggtatgagagccttgcttcgttgcatttcaaagcaatcctatttgtagtctagtcatcactcatcagtgcaatatatccatggatttgtttttctttttctctggaaatctggtgtttctagaattctagtttattgtctcaataatattaggggcatttgcaaatttgccaccgttttttcaataatattaatatgcctgctatgacgctatgatattcaaggtggaaagcaatgggccaaggccatttatttgggagtagggatggtgctttacactcttgagtggtgcttctgtgaatcccctcatcaatattatgatgcaatgga

SEQ ID NO: 60890 - DNA, 1601 bp, Oryza sativa
ttttaaaaagtgggacgacgacggggagcgacaacgagacgatggcggggctctcctctctctcccactccgaccccttcctccggctcccagcgctgctagcggagtggccgccaagtagggatgcggggtggtggtggagtacctcaggttctcaatagtggtgggctcggggaatgatgctagccgacgtcggcgacaagaccgagccaagtgaccgacttgagcttcccgtcaccccaaatggcgacaatcccgacaccctccttcccacggtgctgtagcttctgcagcccgaggttgcacagcgacattgcgtcggggtcccccatgacctcgaccagcccacactcctcgcacgggtggtcgtcgaagccgtcatcctcctcattgcctctcccatagaatggagtgacccggttgggcaacagtggcccgaccaacaacaaaaggcgagaaccactagagccgctaccgtgatgcagcagcaatagagggagagaagatggcttggaggaatacctaagctgttgttgcttttggtggtgctcgcgttcgatttggcggtggtggcgtggtggtggtggaggaggcgtgatgttgatgcgatacggccattagtgagtgaggaaaggagcggcacaagggattgggtcaagcggtggatgggttccctttcaagggtgaggtcaaggggcatgatttaaagagggttttgctggtcattgtgtgtccatcgtcccgccaccaccgccgtcgctccccgttgtcgtcctagtgatctgctgctatcaggccgagaagaagaaaaggggagagagatgtgataacatgtgggctccacttattatttttaatttatttgatgactgggctaccacattgttgccatgtcagtgaaaaccgctcttaaaaacaatcgagagagacattttagacagttttaatagttgggggagtcatcatatctagttttgcagtttagagatacgagtcagatccgaccactaggtaagggagtcagtgtggactctttccacatcactatgtgtcggatctgccaacttcccatagtgaacgagtaggctaataaaattgggaataagtctagttgccgtctacacgtcaagtgttcaaaatcatgcaaacgatgcatcctagtcagcaaggagggaataaaaaaaatatgtggggtccacatgtaattcacatgaaaaatataaaataaaaacttctcccccacctctcccccaagcacacggccgtgacgggcaccttcctctccatcctgagcttcagtcgcgaggagaagggaagcagaggttgaggatgctacagccagcgaggtcgagacggggtgcagggagaccgaggccgaggccgagtccaaggcctcccttcgaggccacgcacatgcattaaatcccttgatcaagatggcctctgttgatggttgttatcgatcagtttcgaccgtcaatattaccaaaatagaggagaactagtgatacttgcaatgcataaatatgttagaataataatattccactagtagtaggtatactaatcttttgtagagaacgacaataaagtggaggaga

SEQ ID NO: 60891 - DNA, 1232 bp, Oryza sativa
tatgagaatgagtagttaatgcttgtgtgtcactctacccttggattatcttaacccctgcttagaatatgattatcacaagtaatatataaattattagttgagttctctctacatgatcttttcacgggataaaataaatatgatacccttggaatactctcgggtgaaatgctacaatggtatatccgtgcgcttgcggatgaactctctaaccataatataccagaagtatttctgcggcattgctggaaattatatttctagtaatgtcgttaagaaataccaacagcctccactaccaccgccgctaccaccgcccgcaatgacagcatcctccccacccacaccatcatcgccatggtcccacccttcataacccacaaagacgtcgaactggaggcctccaggaggacgcgccagcaatgctgcctatgctgctgttgatggtcattagcgatcagtttcttccgtcaatattaccgaaatagaggagaactagttttgcttgtaatgcatatccatgttagaataataatattccactagtattaggttcactaaccttttgtagagaataatcattaaatggaggagaatcgacatcaattcaaacgataaatcaatcggacgatgtcgagaaccagacttatgtatgaatgggccaagaactcagaattgacacgacaaactaggccaaaattcaaaagtctggagaagaataacagaggaggccgccagccaaaccatgggctggttgggccggccccaggttcggcccaaccagggggttcgaccgaacctccctcatcgccgctggatgcagggtttcttctggacgatgtggattagctcccaatgatggttggagggtatttccgaccattccaaccatcacaatcgtcattgggaggctatataaaccccttaccttctcacttcactcacacacctcaagcaatagctctctcatttctctcaatttagtttggtagtatctagctggtggaataggaatagagtagaaatcaggagtccggaagccttcggaagagttcgggtatggctctagtagcttttctcttctcttttgtaagctttgtacttttattagaatactcttctatatacatttatggtattgaaatattttccgagtatatgagtacctattttacattatgttcatgttatagtgaatatacggcgagcctatctggaaaatgggggat

SEQ ID NO: 60892 - DNA, 716 bp, Oryza sativa
aagggttttcacaatcgcggtgcaattggatttccaactgggtggaaggaggaactgtaagtgtcaaagtcaatgataatgtaggaaaaaatttccggacacgcaaaggcttgagacaaggggatccaatgtccccaattctttttaacatagtggctgatatgttagccattcttattgaaaaagtcaaagtcgatggccaaattagaggggtaattccacacttagtggatgatggtttgtccattctccaatatgccgacgatacaataatatttcttgaacatgattttgaacaagcaaaaaacatgaaggccattctttgtgtgtttgaacatctctcggggctgaaaataaactttcataaaagtgaaattttctgctttgggggagccaaggaaatggaggaccaatatagacaactgtttggttgtaattctggttcctttccattcaaatacttaggaatccccatacactatcgaaaactcagaaattttgattggaaatgtgtggaggataggtttcaaagaaaacttagcgcatggaagggcaaaaacagctcctatggtgggagattggttcttcttaacttggttctttcgagtcttcccatgttcatgttatccttttttgaaatacctcgaggtgtacttcaaagactagattactaccgatcgagctttttctggagcagtgatagccagaaaaagaaa

SEQ ID NO: 60893 - DNA, 1013 bp, Oryza sativa
tggcgatgtgtcttctttgccttcaacatcccccctccccacaatgcaaaagatatatttggtgactagctaaggggagtgcctagacccacaaaaaaaatgattttatttggagctagtgctttatgttggtcaatttggcgttgccgtaatgatatagtttttaaccataaaaaaatgcctaacatcatgcaggttatcttcatgtgttccaattggctccactcttggtgtatgatgctttcacaggaacaacaggatactatgcgcaatggtgctacacgcttggaaatagtagccaaggaacttttatttcattttggatggcgtagtacctacagaatttcgtgatagaatctacgtgattttgaaaaaaattattattttagtagatcatatcatcggcagaagttgagggtttgtcccatctcgccttttttaacttttctgttcacgtctgaatttttttggctgtgtgcttacgggcagaggccggagatgtaacacatttccattatttaaaaaaaaattattaaattaagaacagtacactgaaagtactccaagaagtataacaatagtccatgcaaaatatgatttggtggggtgactagcagagctaatatagcatcatgcatgatttaagcaagattatatggagatatatcacttctacacgactacaccggcaaaatgtacaagttagtgcgttctcggtctaaccgcacgacgacgcccatgtaaaccgaatttaacagtgtgaaccgggctgcaaaattaaattaaactgtcgcaagttttgtagcaattccgattaataaatgacgttatgacgcaacgatagaattaaaacaaatcaaatgacgttattacgcaacgatagaattaaaacaaatcaaattaagtcagcctggtcagtgatcagtgcaccatagcgcagctaaacaaagcaggttaaacgtgcttaattaagtcaacacaaccacactacctccctgccttatttttctttt

SEQ ID NO: 60894 - DNA, 1458 bp, Oryza sativa
attcctgcagggtttttagcaccttaccaaaattggtttggttgaaaatgacatcaaagtgaacagaccctgaatcttaatataattatcttcagattcacatgttgctgtatattaggacgaagatagtagtaaaaatctaaattgtttgaggagcttaagaagctgcatttgctaaaacttccacagataagaccaatttatatactatgaagtagtaccatattgatatgatttatgtgcgtccattcttaaataacaatagtcggagttaccctcgtttggggtacagtaacccctcttccccggtaaagcaaaccccagtgcacgacatgccaagagaaagcagcagcagcgagaaaccctgtccgcaacgcaatctatgcgaagcgcacacgattccggagctcaacaaaccgagatggcgacgcctagccccttaggcaggtagacgacgcttgagcttgacatgagcacattagcatatggatgcagcgacaaataacagatgcatcatcacgcatataccacacctcgcttgccctctcgcaacccctttgcttaagcaagaggagattccagacagttgctccccacctactagtcgttccagcagaacaccacaaatgttaacttctcccccatacatacaaactatgtttgtatgcttagggtgtgtttagttcacgtgaaaattaaaagtttggttgaaattaaaacgatgtgatggaaaatttggaagtttgcatgtgtagaaaagttttgatgtgatgtaaaagttaaaagtttaaagaaaaaaaatggaactaaactcggccttaatgtgagaaaaatatactgtgcaaatctaaaaattactatagaataaaaaataaacgtctaaaatttatccatacttatctaaatttgcattacatatttcccgcttaatcatatataaacaacaatttttactgctactttaatttctttttctttttgattcgttcaaaaaccaaaaattggatagtgcttgagagccttataaatatctctctgaatttcttaatcgtaacgtggcaagctcgtgctacctgtacagctcactgtttatgacgtggtaacaatgttttgccaaagatttgtcatgccatattttgatttttgaacgaatttgtttttgccacggtgacatggaaggccctgccgaacggtttaaattaattacctgagcgttcatttctgaaacttattgaaatcttctttaaaagaacatcaaattcgcagcaaaggggaacccggtctcaataattaatcgaaggaataagcacaaatgcttcgcattacaggcgcgtatacatatatatttatcgtattttttaatctgatatatatataattttcttcttctagtctactacggcgaatgaatgccatggcgtgcgtacagcgagaggagagaaaaaacccaaaaaaaaa

SEQ ID NO: 60895 - DNA, 921 bp, Oryza sativa
ttgatgaaaaaaccctaaaatcagctccaaatttaaggttgaaaattcaaattttggttgataagcataagcataagcaaacagatgaggcccactaatttattttccgatttcatcatgtacttctccatgtgtgcatataatatatataaatgaatactttatactagtgtgaatgtatgattggttgattgactcgattctgcgtcaaagattgcaaatttatcaacagtttcttattagcgattgtatcatattttgatgaagtaaaacttaaagcatgcaccttcagagtgggacacacgaggtattctaatagtgatagatgggagctctccaactacttagggttagctcacattttggcgaaaaagatagaagatgacattgactttctcaagacaatggtttgtcatctgtaatttcgtcagcagaaggtactaggagcgatatgaaattcagacacatcttctgaatctttcttcgcatgcgctgccgtggcaaatttgctgatgctctccatgcctggatctttctcaagtgctgcatcaacaacgaacagacaatgtcagcaacaagatcccagtctgatactactgatccctttaattaacaaattggaggtgtcgaaattgtttttatcagagtaattttgcgtggcagattacctaactgaaaatgctctctcggaactcaactaaagtagtcggaactcaactctcacccagctttttctgtgttggctaatggttgccatgaactttcgcatcacacagagagattaagtgctcttgtattgatcgtcaacgatgccaacagcttggctaataaaaagaagacagcaatacatttttctcagagctgcttcaagaaactgtcgtgttgtccacaatcatgaggaggaccacattagagcattat

SEQ ID NO: 60896 - DNA, 1048 bp, Oryza sativa
catcctctgctgctcgccttctcctatgctgctacattggtgtgtttgttgtactgctgctcgactctgccgaggctgacccgtggagcattgtgggggttggccggattgccgggctgggttcgtggactgcatcctcgaagaccgccgccatcacgcatgcggatacgccgaggtcgaggtcgatggcgatggggaagctggcgcccgcccgctgctgccgcgtcagccatcgccgccgccaccactccggctcccgcttgccgtcgccgcccttgcctgcaaattacactacgagagagaaggtgaagagaaaggggggagagaacggggagagagggaaggggaaggagagagtgaatgacatgtaggcccacatgtcagtggggcccacaatattttttatgtgtgaatcacatgtgggtccatagattttttttttaattctaatgccacgtaagcgccacgtgggacgaaaactaggtcaacattgccacgtcagcgcaacatcagcaaaaccacccatcgaaaccaccaagggagtcaaattgcactggtttcaatagtttagggagtcgttctatccggttttacggttgaggatcacatattagattcgagttacttttaatggagtcaaagtggacttattccaaagtaatattacattcatgtaatttgttctaagaaaaaaaatagggttttgaaccaggcccttattctcgacttttcactaatgtatatacccctcacgtgatggaacaagtggcaaggaagataacatcaatccaaactacaactttttctcgtttttcgttaacacgtttcctaaactattaagcagtacattttgtaataaatctattttctagttttgtaatagaataaactaaacgtactgctatatgttactccaatatagagtttcaacccctcttgggttgcaggcttgcagctgcatagcaccgctgttcggttgcaattgttttgaacaatgtttgcttgtaaaaaaaatgctgctgtagaaggcaagtgtttctgattttct

SEQ ID NO: 60897 - DNA, 1473 bp, Oryza sativa
ttcgagcaagaaatgcgtgagatgatgatgatttcttggcttctcttctcttctcttgtctgagcttggtgtgtttgatgtgttttgtgtaaggcagagtggcgggagtggcatccgctacttatacaaggggaaagaagggaacggactgcggatggagggatggatggattgcgtgatttttttggggggtttatgtgggccccgttgcttgcacggctatggtttatgtttctttcagtttggctttttctagttttttttttgactctgtgacgtgtaaaattgagtagattagctcttttgagactaatctaccagtagatgatatggtttgttttattttgggagactctgtttcgggtaagaatgccacatcggatgcagtatcctttttatgttggccgaggtaaagggatgaggctgtttgtgggaattgcctgtttgtgtggaggtttatctcaaccgtcgtcatgcttagttcaacttcgtttggctaacgaactgcttagtactccactatacgacatggaaactgttgcttcgttctgcaatctgcaccaggaaaacagcaaaaatccttcgtcgggtgttgccaacttcacaggaagtaaaacaagaacgacatgacacgaccattacaattttactagtagtactgtacacgcaaatgcaacaaaagaccgagctgttatagttctacggacacctgtgccaacaaattgggcccacatgacctccaaaaatccgtgcgcttggatttggggattccggattccccttgtcaccctcctcacactttccgccggtcttctacaaacacacgtactagtagcataagagtagtaaacacgctctgtgcaatcatgtttccatatttcaatttcactactgctactactagtagcacggtttttatttcggttagcactgtctcctctccacgcagtcgcacacgtgtagggctcagcgcaggtatcgcgcgcgtgccgcccgtggagtcgcgccactgaacaggttgatgtgccgcgtcccgtgaagctgtatacgctttgcggcgagccgggtgccgtctctgaacgctacggttttctctcctcctggccacacgtcggagactcggaggctcattattgccgaagagtgtgcacgcgtcacggcgtcaggagcagaagccgccgcggccaagctaaggtcagaccgggttcggcctgcctccatgaacgaacggatcgatcccgcgatcgagcagccgcgcggccgccggccggcgccacacgtcaagtccagcgagccggacggcgcgtgaacgtgcttgctgccgaactagcggcgtcgtgtcaagttcattgctaaacgccgggaccgggaaggattactatagtagtactaggcatcatgaccacaccgagaattgtttgctgtgcctgtgctgtgcacgcagttccgctacaccacgcgcaacgtcgcgcc

SEQ ID NO: 60898 - DNA, 785 bp, Oryza sativa
tggagtaacagaagcttagctgcagtacttttgcacaaacgcctcatctactgtgaaacaactttgttggtctcgaaccgggaaggaggctccattgctgctctcaaggcaggcaaaatttgtactgtgcaaaccagctttgtctatcttcctcagaagcagctgaagcctgaagatgaacaaaaaattcttggttacgcagcacaaagggaaggagctggcatcgaacaggcgcttgcttgttggcttgctgtgggatcgggtgcccagacatggaccatctcgaacgaagcgaacagatgccgatgccggcatcccgtgcagtgccaggggggcttgtctttcatcagagtaaaggtgcagagcagaatggaatcaaaacgaaagcttaagcttgtgctttgccactactattctctgcgcattgtcgtctctttcgttcctgcacattcttggagattggtggcagccggggatcgtggacgatcgaagcagtgacattctgcgctctccggccgctcaatcgccggcgccgggggggagatcgagcgatggagtcggtggccgtgaacgcggcgcggcgggtggtcagcaaggcgctgagcccgctgtccggagggttcgtggaggcgtgggtggccagcaaggagctcggccccaacgtcggcgccgtcaagatggagctgctgtacgcgcaggggatgctcgacaacgcccgtggcaccggcggcagggaggcccgcagccccgcgctgaggcagctgctcctggagctgcgtggcctc

SEQ ID NO: 60899 - DNA, 742 bp, Oryza sativa
aaccaagggaaacataattctagtcaccactcattttctagcagtggtagaaatggttaaaacattgatagtccatacaactaaaagggcttgatcctcaagagttttgggaattattcaaagcatctgtgtttggtgatgagaaatcagcaaatgatcatgctaatttacttgagactggaaaaatgatatcaaaaaaatctgaagggttcccctttggcagcgaaaacagttgggaggttactgaaaaatcaccttgatttggaacattggacaagtgtcctggaaagtaaagaatgggaattacaaaccggtgagaatgatattatgccagcattaaagcttagctacgattatctcccttttcatctgcaacaatgttttacatattgtgctatgttccctgaagaccataaatttgctagtgatgagataattcacttatggataggactagacatcctacattcacaggatcaaaacaagaaaattgaagacattggattgagccgattgaatgatttggttagctatggattttttgaaaaacatgtagaagatgggtcttcatactacgttatgcatgacctactacatgagttagcattgaaggtttcatcgtatgaatgtcttaccatatgtagttcaaatgtcaaatctatacaaattctaccatctataagacacttatctattgtggttgatgacatggacgtaaatgatagagtgacttttgaaaaca

SEQ ID NO: 60900 - DNA, 1510 bp, Oryza sativa
gagattgaagcgaagtttgttctaaagaaaacttggtttaaagtttatggagtgtcatatgagattagagactttctcagtctacatgctgttggttctgtcattggtcaaacaacaactgtggacatgatttatctcaggaaaaatggtgtggttaggatgcaggtggcagttgatgagttagcagatttaccacctagtgtttacgttgttgtccgaaaccatggctatgaaatcttctttgaaccggaattgcctgaggtggatgggaaaggaaagaagaagattgatgatattgaccaggacggagaaagaaaaaatggtggtgatcatgatgttcacatggaagatagggacccaaaacgccaaaagaatggttctgatgggtcgctaaggatggaaataggaggcttagcgccagctaagctgccctcaacgcgcaccaataatatggttctagataatgaagcattttcaccgtctcctagctcagatacgcctgctacaacaacggagttggaagcgtttgcctcatactcctccgtggtgttggaaacgcccatgagtcaattgggagcccaagggacaggaaactccgagtcaaccaaggaggctgtcggtgaggtggtgtactccgacgaggtttcgacacagctagcgaagttggcaacgactaaggtactttctactgaggttgctgtgcagctagcaggaacagatgaggtggttacgaatggcaaagagcaacaacaagaacctgtcagcatggcacaagaattacagcatgtttcagctagcttcttgtctcccgtggagcatgtattggactgcaacgtgcagtctgaattgctccccaagaatagccagcttgcaggcgatggaagagtaacatcgactaagaacttgatggcagtactagcaaccaatgaagaccaacttagtgcctccagtgctgccacatctaaagcccaggatgcagcacaggcagttggagctcgatccccgacaagaaggcgacctcgtcgcccagtggaccctattccaactaggcaaagtgaaagacagaaggcgatggcaaatgcagatgcgccggtggcaaaccgggcagagctgcttaaaaaggttcataacctcgagacgctaacaggtaacaagtttaataccacaaattctgttgcttcaattccagataagactcttgctgcaaatttttctaaattaggggtttctctaggaaagaatgatttagaaataaaggagtccattaaccagattaaaatttcagaagtggatagatttgctactctttatagtagtgctgtagcgtctactagtaatgtagataaaagcaatgatgaattgttaaaattgtcttctctccagcacttatgtagtgactggctagaagaggctgagagtaatgacgatgagtctatggattctcaggccatacctcaaatgaggaagatttcgaccaaagtcaaacataaagtggtatgtacctcttttg

SEQ ID NO: 60901 - DNA, 1523 bp, Oryza sativa
acgggaggtccccggccgccatcggcggaaggcccgggaactccaggacgaacgaatggtcgcggcggtgctcgtcgacgacgccgccgaggccgtggaagtagtggcagtagatggccagcacggcgacgggctggatccagtagagcgcggacggcacgccgcggtcgcgcgcgacgtcggccgcccacggcaggaggagcgtgtagacgacgctcgacacggggcgcccccgcgccgcgagcgcgtcgaccatctccccgacgctgcgccggcccgaggcgtggaacgacgccatgtacgcgccgagctccgcggcgtcgccgcgcttgacgaacccgttctcggtgccgtcggagaacgggaggagctcgagcctgccgtcgccgtcgccgccctccccctcggcgaacatgcggcggtgcgcggcggcggcggtggagaaggtgacgagcgcgtcgggggcggcggcgagcaggcgcctggcgaggcggagcgccggcgcgatgtggccctggagcgggaacgtgagcacgaggaagtgcggcctcggcgtcggcgacatggctccacaggtcacgagtcaccgacgtgtggctctcggttagctagctgtagtgagagctctagctcagctcagctatggcgcataggcaaaatgggtggcattggccagctattttttatctgttagtggtgtggcgtttcgtgtggcgagcgagaggagtgcacaagagttcgagatggcagtgtcgcatccacgaactcaaccagcgttgcttttagttacctttaaacttttaaaaattccaccacattaaatgtttgggcatatatatatatatagagcattaaatatagacgaaaaaaaccaattacacagtttgcatgtaaattgtgagacgaatcttttaagcataattgcgtcatgatttgataatgtggtgctatggtaaacatttgccaataatgaattaattaggcttaataaattcgtctcgcagtttaccgtcggaatatgtaatttgttttattattagtctatgttttatactttaaatgtgtgcccgtgtactttaaaatttttacacctaaacaactaaacacggtccagattagttggcgtcatcactgagcttaagttggattagaaaaaagacgagtaagactgttcttcctgaccttacccagtgtcgatcagattcggtcgagatcttgtcgtctgtttgccagttccgtcgtggagtttgagtccagcgacatatgtcccccccgcttggtcattgtctagactgaaaattttgtagttagtctcgtactccctccataaaaaaaaacaagtctaatagggttctcttttagcacaacgaatctggacaaatcttttttaggttgggtatttttaagacaaccttaaaggatccctttctagtacaacgaatctaaacaaactctttctaggttggttttttttggacggagggagtatgctccagtggcttgctccaaaagggggatccact

SEQ ID NO: 60902 - DNA, 727 bp, Oryza sativa
ttcaaagttttatgcgacacagctcataaagcagcttgtaacagagtggtaccatggaggtggtgtaaaagaccacattcttaggatgagcaacatggcttccaagttaaagtaaaaagatttgggcatctcagatgactttctggtccatctggttatgtcctcattgccagagaactttgacaactttgttgtcaactacaaagtaagtctagaaaaatggaatcttgaagagctcatctctaattgtgtgcaagaggaggaaagactcaaagagaccaatggtggctccattaaccttgttaaagataacaaggaaaagagccacgggtcaccctcctcaaaagcaaaacagcctcagcatctgcctcagcaacaacagttcacagttgagacaggatcagtgtctccactgcaagaagacaagacattccaagaaagatcgtcctgacttcctgacagtgatcatggcaaagaaaggtgagaacattattacatttataaatgaatctcattatgattggttattctagatctacatggtggatttattctagagcaactattcatatatgtaattgtttaaagggattctgttcgatgaggactacgcaaagaagcgaaagatccattagagttgcaaatggagttgaagcaaaagttgaagctattggagatcttctcctagagctcgcgaatggcttcacacttttacttcgagatgttt

SEQ ID NO: 60903 - DNA, 809 bp, Oryza sativa
cacgaccaagccacccaagaaagtgagcaagacaaacaagacgccgaaaccggacggcgcaatcaagatcgttccactctccagtgccaatcccgacaagaccgtcaagatcggggtgacactaagcgagaaataggaactcgcgctcatcaccttcctccgcgacaatgctgacgtgttcgcttggcagccgtccgacatgctgggggtccccagggaggtgattgagcacaaactcatcgtgcgacccgatgccaagccagtaaagcaaagactgcggagatttgcaccagaccgaaaacaagccatacgagaagagctcgacaaacttctcaagcctggcttcatcagagaagtactacatccagagtggctagccaatccagtcatggtgcgaaaggccaacgggaaatggagaatgtgcgtcgacttcaccgacctcaacaaggcatgtcccaaggatcacttccctcttcctcgaatagatcagctggtggactcaacagccggctgtgagctgttgagctttctcgacgcttactttggctaccaccaaatcagcatggcaaaagaagacaaagagaagacaacattcatcatgccattcggggtattttgctatgttaagatgccattcggactgataaccgcagggaatactttccagcgcacggttcagggcgcacttagcgaccagctcggcaacaatgtcgaggcatacgtcgacgacatcgttgtcaagaccaagacaagcgactcattgattgacgatctgcaggaaacgttcaacaacctccgacgatatcgcc

SEQ ID NO: 60904 - DNA, 746 bp, Oryza sativa
agtggatcccccttgtggttagggacggatggttgtaaatgaagcatctcatcctcagactcatcgtcgtcgatggaggcaacgtcagagatagcccagaatcggccgcaaacgccgccgcctcgcgctttgccagtaggtgtgccggttacagcttgcgtcgagccgacgatcgggcttgcacccgttgtcagcgtcacggagggatccaccgcgatcgcctcacaaacgcctaaccgctaaacccggaacaccctcacaacaaccctttgcagactgcttaggcaaataattttaatttagaatttagtagttgtgaaattttgaaattaccaactacatgctcggtatatagactcttgagaggctgcattcgtttgcacctgattaggaaaagaaatatctcgttctccacgtgtacactttcataactgctaagtgttgtgttatttacaaaaaatatctataggaaagttatttagatttaaataaggaaaaagtatgaattaccccccctaactatcacggtcgtccgaattacccccctaaccacaaaaccggactttcttcacccccaactatgcaaaccggacgaattacccccctcgacctaatccgcggtggttttggtttacgtggcagtagagtcagcaatttatttattaaaaaaataggtgggccccacctgtcagtttctatctctctctcctatctcatctctcactgtctcactctctctgccctct

SEQ ID NO: 60905 - DNA, 1353 bp, Oryza sativa
tatcgcagtataactttagttgtttctcaatactgctcaaccacctttaaaccgggtgtgaatttctttagccagttcacctgccccgttgcctcatagcatgctataaactcggtatacatagtagaccctgcagtggtgtcgggtctcggaactaacaacttggatccgacataaattaatgtatcaatccctggatcagtagatatcgatacatacaatataaccggttcttcattgcatacgataaagttttacaatactaagggttttacaataataggtactcatctaattgatcaactagaattaatacacagcggaagtttttatacattctgactagggaggtataacctttaaggattctctaaattatcggggtcatcgtagtaatagtcataagggtcctcttaacccagatctgaaaaaggggttatgagagcaagaacgagtattcacaatactcagcaagttatcatgaaaatatgttatgcattggcatatagtagggttctttgcaaaaagtagaaataaacaatctggaagagttatagcaagaatttataaacatatagactttagatttctaaccagggtaccatatgaatcccggtactcaactccatgagtacggctattcgaatagtttcaaggatattctactgcagcagatgtacgctttacccacagtccacgacttgctgataatcatcggctttagtcatagctcagtattaagttattaacaattgtggcacctattccataaacttatatcctcatatgccctgaacgtattgttaacagcagcaagaggagttctggcgttcccgaggtatttaaggggaactgatcgtatgacaccacgtcatctcgatcagggtttagaaatataccatatagtttatactcgagtatcacaaaccatttacttgtacatggtaatggttaaagttgcccttcgcggctatagttgcctcctacgcgaggacttaaaaataagaaccactatacagaggtgccatattgctaattaacataataactaggtctgtccccattctagaaactgcggtcgtactcgttcgttcgacataagtacctggtaaaaactatattgatcgagacagtactagccacacggaaatcaaccaaatcttacgtactaccccaatctaagtataaggtatttaaaccagattgtaagcaaagtaagcaacactaaattatctgggtttctatggttgatttatgcatataaaatagaatattgaatagaaggctataaataaataatttgcaaaaaatgggcttaatgatcaaaagggttatgggtcctgccttgctcga

SEQ ID NO: 60906 - DNA, 769 bp, Oryza sativa
ctaatttaatcaaaagccagcatgatgcagtcaaattttagttttaaaatttgaggatgttacaagtggtgatctgttttgagcttttccatgaaatagctcctactgccagggtgaacacatatcccgatgttgactttgtattatcttttgcaaagttagaatctgaataccccactatctggagcgattctgattttctgtaagacagcatgaggccttttgttccttgcaaataacgcaagactttctttactaattccagtgctctaggcctggattactttgaaatctgccaagtatcccggtaacaaatgccaagtcaggtcgtgtgcacacttgcgcgtactgtaggattcctacagctgacgcatatggctttattttcatttcattgagctcatactgatttttgggacattgcgatgccccatactttttgcctttgactataggagcaggtgtagcactgcatctgtacatattgaatttcttcaacacattttctatatatgccttttgagaaagtcccaatgcatactttgttctatctcggtgaatctctatgctcaaaacatatgaagcctcacagaggtctttcatgtcaaagtttgaggacaagaatttctttgtttcctgcaatagactgacatcactactagttagtagaacgtcatctacatacagaattaggaaaataaatctactatttttaaactttgaataaatacagttgtcctcgacattctctaaaaagggggatccacta

SEQ ID NO: 60907 - DNA, 745 bp, Oryza sativa
ggggtttttactagcccagtggatccccccgttgaagcgccgaacatattccctcaaggattcactcgagttctgtgttaacgcgtgtaggtcgtcttcgatcgcgtggcgcttgtaggttccttagaagttggcgacgaactgctgccacaggtctgcccacgaagagatcgagtagggcgggagatgcatcagccatgaacgtgcagagccatttaacgcggttggcaaataatttgctaatgcattgtcgtctgctccggcaacgtagagtactgtggagtagacttgaaggaactcttctgggtcggtgctcccatcgtacttctctattgctccaggtcggaatctctcaggccatcggacatcatgcagggaacgactgaaagctctacacccagcgctgggggcggtgggttatcggcgatcgtgtgtccttcatggatgtctatctgatgatgaggaagacgaggataatgacgatgacgatgggtcgcttggttccagtgtacgattacgaggttgtcggcctggctctcgagaatcctgtcgccgtctcccgctgttgtctcggcgccggtctccatcatcgtcgtcattatggcgacgtcctcgaccagtatcgcctggcacccgctgttcgcgatcgttgtgatcgtggcggttatcacggtctcagtcttcgtttgaacggtctcctcgatctttggtatcatgacgccgtgaagagacatgacgccgggaa

SEQ ID NO: 60908 - DNA, 744 bp, Oryza sativa
ctattttccaatgaacttcattaggatttggaggcttcagaaaccgcttcgagagcgaagggacaactgagttgaagaaatgcttacgtgacgatgaaagctatccccactgtgcccaaatttctcttgcaaatcctcaaatgaagcattgtgactaagcatgtataagaagaacgccaacttctcttcaactttaatcctagtatcatcgaccaacttttcagttctaaggtaattggccaaagatataaatatttccggctccatcctgaatgctacccggcaattttttacatgcccttcaagcaactcccgaacacgctcctcgcatgttatctttgatgtatggcatcgcttcttttcccttgctccactagaactcaacaaatgtagtgcagggaaaataaacaacatcatatcatcgtcctcctcttccctcctctttctagcgcggtctcttgctctcatatccatagtagtactatagatagcacacaaattatttacaattttgcacttagcacagcaacaaaagatctagaaagataatcacaaaagaatcactaaactatgggaattaatcttaagaagatccaagttatgaagcatatttaaaaattgatgggaaaaatgaaaagaacaataagaatctttttttcttaaagagtgcacagtgcaacaataattgatggcagtagcacttacagaatgtatgaaaaagcagattacatggcagtagcactt

SEQ ID NO: 60909 - DNA, 880 bp, Oryza sativa
tttttttttttaaaaaatggcacctataaaataggtatcggttattatttagaactagcacctataattgcttaaaggggccaattttttaggatttcaacatgcgaaagtggaaaaaagcctacaggtgtctttttagcacttacagcgcatatagtgctgacacctatttgatattttgtagtattgacagtggccttcctacatttaatttcttggggtgaacgcgaaaattaaacccatataggctattcaattattaactatattaattaatatattaaataataagtatgtattatatcctcgataattttttttatgtgtgttcgccgccgcgtttcggagctggattatgagtgaggaatctctcaggtaaactcacaaatttgcataattaagtatccaactacaagacctttctcacgggcatcagcttctatctcatccggcctccataataaaattatgagtgaggaatctctcaggtaaactcacaaatttgcataattaagtacgttcccctgacattaggattatatatatacatcgtatactacttgtgagaataattagcatgccatattgctagctactacgcgtacgcgtatacaaagacgtacaggattcacatttctgacattctgaacgtgatacaccatgcaaatatagatgaatcctacctaacatacttggatagccatcaccaaccgtacgtgtgctgccgaacccacccaaattaaccaatttggacgagtatagtgtccagtggtaggtgacgtcctgacgggatggatcaaccacacgtacgtaaattaacctcggacgtggccggacatttacaaggcttagtaggtatatatatacttaaaagctcgaa

SEQ ID NO: 60910 - DNA, 1204 bp, Oryza sativa
atgggatgttacaactgcaatttctgtgggaatggccggatcagctttttcagagtggcatggcatattcaaaagctagatttgccctattttttttaagcttatctactgggttgacatggattatttgttctggttttaaaaagtaaaaaatccatatttcagcgaagcacttgatcccctaaactatttttactcattttacagcttgaaatattgaaaatggttcacttttactccccttacactatttcttccccctttttttctctctacataattcatattttaccatctataactctaacaatttttagcttaaaatgcaacttatatgaagagtaaaaaaagaaatgttattacggccaaaatgaaacatttttaataatttagcgataaaatgagtcaagtttaagggttaagtgacccaataaattagagagagagagagagagattaaaatggagtacatgcttccattttggccgtaaaccgcagctacaacctcgatacagtatgtttacaagtaaagatggaggtaaaacgtcccctcgagctagcttgattggttaatttcccaccaaccctctcatcaatcaccagcccggattagctcagtaattaatcacgagatgaaattaaatatatattcagagtagtgaaatagtgctgaagggtagtaacaaccgtacttaaacaatggcgtttgccgtgttatcttatcccgtcgattccggaaaagagaaggttactgtgtaagctagtggtgcagcctagctagttaatttgtacgaaccgaaacacgttagctcggtccaataatatagctcagtgtgcacatgcaggtgtggactcttggctaattaatttacccccaacaatatgcacaaattaaagtttaaatttcttgaggtctatgtgacaacaacgaatcacctagcaaatgctgaatcagcccggaaaatctgcaacattttgcgtcgaatcatcgatcaaactattcaatgtggcagatgaacgatcattttgtcatcgcccagcctatgccgcgtgcctacttgtcctttcatactgaatactgactactgagcaacactcaccatgttaattgcacggtgaaaagaaatgcaaccttttctatcatggagtacagagaaaaattaaatcagcattggcttgatcgttacttaattaattttcgatg

SEQ ID NO: 60911 - DNA, 2221 bp, Oryza sativa
tcttttaaattgagacatctgattttttatttctggctggacggccaatggtaagcatttccgggaatacacggcttcaatctgattcacacactgcttaatgatttactcaccaggggtataacagtcattgacaaattgcaaaatcattttttaattttcctttccctttgtttatctcaaaaattctagtcccacataaccacggtcaaaaccagtggcaaaatggttgcttcacttataaaaagtaggggcaaaaacaaccctaaaagtagggggcaaaatcacaattggatcacaaagcaagggcaagaacacaattgcccctatgtttttatatctatcttgagaaatgctttcatgatacataatgtgcacgttgttaaattttatgaactcataaaaaaatacaaattttgctataggatacctaaaatttgtgtaatttgctagtagacatcgaaaaacgtgtcacagcagaaagacatattataaaactagtaatttgctggaggacactttgaactcaattggagagataaattcttaagaaggataagaacacccctagaacccatacttcaaatagggtccccttcaaatatggcgttagagtgaaaatttgggaattatacaactctaaatttatcatcatcctaaatacatcgttagtatgtatcatattccatcttcactctaagccttagcttgaaagcttttggccctagggcattctcgtttttgtgaagaatttccctctccaattgaattgaaagtatccttcagcaaattactaggtgtttttcagccgtaacacggttttgtcatttctactagcaaattacataaaatttgagtgtatggtagcaaacattgtcaaaagaaaatccaacgaaccggtataagacactgccaatgttaaatcgaatgataatcaatctgaaatggagagattagtttggtttaatttgcaagcaggcgcaaaagaggttaacacggctaagcggttgttacttcccgtaccgaccgagcaaaataagcattacttggttgttaattaatcatctctctatataatggaaacggttcttgtacttagcctggtcgcttgaatggcttgcagagttcggttggctgattgagatcgatgaaaaaaggcagtttagttctgcatcaagcaggcaaaaaggccagccggttgtagtggtggttggtgattcaggacgcagatcggagcatgtgatgtgcagtactgcaaaatggtactgcttggtttttggacgtttggctggtggatttcatcgtttttggtagagttggtgatatttcgctcgaaaacggagcatatgcatgggacaagggttgaccaaaggcatggagcagctgatcgagctccacttcgaacctttttcttcttcttcttcttttgtgattatgaggataatgccaccacttcgcgcgtacttcttatataggcacacaccaacgagtgcatcctgtttaccacccatttcggttaagttctactcccttcgtctaaaaaaaccaatctagtattgacaagattcgttatactggaaacatcccattcaatagtaggttggtttttttttgggcggagggaatagtcggtaattcggcgactacttactcattctccttgggcacgtttctgagctgaaaaatgggatgtttagcacaaaaaaattatatataaaagtttcctagaaatcaaataaatctaattttaatacttgattgaatatacgctaataacttatctcgttttaagtaccacctaaagtttctgtccaacgtacagctgatctaaactcagactctaaataatcgtaaatcatgtactcccttcgttccacaatgtaagttattctagcattttccacattcatattgatgttaatgaatctatgaatatgaaaaatgctagaataatttacattgtgaaacggaggaagtaactgtaactttaccaccacatcgtttaagcctttaaggtggcttctcgaaaatcgattttattcttcccatttttagttcgagctagtataaagcatatgatatgctctagaacatgcagcgctaacttgcccgttgaattggagagtgttgtttgtcgcattggatgctacatatgctacttcgggaagtaaagaaatggaggacatgagagctgctacgtacctagtaggtggatatgcat

SEQ ID NO: 60912 - DNA, 897 bp, Oryza sativa
cactaccacgtaagcaccacgtcagcgaaaccactatccaaaaccgttaagggagtcaaattgcaccagtttcaatagtttggggagtcgttctatccggttttgcggttgagggtcacggattagattcaggttactttttaagggaatcaaagtggacttattcctattacttttcttacatgggctcaaaatcacgcttggatgggctgtaaaccacaaatttttacgctggtttggcccgaatacctgatacaccccaaaacaggccgaatccaggcatgcctcaaccaaagtcaatttactcgggaaaatactgttctagcctcgtttagaaaggaataagtccactttaactccctcaattatagctccagtctaattcgtatcacccaaccgcaaaaccagatatcctaaccctccaactattgaaactagtgtaattcgactccctcggctgttttgagatcggtttttgccgtcgtggcatgttgacctaaagtcaaaatggctgagtcagcatgcggatcccacgtgtcagtgtcatgtcctctttattctctcctttttctcctttccccacacgacgcccctggggcagcagcaccatcgacaccctctactgtttgctcgcctccacaagttctccatcgactccatggacacgctccggtgccggaccgctagcaaacacgcgacacaacagccagtcaggcagcgagcggcgatggccgatgggcggactgagggaatcgaggcgatatggaggcggagtggattgcggcaatgactagcgatgggcggacttaggggattgtagcgacgaacggagatggtcgagggagagaagggggtcggtggtggtgtgctttgcagcggcatcggtggcgctggact

SEQ ID NO: 60913 - DNA, 1314 bp, Oryza sativa
gcccgagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtattgatttctggtgtttcaggaattagcagtagctaacagtttaccttttttgtgtttcctaaggtttattttctggttttgaatgtataggtaccttgctgagtttaagtcaggagctgagaggaaggaagcagctgagaacactcttgtggcatacaagtctgcccaggttggcctccgtgtacttttgccaatatatatggtgtatagcggtgatatttagtttgctatatcattatatttttcttggagtagctttataagttctgatatttttatgtcattcctaccagtgattttttatcctccatgctgtatcttcttcaccgtaggaaaatacttccagtcttgatttattttataagttcaattttcatttatgggatgcatatttgctcatgtttgagacatacgctgctatttatggcatgtatcatgtggcaacgttgagttatttattgcagcttcatggattttgatgcatatttatcagcagaaactgcacacgatgacacttgattgcttttttaggatattgcactcgctgacctgcctacaactcacccgataaggcttggacttgcactgaacttctcagtgttctactatgagatactgaactcaccagaccgtgcttgcaaccttgcaaagcaggttagtttttcatttttttcccttttgaagtttgtatcttcttggtatcttgtattacttaataacctgaatatttgaaactgaaggtgcttgattgctagtttttcatgaatagttatgcattttttttatgtagcaaaattcacgtgcaagcatagaatttaattttgtttggtaaattgagggaaaataactgatgattgcttatagtatgcctgttactaagtaaagtaaatcttctgtctttgtattctgttcaaccttaagaatgctgttcactgtgttttattatgcattcagatcagctgtgatgcgccctcttgatttgttttcagtatgtatttatctactccgctgcgtgtgttccatgtttcttctagtttgttgcatgctttttctagtttttagcacatcacattaaattagctact

SEQ ID NO: 60914 - DNA, 1540 bp, Oryza sativa
tgctattgctgaactggacactcttggcgaggagtcttacaaggacagcaccttgatcatgcaacttcttcgtgacaatctgactctctggacctctgacaatgcggtatttgctctaatatgcttattatttttcctttcattcatttatactgtaattgttatcaaaacgattttctggcatctaatcttatgttcctctgttcttctcccttcaggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtcctttatttgtaagctcgatgtggacacgttggaattcgtgcttttcttattgtcatgagagttgagatgatgtttggattggcggcatcctgtccgtccaagggtcaatgttattttgaaggctagttcatttgacccatgaactcttcagtttatctaaatacaaccataaacacagtttatctaaatatacccataaatacatttggccccctgacgcaggatgccaagcttacaaatctgtcatctcagcagcccggaggctttcggtgggaggagtcgatctttgaactttttttattttaaaaataaactcccctaaaacttatttttaaatagaactcttttggcatggcaaagtaatgctaccatgccagctagtaaatacgttatttgatcacacctgatttggctatcctgataacgttgtttcgtcgtgccactatggttgacgtgtcatcataaaattatcatattacatgtgacatgactattattttgttgtttcgtcgtgccactatggttggcgtggcatcataaaattatcatattatgggtgacatgactattattttgtcatgttaggtggattggcgttaaaaaagatttaaattttagaaataagtttttagacggattatttttaaaattgcaaagacaaataaataataaaatttcgagtctctacctttaggctaatcggatctatatatcagctaggaagcacttgaataaaatgcatataaaatcatgacgatggcgatggttgtttttgctcaattgctccaagcagaagcgtcgatcccatacccaatcctacacctcttccctgatagcctctcgtcttctcttacctccattgacatagctattgtatgagattgaatttttcttatgcttcttgcttcgtttcaggttgaatcacaaacatgatgagtcgtacgctgttaggattatatt

SEQ ID NO: 60915 - DNA, 987 bp, Oryza sativa
aagcctaattaattcataattatcaaaagtttactgtagcatcacattgtcaaaatcatggcgtaattagactcaaaagattcgtctcgcgaattagtccaagcttatggaatgggttttgtaattagtgtatgtttaatactctaaattagtgtccaaacatccgatgtgacagggacttagaataagtccctggaaaccaaacagccccttaatgctctaatgggttaaactacgtaggaggaatagaggatttgctcttattgacaaccaatatttactatttattcattttatgtagacagagttccaccagagccctagttttagttaaaccaaatcattgaacttctatcaagccaaacattcaatttagtcacatgattattaagctcattgctcgcttaattctgtctcctctgataaactgatcccacaacctgatcgaacaagttagccaaagaaccgaacgagacatgtctcgtgccctcacccacaattggactcatcgtaacgctattgtcaagtcaccgccataaccatggctgcttcctttccttacgaaattggggagatggggattcaaagtatttacaccatcacatagctatggctgccggtggtggatgagtcttctggatcacttgaccttttggttgtgaggctcgtatgcatgtcagccactcaaagttagagaactgtatatcaaagaatttgttttcgccaacgtcttgaacctatacgagtgaagatccagccctcgaataggtggagagtagccaaataacattttatatattcaattttaggtgtggtatatactactcctctgtacttaacatagttataactacactactttatagtataattacatctgaaagtttttggagagcttttctgtcgaaagtcatatacatagtttttgaacaaatactacttcaattattaaaatgttggattttgcctaattgctctcatgccacg

SEQ ID NO: 60916 - DNA, 2462 bp, Oryza sativa
tgctagcatttgcgctctctacttcctcaattagagtaagacttgcgatatgcttaacaataagtgtgggaagcaatttcagtagcataggctttgaggatgcagttatcatcctaaactagttctgtatagccattcgatctagcaacagcctttgtacaatgagttagttatgaatgtaaactttcaccatttgcttaatgttaagaggttagtaggtatgatttgtgagggtagcatgctgctttcctgctaactgtagtttctgttagggacttataatgtgaaataactaccgagtatgaatggccgtgcactataggagaaaatcacggcgagtttgttaagttctcttgcatgtcgatgaaggttgatacaatgtaaacgttatgctatctattgcggattatctgactcttgcttactttgcactttagactttgatctggagaaggaaagaggtggtttggatgagcagggtttaaagattgcagagaatcaagagaccagccagaaaaacagacgccggcttgctgagagcactagggatttcaagaaggcgtcttcagatgataagcttagtttattcaattctttgctgaagagttatcaagaggaagttgataatctcacaaagagagcaaaatttggagaaaatgcatttctcaacatctaccagaagctctatgaagcccctgatccatacccagctcttgcttctatggctgtatgttctatctatcatctactgtagcttatttctaatccccccttccgccttagtatttttgccaaaaccacaaatttccaccaatgcttaacattttgccttgtttgttttagccagtttccatcttgttatttcctattgacgcctaagtacatgcctgaagaattgtacttgtagttgtatgtgacataaatggttatagtaactcttattgttctgtaactatgtacaaccgagcaagttgttgcaataatatgtccagttacttatttgaaactataatagtaattttgtcagattgcaaaatatagataacagttagtttgctccagcatagtagaagtagtaaattgttgaaattacaaagccggatactgcaattttgtataacaaagccagatgtctcaactttaagtgcttccagaggagagctttcaacttcattgttttgtactgcaatttcgtgtaacaaagcaagatatttctaactttaggtgctttcagtataatagataggcttcaattattttatggcactgacatttctccccaacctgtcctgtttatcatccaatccattcaggagcaagatcagaaactatctgaactggagactgaaaatcggaagatgaaacttgagcttgaagagtaccgggcagaagccgcccacctaaagaaccaacaagcaacaattaggcgacttgaggagcgaaaccgccaactagaacaacaggtctgttctgattctactcagttgcttgctctcttttcttagctagaattaagtctatttcttgttctttccatgaaggaagtaaaaaaagataagttcggtcggatactattgttttttcactcgtaaatagtgacttattatatccacatactgtatacctttgaatggcagtccatttttctgacaatttggaacctttatctgtagaaattattttaaatctagtttcagaaactcacaatgagcaatattttagctattcttttgcatagattctacattctagagacagaaatgaatattttacctaatagcaatataagtatgtttttgttctgctgatattctgacctattaataatgtacttctgagcataacacagtcaatcaaaattatgcgataaacatgtctctattttacataagtatgtttttgttctgctgacattctgacctactaataatgtatttctgagcataacacaatcgatcgaaaataataaaaatgtttctatgttatttaatttgtatgaaaagtgaaatatttttttttcaaatatgtgtgttgcggataattattattggcccaataacttttcttcattaaattcctgctgatttcttccaatttatttcaaacgccaaacttccattgttctcaagttcttcttttctttttgcaatattctttcttccatttaataattttagatggaggaaaaagtcagagagatggttgaaatgaagcagaggagtttggcagaagatagccagaaaactcttgaagccctgaaagacaggtactgtgaattaatggtaactagaaatataactgctctatgatcatcatgtttccaatgcttttttttttgtctgaagcatattttttttaccttttagtttttcatggttgtagggagcgggcattgcaggaccagctaagacaagccacagaaagtgtaaagaatatgcagaagctacatgaatcagcacaaa

SEQ ID NO: 60917 - DNA, 5146 bp, Oryza sativa
aaattagggaattggacaatgaaatatctagaatatctacatcagaaagaagttgcgggacttacatgagactgtagctgtagtttgcacagctattgcttgccagcgtctgatctggaataccatgttttatgcctttattgttttcctgcagggtgatttacgatctcagttgcaaacaacaaatgaagatgcaaccaatagtaggttagtttatttgcattttccatatatatgatgtattaagccttattgatttcgaaagtgtagatttgtcagcatccataattcatatattagtaacacgtggctcgcgcctttcaccagtattgctgtttattagcattttatttgtttttttctgtgcttacccaaaagtaaatgctgaacttattgtctgaatcatgttattctacagtgactacgtggactcaagtgatatacttgagagttccttgaatgccaaggagaagatcatctcagagctgaatgcagaactgcgtagtattgaaaatactttatcttctgagagagaaacacatgttaatgaactgaaaaagttgactgctttgctcagtgagaaggtactcgtcatcaaaagaccttactgtgtaaagtcgataactgtttcttgaaataactcatggcaggactgtagtagaaaacaactttaaagcgatcatttacctgtctattactcatttatcacaatccgttgtcgaaattttgttgaatataggttaatttctttgcttctatcactatcgatttctattatgctagcctcaattgttatgtgtgggttttatagaatgtaccattatatgtattagtcacatttttggtgtggattgaagcatcaaaaccatgcatatattatttggaatgatttctttctttgcaactgtttgttacccactattttactttgctaattaacttccaatctgtaggaaaatgctctgacagagttgaagaaagaacttcaagaaagaccaacaagaagactagtagatgatctcaagaaaaaggttcagattttgcaggtatttagagaaaatactcatgtcatgaaattctttatgatattttctgtagtacctgtattacatccaccagttggttctgcactcattgcatgcccatttaatgtaattgcaaatctgaactgtacatgatttctgctttcctatgttgcttcctgtagctgtgtaagtagtaccctcatcatgttgtacaggtggtgatcctaaaataatatcttcgtggtagcattatgttcttttccatcatttctctacgaagacctctctcccccttgttatgcttattcctgatgacataccaggctgtagggtacaactccattgaagctgaagattgggagctagcaacaaatggtgaagaaatgagcaagttggaagctttgcttcttgataagaaccgtaaaatggagcatgaactaacacagctgaaggttggttggcctttagtttggatactaaaatgcatctaggcgattcctcgtgcatacagaaatgcaaggtgaacttgtttctctgttctgactagccatgttcttataccttgaaggtcaaaatatcagagaagtcaaatcttcttgaggaggctgaaaaaagattgctgagctaactgcaaaggctgaagagcagcagaagtgattttgaaactcgaggatgacatactaaaggtttaatcagtagcaattgatccttatggatatagtactttaccattttagtataatatgtcaatttgaatcatgattcatactgttacaattatgtaatctcacaattcagaaaatgaaaaaccaaatgatttattattttagtttcatcttctgaaggacatgcaactaatatatattagctttattgcagggctatagttcaactgataggaggacttcacttctgaatgattgggatcttcaagaaattggctcaaatgaagtagcagaggtaatttccaggttgttcagtatcttatttgtttaaagcttgtgctggttgaagtttgttttggaatacaaactaccaaatcccatcctcaaagcaccatatttgtttattatatgatgtataatgcctgctttaactcagcagtggacaaaacatgcaagagaaactcaattgaaaagttcaattttaaattcttatatacatcttgaagctgtcataaagatctggatttaccatgaatgttgtcagtgtacagagatgctgtactaaacctctttatctgacgtatggattaatcactggtcttttgtatacactattttcgtaactattggtttgtaaacttatgctttaatctaaaaatcctgtcttgcctttccaagtcaataatcaagctaacaaactatagtagccttgttttgccatacttagacaaaatgcgctaaaaatttccttctctattcattcccaattcgtagcaaacatgtgttattttcagttagttgctataatagaatagccttcactcccttgttaatacatattttcagggtactgatccaaggcatgcaccacaagaccaagaccaaagttccatgcttaaggtcatttgcaatcagagggatcgtttccgtacacgtctacgtgaaactgaggaggtatatttcatgaaattttgaaaagggactgtaccagtttacaatttagagcaacgatgatagtgtagttctcatgtgaattagatgtgaaatgacatgatgtgctaatttcttttagtcttttcgatctgttgtcctttttactatattaatggatagcgagatgagagggtcatgcccttgatttttctttgaagtggggatctgtatatgtttatttatgatttcatttttatctatgtgcctctttgttttgttttgttttgacttattgccattttgtgtctcctaggaactaagaagactaaaagagaagtatgaaatgctagttgtagaattggaaaaaactaaagcagataatgttcaactgtatgggaagattcgttacgtgcaggactacagccatgagaagattgtttccagaggaccaaagaaggttatacacatcctttcaagggaaaatagcaaaatccacagcattctagcttttgacctttgttacattgtgttttgcagtatgcagaagatgttgaaagtggttcttcagatgttgagacgaagtacaagaaaatgtatgaggatgacataaatccttttgctgctttttcaaagaaggtaacaaaatgtttacgttttatgataacgtgttatatacgttactctatagcttatacatacatttaattccatatccaggaaaaggatcaacggtacaaggaacttggtttaagagacaaaatcactcttagcagtggacgttttctccttggtaacaagtatgacaccatcgttttctccctttttttctttgggttcaatttcaggctttgcctcttccttttcatggcacatactgatctttgatgataactggtaaacactagttagagctattcatggcaaacttctatgtttcgaccataccaaatattatgatcttgtgtttaatgatgttaggacttatgagtctagttaatgtgccttgcggccatgcaaacgacactctccctggtagcatgtttaaaccagccgcttcttattaatgttagccgtttaatgggagagtaattcttttctggaggaccaggaaacacctatcaatctgtcataatgcataacagatctgctggttgagttttcgttcacttttcctttttttttaaaacttatccatgtagcggaatgacaagtagcttatgtaacatcttttctatttgtattcacagatatgcccggacatttatattcttctacactattggattacatctccttgtatttacattgctgtacagaatgtcagctttgagctatctcaggtatgcatgcatcgccttttcaaaattttaaactctgttcctgagcatgggctaacatggaatatttgcacagcacaacacctgcaaatgatgaaatcatcttggacgctggcaatcagacgctaccacatgcgctctaaatggaagttccatgtgtctggtattatcacttcatcacgctgaaaaccaaaatctggggtttgatctcaggaaatctttgcataggaccatatgactgaagccatagttgacatgtattctttatgtccattagacgtctgaatacgttttctgtagataaaaattttccagatatggagacggggtggatgggaaatgacaggatgaggcgtggtcgtgcgtttgagccgttattatgtaaactgttgtatcactaattgtcaattctgtgggtaaaatgaatgcacgcctgataatgatggttgtacaaatgccaaaaggataaagtcaaacaacttgagtaatgaaatcaaagttgtcactaccattttcaaatgaaaaattttaatgcttagaacatccactacaattctagtggtctaattctttttagaggaattagtggttcagctctaatgctccttactccgaaaactacaaaccagacctgatgagctttgcctgaacaggattcaccaaacacagtactacacaacttgtccaaagtcacattatcgacagtatatttgcttgtcttcgccacaccaatcattaattctgttctctcgagctgctggctctctcgaactaacccaaaaaaaagaagagaaaaacaagcaaaaaaacatgtaaaaactaacttttccttttttctcatttcggtggggtttggatcaggatttaactaagtctttgtatttagacactaatttagagtactcccttcgttttttaacagatgacgccgttgactttttctcacatatttgactattcgtcttattcaaaaaatttatgcaaatgtataagatataaatcacacttaaagtaccatgagtgataaaacaactcataacaaaataaattataattacgtaaatttttttaataagacgaatggtcaaacatgtgagaaaaagtcaacggcgtcatctattaaaaaacgaagggtgtattaaatatagactacttacaaaactgattacataaatgaaaactaatt

SEQ ID NO: 60918 - DNA, 6028 bp, Oryza sativa
gaatttctattaaaaacccatttacttatgcctaatatttttaaatccacgacaacaacaccgcatcactattgttttccaataggataactcattagccacagtagcagcaagactgcaagagccgggaaaaggaccggacttgtccttcaccgcggcggcaaagccacaacggcgaggctgccgacagccgagctcgccgcggcctcgcctggctctctctcccggcggcacagagcgcgcgggtggggccgcccggccgcgtcgcggggcgcgcggcggtcgcgtacgggccacaggcgcgtcgcatggggcggatccggccacgtcgcccgcggaggtggagggtgtcgccgtcgggcgcgatctggcgctgtggctatccgtcgagtcgagctggtgtggctctcccctgtggggcccggacgaaggaaagcccctgcagctatgctcgacacgtcagctgtagtatcactgtgtgtggaatgtgtgttgattttcaccggccgtacgcacttgaggttgaggggatgtctgaacatcactgatttggtgagcgacttatgtgagcatttttgctaagaaagaatctcgtcgcttatcaccctgcaaatagttcagctatcaacttctaacggcgttttgttgatggatgattggtgatggataaaactgagtttaggcactacaaagttgatataaaaaggttctatactgatgaatattttttttttcaaaagtcatactatttaataggttaaaaagtgtctccataatatgccttacatttacgagtagaccgtgttaacgatatacgaacttgtcaagtggatgcaatttagtacacaaacttacgagagaagtacataaacggtctctaaacgtgtgtgggtgtgttacctaggcttctgaactcccaaaatgcatttttgggtctctcaatttgtcttgggtaccatatagttctaaatgggctccaacccactccgtgtgttgatgtagcatgccatgatggtgcatacgtgtcagtagaacccatatgtcagtcatatattgaaaaattaagaacataattttctcctctctttatttatttatttttcaaaattaaaaacataattttatcctctctctcctctctttataatttttatttttttctatgtgactaatatgtggattccgctgacacttaagcgtcaccatgacatgccacgctgtctcatggagcgggttggagcccatttgaacctatatgacacttatgacatgtttaaagagctaaaaatgtattttgagagtttatggacctagatgacatatccgtacaagtttagggaccgctcgtgcacttcactcaacttataaacattatgatgcataaacttttcttttgcgtgcgaacatttgtaaaacgatgtattatatagctagtctgattatagaatgttacacacatttgagagcatgagacatgtcgtatgtgcaaataattaacatttacactgtacttaatttgttcttatattatttcgtatccattacatatcccctttatatacatttttaatatgtataattaacatggcttgttatatgtttgatatgcatatctactaacatcatcttgaaattcgagcctacataacatccatctgcatccaacttagtgaaattagttacgacatgtttttgctttggtttatatggaccagacaagtttatacattaaaatgagtaatttacaaattccatatactaaatcacactcacctcgcaagttcacgtaccaacgatacaatttacgctagaattactcaaaagagtatactatgagatgtgcttctatgctcttcaaagaaaaaattgcacaatttttaaagaagatgagaggttcagattagaagtacttcaatagcctaaaccgttttaacaagggcatttttgtctttggagaaaattaccctgtatcaccgcccctttctcccgccgttcttctccacctccggcgccatcactcgaccattttgtcaaaatcaccatggcggcgctacccccgaacaaagttgtcgtaggcgccagtatctactctggtcctctcgatgaagcttcttgcccgtgattatgtcatcgtggttaggactgcactgcagcctgatcccaacactgagcagatccattatcatctctgatttggttgctttaatcaatagcatcacgattaagtaattcagctagttctctcaggtttgatgcagaggctacaaataaaaaaaacagatcggcttataacttttgatgctgtttcaagtgatgaacgatttgtgtttgtgatgcaatgcaaatgcaatggtgatcgcggttgttgtttagtggctttcagtttgtgacggcggcgagcagaacaagttgccggtgagctttggtgtggcttccgaacttttaggatcggagattaactccctctcaaggatgaaattgccctttctgaataatgtttatactatcctttcatcttctttaaaaattgtgcaattttttctttgaagagcatagaagcacatctcgtatactattatttagtagctgtgtcaattactcctagttaacacccactctagggatatgctgacgttgcatacggcatgctatctactttgcccatatcccatgcctcatgacttgctctatacgtgaggttaggatctaacaactggctttgttaggacccatgtgtcgatagcatatcaaagatctactgcttacctggcgtgccacatcatcagtccatcgctgatcaggaacagccacatcttccaaggccatcggctgaagttcatggatatagtatacgtgccttatgcatctcctcaagcccaaggagtcgaagcactcacactttgtgaacctagcttggcagtgtctcacgctccacacatatattttttttttcatgttagaataatatgtatatatatggtgtaacaaagtcacagttagttacattcaaatatatgtaggagagcaactctgtccacaataattattctcaccagccaattattctccacaaaaattattctcgcatgagaggacctttcatgcgcacatcgatcggtgtcagttttgcgaatttgtgttgtctgcgagcagatgccgaccttgtatgataggaacacccaagagagtcatgccattggcaattaatgaggaaattcgccctagtagataggtaattgttgcctttttcattaaaaaaagtaaaaataggtagcttattattatcaatttttataccagaccaagagagagagagagagagagagagagagagagagagagagagagagggagcacgcatggagcagagctttcttgctgattttcatgtgatttttcaataagaacaatactcctttacttttagaaagatctcagagttccttttggattaccaaagatatatggatctctgaattgtaccttaattagtaattccgaaaactacagccatattttctcctaaagttacaaattttcttttagctaaaaagttgtttataccacagcctccccccctcctcccctaataaaaaaaatataattgactagctaaatgtctgtgtgttgtaacgagattttaagaaaatcatcatacatggtagcaaaataaaaatattttctccaatctatggtcatcgttggtatcgttttttacacatatatcagcgacatagttgctccaactgataaacaactaatcgatataaattatttatatgcctagaaaactgtatttgatccaggtaaagtaatctgaggctcatcaaaacgttctcttaacctcccagtataccgaaaaggcaaatagctaaaaaaatgaaacgaaataggctgggagatagccctgctgccttgctagcagcaggttgtgggtgggaatcaggaatgggtaaaaattccccttcagttgttccatatgatcaatgaagtttctttgaattataacttaaaaatatatttttggaagaacaaagctgattaatcctttgtctagaacgtcaaataatgctatcagacgatatagctcatacccattttcacatttacaaataaatatgattgtcctgacagctatcccactttctcgttttgactctccttgtaagatgccatagtaccatttttggggtagaatggttatttaacttattcatcaatgtacagctgccatagtatgacttgttaggggacacatgcggatgagcgtgtgcgtatgcacatttcaaacaccaacaagtgcatatgcacatttcgagagatggtgaagactaacaaatctctattctcatttcctcgcaaaaaactctattctcattaaatctctattgaaaatgcacctatatataagtaatatggatcatctatatattgatatatctaaagctggctaatctccttgccagctgattggtccatcttttatccgtttatttactgccacgtgtctctccaccatttagacaacaggcgtagcataaactccgtgcttgcagcatgcatgcctctgctgccattcaggaataactgggagtaatggtgtgagcctctcgcgtaaaaataatgcactttctagacgtctcgcttgcccacattggttcgtgggcaattgcagtgctttcgcactatgccgaccgagccaaccatgcagtaagctcacatattgtcgcatgcatttgcataaactaaaccagtaacttgtacgaagaaaagcaataaacaaattaattatatataaaaattaaatttcaatatagacggttcaaatacaagaggtgaggatataaatatatattttttctatcgcatctgcaaatttaacttcttagaaagtaaatgagagatttcccgaaaaaaaaggagagattccaacaagttatcatgtatttcttaaaaaaagtaaaggttttacttttttaaaaaaaatagaaatcaagtatataataaaaactattttattctaatcacaacagcttagatgctaaactttacaaagtacaaaagcaatgtagaatattcaggaaatacgcctttctatatattaaaatatcatcttcaccactgataagttaaaacttaaaacaatattattctatagcatgatatatgttattcttgggtgttctacaaacttatctagaacacactaaaggatactttcgatgtaagatatttgcatatacttgatataaatctttacactaattgctataaataaatcccatattccaaataatatctaaatgaaatattagaggctaaattagcatgcgtgccaacatgcacgctcattttctagttaggatttaaacatagtagatagagtcatatacccacgatcactgccatggttcatctcagttaattcccaagaaggtcgccaagctcaaaattaccatgtatgtatcctaaagcgtagaagttggataaacttatggacatatatctaaataaaacatttgaatttatgttctggtaaaaattaaacaaccatcatgtatattctacccaatacatcacaatcaatcccgctgtttgatatagagtacgcttcaggcgtttttatcgacctactacaacattctcacaaaactgagatgaccagttgacaaggcaccattatccatgatttatgtacagcacgcgtgcggataggcatagcctactgtcttatacaaaatgatagttaaattaatttccattccatttggcatcagctcgatcaaacagacaaacactgttcagaaatactgtttcgaaagatacagatcaatcatggcatcctacgcttgtcgggctaccgcctgtgagaacaagtaccatgagcatttaagcacaagactcaggattatcacgtataattaaggccttctttagtttctaaaataaaaacttttcacccatcacatcgaatgtttggacacatacatagaatattaaatgtagacaaaaagaaaaaccaattaca

SEQ ID NO: 60919 - DNA, 6684 bp, Oryza sativa
cttccagattcattgtctaggtgatgtcaaatcaccacctatgttaccctttttaggagagggagtaaaaattaacaacgccatctattaaaaaacagatgtagtattcgagtggaggcaatgtgttatatgcattaccccttaattaataactactccataagattattggtgattatagctccgatatatgagtttttttcttttattcgctgatggatgagtcaccaacccaagaagatcacagagttgacaacacgaacctcctctcgtagtaatcctctctcgcctcgtgcccatcccctcgggtggcccccaccggaaatcccacggcgtgacagcccgcccaatggcattccgcccctccggattccgcgccccccgccagccaatcaccttccagataaccgtcctcccgggccccacctcctccccccgtcccgccacgtggcgcaaaagcgtgttcacgggccccacctccctgtcagccgacccgcactgtcgctgacgtgtgggcccgggggtcaggacccgagtccgcgattttataaaggaaacggctcgggcgctcgcccttacactactgttcccatttttttttgttaaccgcgaaaagtgttgtgttgtttgggtaggcagggtgttcgacggaatggcgagcgccgccgcggcgacgggcgcggcgctgggggcgcgcacggcgcgggcgtgcgacgggtgcatgcggcggcgggcgcggtggcactgccccgcggacgacgcgttcctgtgccaggcgtgcgacgcgtccgtgcactcggcgaacccgctggcgcggcggcaccaccgcgtgcgcctcccgtcggcgtcctcctcgccggcatcctcccctcgctcggcggccgctccacgtgccggatcagacgaccccgacgcgccggcgtggctgcatgggctcaagcggcggccgcgcacgccccggaccaagcccgggggaggcggcaagcacgacgcctccgccgcgacggtggccgcggcggcggcgtcggcggtcccggacctcgaggcggaggagtccgggatcgtgggcgacaccgaccacgacgtcggggaagaggacgacgaggacctgctgtaccgcgtccccgtgttcgaccccatgctcgccgagctctacaaccccgtggcggccgacgacgaggagcagcagatcgagcagaagcctgctgcacgcgtcgtgccgttctcggagccgtcgccggagttcgcctccggctcggtggaggcggacggcctctccggcttcgacgtgccggacatggagctcgccagcttcgcggcggacatggagagcctcctcatgggagtcgacgaggggttcgacgatctgggcttcttggacgacgagaagcctcacgtgaaactggacctggacatggacatggacttcgcctccatctcgccggcgccggcgccggagcgggaggagaggaagaggaagcggccggagatgatactcaagctcgactacgagggcgtcatcgactcgtgggcccgcgacggagcctcgccgtggttccacggcgagcgccctcgcttcgatcccagcgagtcatggccggacttcccggtaagctctcacgcagagatctgtagctttctgccggaattggattttcatctctcgatggacatctccatcttagctcctttattccgtattacctactccctccggctaaaaaatataagcatttttaaaatagtgttaagtcaacatttttaaaatttaactatttatagtaaaaaaataataataaaaaaagattaatcctgtaaatttgatgttactggatgtattattgaacaaactgtcataatatgtaactctttttatttataatatcttagctttgtagatattgttggtcgaagtagtatctcgacgaccgtgtcgaagtataaaaatacttatattttaaaatggatggagtaaatagttattatttttttaagaaaaatgataacatagattaatatgaaatgtatcacctccgcaagcatacaaggcttaacttttacaattgcaacgaaaggaaccaatcaaactgaaaatagttcgtacatctgcaattatattttttcatgtttgttaaaatttatagaagctgaatttaaaactgtatgtttataaagtgaaatatttaaattaatctattttatttatattttttataactatttattagatgatgaaagcactttcctctttctgccattttcttcacgacctagcttgtgtactgttctgagctatcctatgcgtgcgtgcaggcgggaagccggggagggctcggcgcggcggtgacggcggtgaccggcggcgagagggaggcgcgggtgtcgcggtacagggagaagcggcggacgcggctgttcgccaagaagatccggtacgaggtgcgcaagctcaacgccgagaagcggccgcggatgaagggccggttcgtcaagcgcgccgccgcgctgccgccgctcccgctgcccaggcaccagcatccgccgccgccgccgccgcgcgctctgccgccggtgccgatgatgctcgcgccgcgcggcgcgcacgggcgctaccgtttttgagagctaccgctctcgatcggcttccgatgcgcatgcgcgcgtcgtctagctacatgcatgcatgcatgctagcgatagccgtttgcgtgatccaacaataagtacaaaaatactactatatatatatacaaacatacaaactcgtcgaatcatcgatcgtagcatgttggtttcaggtttaattgtttgggggtagtgttagttttgagcagaattaatctttgtgaattagggcgccctaccactctactatacgtaccaaatgtaccatgcatgtgtgcactgaagcagccggcaggttgtgtacttgtgcacaatttcatgtgcaaattaagtaggtaagttatgtgtgtggtagctaggctaggatgtgtactttcttggttttctgtaagaaagatcctgctaattataaaggttgttgtagattttgatcccggatcaatgtatgtaaaggcctatatgtatatactggtatatatatacagtgtttaagatcaaagtagagaaattacaatgggagcttgtatagttataagcatgtaagtatgtaactagaggatgttgaagcggaaatggctagtgttcttctatttgtatgcatgccttccaatgctttgttagtttgttgggtgatctcaagagcactaactgttgtaatcacgtgttaaatatttttggataaaaaaactatagacatgtttatagtgtatactttctatctatatttgaatacttgatcttgtctgttacctcctccatccctaaatgtttgacaccgttgacttttttaaatatgtttgactgttcgtcttattaaaaaaataagtaattattattatttttttctatcatttgattcattgttaaatatacttttatgtatacatatagttttacatatttcacaaaagtttttgaataagacgaatggttaaatatgttttaaaaagtcaacagcgtcaaacatttagggaaggagggagtatattatttgctatccttatgttctgtatggtagattcgtagttggttagtcgtaacaatatttacatatctgggatcagggaagacactgagcatgacgttttcactttgccattcaccaagtggagtagttatatagtatgatttaggaattacgactcgcaacacattttatatttgcatcgttacagatatcaccacagtgatgatgtggtgtacgaacgtacattcttctccattacctggcaaatctatcgtgaggctgtatttaaaacaaacaatatacaggactccgcccatgctaacattgcataataccgtctcatagtgaaaaagatgttcacatttcgcgaaaagaagataacaatacatccacatgccaatacaaagacccattcgttctgtaagacgcgatccaatagaattactagctcggctgtcttacaaaaggaacaaaaaaatgaataggcactgtttaacttacactgatacaccctctgttagtcgcttgaaatcaccgttcttaccatacaatgaaccgctcaacaacataattctacataaaagaattagtggctacatacaattgatgtacacgaccccccatttacaaaaggagaaatagactatttctcaataccctgctgcaagtattgaatcaagtcgtaccctgcggtagtccatttgttgtaggcatccacacatgttctgaccataaaattagcagcctcacgctcgttcatctctggatgaaaacgttttcgcagattagcgataggttctcccctgctaaagcaaggcaggccactgtccaccatcaaattaacggtagtaataatcccattcatgtgtctccttcctgctaggtaccctttgacacacaatctgaaagaacaatgcttgactcagagcatgtgcaacaactccaattctagttaattagaagaaaatgcatggaaaatatttacctcagaaactgattccaagtgtcactcttcattgttccagatggatcaagcaattgagtcatctcatggcttaacttgaaatgtgcactttcaaaccccatgtttcctccaggcgaaatctccaaaataaatccaaaatcaatatggactagtctcccgtggctgcacaagcaagatgatgattaaccaggtaattccaggtttactcattacaattaggacagaaaagtaaatcgtacctatcaaagagaagattgccattatgccgatcctttggctgaagaagcaagctagcaacagcatatccagcactactgatcatgaacatttcgcgagcagcttcgaaagaaggtgaacctacagggccatagtcttgctgaaatatctctaataaaccaccatcagttgtttcacccatttgatttctactccgagtatttggtaccacctgcagtgtggtcagatcaagaaggttgacaagaggaaaccaatagaacaggtaaacaacaaatacacaacgacaattgctcagtcatgaaagacgtagacttgactcattacttaggtgtcaacttgtcataaaaatggtagctccaaatatttcatttaaaataaaccagagttagagttgtttttttaaaatatcttagggcctgttcagattgtagccaaaataaaccttaccaaattttggcaggatttcttatgtatttaccaaatttggcaacaaactaaatatagacattttttttgggcaattttgccaaaaataatggtatagttgaaaatggcatcaaagtgaacaggcccttagacattagagatcacttgattaaatttggagaaaagagtccagagcatgttttgaaccatgctcattttagttgttctattgtcaaatataacatactcctaatttgaactagaaaggtagctatattatgggacggagggagtaataacaaagtaaagttttcttgttgaattcactattcacatttgcagggatattatactgctaaacatgacataacggtgtaataaaatgtcgattaactgctgttcaagatcagtaataagtgatccctagtccatatagatacaaggaactaaataactacagatggatgcttacctcaattatgcctcgctctggtccagtgggtaaaacaccatatgggaagagataaaggtttaatccaacagcttgaaatatgtcccttagaagagcaataacttggagtgccagcacatcctgtctacaatcatcaccaacctgttgtaacatagaaaatgctcatgtcaactgtgaagcacgttggatgctagacactaagatggttcctgccacatttgctgcatccttcaatagatttacttatccaatgcaagttttaatttatgttcagttaatttatgaactgaaattccatagtaaacatgaattgagacttatagctccataactcgttatatccataggttacaaccatgagatttcactgcaaaagatatatttaccttaaaaatgcaagcctgtggcttcacatcgtttgggtccccatcacgatcaaccacattgaaagtaatcattattggaactttagcagcagactggagaggaatgccactgtctacttgaatgccccgtacaaacttgtttgttgcagtaggtaggtacagatcatcacctggcacagtaatcttctccagctccctgcaaggacaagtttaggataatgagatactaataaggacatatttaattggaacccgcatgagaagattgaaattatatcagtagaaagctcttgatcttcaatgaaacattacagtggtttttactttgtaccttttaatacccgctcgccgctcttctttgggaagaggaaaaagaacaccagaaatcgaggtgaccttgtcaaaaaattcgaactctctttcaaacatgtcacgagcttctggagtaaaaccgtcaacaattttctccctaacggcaggagcaaggaatggaatgcagtggcctgaaaaataattggagctattaacaccacattgcatatcttcgagcttgaaggagggcaggaaacaaaactgtatgacattg

SEQ ID NO: 60920 - DNA, 13814 bp, Oryza sativa
cgaagcaaaggtacataaatcttaaaacatggatacctttggtgcagctgcttccttcccaggttcatcgggaacacattctccctgcaatttacatttcctaactcaattagatattcaaataactcagttatcgaacatcgcactaggcatatattgaagaatgaaacatgtttttttatatttgaatagagtagaatatgataacatggtataacagaataaaaataaaataaaatttacctgcagatgccatattaaaatatgagcaaatatattacttctccgagcagctccaagcaagtatccttcaaccaatttctgatgagttcaaaggcaagaaaaaatgagacgaatgcattacattctttacgagtaataaagtaagggcgcagattgaagcaataaatgttttcctagggtgcattcataacataataaatatatatcactggaagaaattctcacatcatcatcatatctgagagactgtaccaactgtggcataaagaaggtaacagtctcaggtgggtaagtctccaggacacgaagaacatatgccataacacggggatgtcctttataaggaggggtaagaaactccaatgcttgtgtaacagagcatggagcccaatgtggaagttgctgtaacaatgatgaattttcatctactgcctttggagtgatgaaaaagggtaatgcttcaggaattgtacggagttccaatatatgtgtctacagggacaagagagcattgtaagacataacagcatatggcacccttcttactgaaagaaaatagcagttgaacaatttacgaaatacacgaaaaaaaatcaaacacaaaacactatcactcagtcagcagatacacctactacctcgactctaacaaaataagccaggagaaaatctgacttttactacactcagatactgtttatttggttacatgagttcaagtggaagttcaagtgttcaacacagtgagagcatccgctagttccaaaattccagtatttaaggtaagacatagcagaaacaaaaaataaacaaacattgcacaacacactgttgtcaaaagaagatttggttctacccttacattctgaaaatatcactaaaaaaaaattaaactggcaatatcggaaagcaatagtatgttacattagctaccgttcttaacaatagactgaattactatttaactctcgtagctgcaccagttgtcatatcattcttcgacttaccagtagacatgcccataggggtaaaatataccgtaatagcaccctaaaattattttaatttttgacacctccaattactgtcctcaatgtggttgcatggttgctttaaggggatttatgatgctatatcttttagattactttataatattcttgaagatggcatcttaatatattctaaatataaacaaatatgccatattgaattaaagttaattgaagaaatgcaccaagagttctcttgctgtagctgaaagcctgaaaacacccctaaagataaacaagaataaatagattttgaaacagaacttgcatgacaaggaaaaatgggtagaaactgttgtctgagaaggtagcagctgaacgcagcaagaaccatacctgtaccaattgtgtaatttctgatgataatgccgagtttgtgggaaacctcataatcattgagaatgcaattcgaggatcaacagcaaaagcagttctggcatgatcaatccatttatctgagctaattttaccacgaaatgttgctgcatctctgccatatataacatgctatacatgtaaatttgaactcaaagcagagtcaagaataaataaaaaaaaatcacgacgatagttactttgtatttatcggttgtgcccacacttcaagtctgtctgcctcattctgagaaagcataagaagtaattgtttacgcttttcccgtacagttgtatagttatccactgagccccagacagggtggttctgatccagctgcaaataaatgaatgaagcgacaaggtgagaaaagttttaaaagtagttagtgaagatggatgagaagtgattttcatggcaattattttaggtcaatgcacacggagggcagcgacagcagcattaggcatcagcatgtgtcagcagactaggcatattcatcccttaggttacctgttagttctctattagttggattcaataatcaactagttatcaggactctcctatgaatcaagccattatccttcagtttaaaccatagaagaacaaactaaatgccatttatctccatctctctccgtctcacttgtgcatcttcccctcttgccaagccctgtttatcttgttctctatctgcctgttactcatctcttctttatctcctcaccatgggttcacggcaccaggccacaacatacttggacctcatccacataccaatgacagtcatcactagtggtctgtactgtaagcagtcaacaagtggcgataaattatacggagtattatggtagctggtactgcgcatgaaaaataccagcatactacatttcctatttccttgaataaataaataagtttcctaacaaaggggttagttaaattagtactctatcaattacttaggaaaattatcagtttaatatgaagttagtctttgagatatggcttgtaagggaagttgaaattgtattcttaagtgtactgttatcacgggaatctcccataaaaggaatgtactcccattgtggtttaagcaatgagacctgaagttgaactaagcccgacaacctctctaccacgtcagcaagaagctttgccagaagctagatgtgaggcaagccctatggccccttacccatggtctttgaaccatacccaaccagctacgccatacaattgatagttatttaggtgggtaagtgcaaagaaacaaaaagggaacaaagatgcaagttgcaccataccatattgggttcaccttcacgtccctgtgacttcggagcagaatcagcagaaccactggggcgctcattttgtagacaatggacaaatattgacacggattgggcctctctctgagcaaaacttttgttttgagattcataccactcaggtgcataagcaaaccatcccaaagcagcactgaaacaaaacatgtactactaaaatatattaacaagtaataacatattatagctggcacaaaaaaaatgaagatgcaagcaaataaagtgtaaagcaaaaatgcatatacatgcattccttcttaatgatatagatgaataaccaaaaaaaatcattggttgatgcatattatcatgcttgacaataagaaattgatttcgagcatccatattctaccttaattttcagtacaacctgtaactcttattttgttttttcctgaagtatcaacatttcttaagtaacaaataattgtacaaatatagttcagaagtatggaaagagagcattgtattaaatatgaaaaatatgtattggagtgattattaccggtataccctgtcctctaataactgaagtcccatattacatttctgcaagttagactgagactggcatgagcaaaatttcagccccaggagcattgcagtgaagaaagtgccagttgcagcaggatggtgagaaaaatgagtagcagatttcattgtcccttgcaacatccgacccagaagtagaagctgctcaatgctatcatgccgaaccacctaagtaaaaaattgttgcagagtaatcgtaagttagacatgttgtctatcctggaggcaaaagtgccttaaaaaccagcctagggttcaatgcactgatcttaaacgttcagggagtaaagtggacagttttgtggtctagggtgttaagtagaggcaaacataaattgtacaagctaggttgcatgcatgccaatatcctagaaaagcagaaagaaattgcatgagatccataaaataaacaaagtgtgattatcacctcaaaccgatcgatgaagaagccaagccagagcctatgggctattattgcttcaactggatccttttctggtggtgcctcaggctcaccagaaatgagatgtggcctcaattttgcatcagggccacagtaattcatatctgacgcaaacagaccacattttgtatctattgtccacagccatgcatcaacaagttctgcaagcacaagaggacctaaggaaggtgctgcagatactagccaggtccagataaatatcccagtctccattgcatcaggagtgcatatataagcaggacaccagcatagaagacgtataagctgagaaaatccatctagatttgctctagagtcagacacctgtgtgttacatcattagcaaatgcaatcataaccaataataaggtattatgaaatatgttcaaacaatttaccatatgatcaagaagtaatgctgtagactgagaacaagtttcacggaacactgtattatctatttgatttttctctgccgtaacaacgaagtcctgaagaagacgaacaaatcttgacagaaaaacttcgtcaaatgattgattgggctgtgcagactgcataccaaggggggacatgcccgtgttcatgcctcccatagaactgaacaaccttctcataccagcaatctcccctgcatggttgcatttaacagttgcagtcactactgcagttgacagcacttccagggtgatgtcaggtgcttcttttttggcccctgatgctgctgcagcagaatccataactgcaggtacattggctgtcctgatgccattccaatcattctttccactacaaatacgtatttcagatagaagtgatacaacatctgctgtatgttgtgatctttgtgctccacttggcttgcaaaaattttcctaagcattacaattaaaacccctatcaatcattatgggacttgggtgaaaataaacaaatagtataacttttgatgccaacaggaaggtgcctatggaacaaagtttgtgcaataaacaattacagaaagatcagcagttgctgctgtctcagagccttttttaagtcaaccatttaaatgtgtgtatcatttgaccactggatgacaacgatggacatgctttcattaatatatgttatgaatatgagcctactggccagtgacgcagtcgttacaaacttacaacagtagacactcctagaggattttttttttcggtaatttctttctggtggtacaactgaatggttagtttataccatactgactctcattagtattcccgtataaaaaactgctaatcagacatttaaatcctttcaagtttggttgggaactctgaagaacctatgactactatgcaaaaatctaatggaagttaaaaataacctatgagatagcaatctcaatcttaaccggacaagcgaagcgataggtatatcattaacatgacaataaccatctactaacaagaaatgcatcaccataatcatctttagtattcctgtagaaaaactgccaatcagacatttaaatcttttcaagtttggttgtgaactctgaagaacctgtgaccactgtgcaaacatctaatcgaagttaaaaagaacctatgagatagcaatctcaatcttaatcagacaagcgaaataggcaaccttatcattgacaggacaataaccatctactaacaagaaatgcatcatcatacaacaatgctactagacaaaataagacaaaataatattatatttgctaaacctgtataaggccttgagttgtacatggagcatatgaaagagcactcgttatccattccctggcaatcttctgatatagtgagcgtacagtggcaacccaagcaggatcgctaactggaccagaagtcaactcattatgaacagatattagaagtaaatctacacatgatgagttccagaggacctgaaaatttagtatactaggtgtcagtgtctcaaatcaataaaaaataacacatgagacaccaaatcaagcagccaagcaaacctgtggaaacttttcctttagctgagttaacagcttgacactcacatcacgaacattttcatccctctgtgacatgctctttataaggaagcaagcatgaacagaaataacagattcccttatatcagctccttctcctatgtcacatatacgatcctcctgggcacaaaaagggtaattgttccagtgcacatctacaagttagaagtttatcatgtgctctagaaaaataagacaatacaaacaataatcaccaaactgactacaatgcaaagtcaaaaaaaaaaaggatgatgaagtaactcgagattacacaaaacagaatttaaagcactcctaaagtatgaaataagatgcaaagcagattccaattattggacataaaattgctattgttggttgatgcttcattaatattgctcaggggaaaacaaaaacatcccaccatcaatgcatgaggcctttccttgtgggagacaatatctttatttgcagatcaagaaagcagctgtttgtacacttctaatgaatatatgttcgctacaatttatagcttactcaacaatagtcctatgtacaaacaggcatatctgaagcaaaaggagatattagtgctgccataagagatcaaggctgcaaaacaatggaaagaatgtgtggttcgtcacaataggaagtgtgtatcttttttacacaaggagttgaattaacaaaaaagggaactattgtagagataatggactacagtactacatagctaaacaccataatgaaaggacaaaaaaatacatgacttatatcctcaaaaaattgatgaagtgtgagttgtaccatccatgacaactctgtttcaaaagctctatgcacaactgcagtcaaacactgagatactgctggtgtcaagttcggggttagcaggtattcgaacacacaactgaatgcactatttgatttattcaatgtagaggtggctgaaagtatgccgccattgcagctaaagcgcaatatctcaaggaaagcaactgcgaggagatatgtagctttaacccctgaaaataaagcaaaaagaaaatcagtttcatacttaaagaattcaatttatctaatgtaacatttcataaagaaagccactggtatgtgagtccaataatccagttaagttaaacttctaatgatgaaaatgaaaattgaacatttttctcataatctcatccttctctcttcaaaaactgcagattctagcttttacaaattaatccttgcacaaggccaaaaagaactaccgccagtcacaaatacatgtcggcttgggcatagatgcactcaaacttttaacttttgagtatcaatgtctttttaaatatttaggttgatatatgaagatcttacatgtaaatctctcgataaaaactttcataaaattagcattttctggtaagtggactaggcactattatgtagacatgcacaagacattttgctagtggactgtccagatgattgtgaattttaaggacctaaatgcaattctacattaattttactatattggaggttaatattttatttgtgcgagacaaaataaacaaatgcataagcagcgaatgactcgacagagaataaatgttgacctgaaattgtagtcattgctgctacctcaactcgacttcctaaagccgcagaaagtgcagttctctgtccaacagcagccttttcattactattgccacggcgactacctgggttatggagagcatttaactctagctcatcttcaagccatttcactgaactgacaacctgaaatgagaaaagcaaacatggtagatacaaggtattaaagaaagtaagacagccaaccgtcagcataggatgatcaacagggggttaagaatcctaactgttaacttctccatgaaaggagagacaaacatatgtgaatgactgaggacagtagttatcagactattctaatccattgttatgtaaaacatcaataggctttaaaactaataacactcaataatatgttataagtacctcttcaataataagatatgctctctagtaccaggaaatgaatgaaaacaagtttgaatttacttattgcataagaaacgatctgttttccatccctatggacccaaacaacctaccagtggtggagttccttgtgcaatacgttgcactgctacacaccattcgctattccacatgtagggtccagaaacagcctgaagagctatagcactgatgctctccatagtgttcaatgaagtggaaactggttttgcaggtgtctgattgctttgtattggaggagctagtccaaacaagacaatgtagaaccacaaattacggaacaatttcaataatgatggctcaacagttgaaactgggtcaaaatcagaacatatttcagcaactgcaggaagtaatggacccatcaaatcagcaccactcctgcagtaaaggaaatattatgttaagcacacagtactgcagttaattagttaagacataaaaatacatcattcaagtttgaacatcaaaactcatgaaatcgatatatatcaacaatatggcaagttacctcccacttttagactcagcagctaagcccacatctgagcatagagataatagcctatgacggtaatcagacctgagttttgtgctggtgagattagtagcaacaagcaaaaaccctgcaggaagagtctagaattttgtagacacagttagcatggaaattggaacacaagttgtaaaataagtttcttatgtagtacacacctctattctctcagttgttgcttctgatggcactgtgttgttttctgcagatcctacagctttagccttatcgagatagcttcttgtcatcaagacaatgctctcacgatatgacttttcaaaacccaagcatgccacacgagatattgcatctaacaactgcagtagagtacaaaaagggtgcttttgtttaagagtcacaagcaatgccactaaatttgaacacaggtaagagcaagagatatggaacaaaaataaatatggtagtgggtacaatacagaagttccatacccgaagtcgcaataaacttggagatgaagcatcaccctcttctaaatgttcaatgaaaagaggcaaaatcatgtctacaacttcccattttttcaagcatacacataactcagcaagaaggcggataacattaagtcgcatcaccggaactgcgtctttttctttgccatcctgaaaggattcacggtcaagaaaacgaccagcaattaaaatctaattaaaaaaatattgtctttgtatgcaggcaggcaaaagcaagtttaacttgaacattagcatatattcataaacaactagaattccgcaagaaaatgatgccagcatatttgtagccagaaatgctctctgataatcaaactccatttttttttactacaataaaataaaaggatgttaacagtcagaattttattttggagaatgtgaaaaggaaaagaaacactccgattttaacctgaatctctggtttcacagtataatcatgagtttaccacagcatcatggatgaaaattgcttatagaaagaccaagctaatcttctcttacacccttacagccttactcatatgaaattaaaaagcaaacctataaggctaccaatgatgcatcatggtgtatgaactatttggctttttaatgaaagctgggcgtaaagccttttctctaaaaatgatgcatcatggtaacttagcatgttgaaagactgctgaagtgacaattgttggaataattggggcatgttccattcaacaattgtaaggtagataataactgcttttatgttgaagctttttcagtgtggtggcaactgtactaactatcaagtaccagtatatattaaaaaaacttagctataactttcatacgttaactggcagttatttttttaaaaaaaacagtaacagtgttttcataaaacatgcatgaataacacatagtgagattgctcatataatgcttattaacatatggtacaacatgttcatctagtgcccagcataatgacacttgtgttgtagcaaatcttatttaactagaaaatttccaaaaggataaaggaatacctcctcctcataatcatttcgttcacggacatatgcagctaaccgcataatgaatgtgtcgaccagagccctatcctttgtccagccaaactctataatttcacagctcaacttaaccactgcatcgaacaaagccccagggctactacctgtcatgtcagcctataccaacgtggccggtttcacatcagaaagcatctctataaacacataaatttcaggagtccaagcgacagtggtgcaaaagaacatgcctgggaacaagtgctgacgacgagaggtttcaaagggatcagcagcactggcaggagttggccccctcgtgagacagttatctggctgataccattgagcagcgtgcaaaatagctcctcgcagatcttcagtttgcgccaggatgagaggatgcatgacttagtggcctcgataaaccaagctagagtctgctggagcatatccttggaagccttgctatcaacatccatggcagaaacgctccgaaccagcaccactaccgcagcctggcaacagagtaatttggtatttatccttgtctttagctgtgccccctgctctctccagtcccgtttcctaatctgcggagtgcaaaccatcacatcaatcatgaagtaacagcaagtaagcatacatgatacacccaactcgccagcatgtacacggcgaatgcaaatgcaggaacctccgttgtgcacatgaaccgcgaagggtcatccacattctagtctcaccttcaggaattcggagagcgaccggacctgctttgcggcggcattcctgaccttggcaacattatcggactccagaccaccctcgccccccaacacatgcacgatgagcctgaaggcgacctccttccgctccagctcctccacctcctcctcctcgaacttctgcaccacctccctgacccctccattttcctctcccgccgcgtactcccccttccccttggccttgggcggcgcctcctcagagcccgcgaactcgaggagcagccgggaggcgacgggcgcggcatccgcggggaggagcgtcggtgggctggccgccgcggcggagaggaacgcgcgggcgaggggcgcggacgccgggtcagcgacgtcgagcgcggcgaggagcgccgcggagagcgccgacgagagcgccgggcaggtcggcgccgcggcgagcaaggggaggagcctggagaggaagggcgccggggcgaacgactgcggccagaacgacggcgagaggaaggcgtgggaggcgaggaacgcgaggagcggcgcgggcagggaggatccggccccggcgccggcggggaggaggcgcgcgagggcgaggagggagtggaggtgcgcccgcgacgcgcgctgcgcggacgccgacgccgacgccgggggggcgccgcagcgggaggcgagccaggcgagcttgtcggcgaggaggagatccgggtgcgccgccaccaggtcgcagagctcgttgagcgcctccatgggggttccgcggcggcaatggcgggggtcagatcatggggggaggtcgtcgccgctgcagcagcagatcggattggggggggggggggggaggctaggccatggggacaggcggaaaatcggatactgacataggacaggaggggagggtctccccgtcctttttccgacgcgagagtaattcgcggagccagagggggggagaggacaaaggtgagggtaatttgggtgagtaatttattttattttgtttaattttcttttggttgactctactccgcggaatgttgggacagggtgagaggggccgagggccgcgagagacaagcaggcaaggccaacgtgcaaatgccgggttttctctggagccagactggttgcctgtttgccctcggtgaaaacgggacatttaggctttgtttagttcgcgaaatgtaaatttttaagtttcacgtcggacgtttgaccgaatgtcggaagaagttttcggacacgaatgaaaaaactaatttcatagctcgtccttctcctctcgaaattgcttttttccttttcttattcttcctttcctttcgaccatcttactttgaatccggttggagcttttctagagagggaagaagagaagttgtgtgctccctacaaaacccgttagacccactcatgatagatcaccttaccttcgaaggcagccaaacatgccttctcgtttcactaaacaggcctctcaatccgttttgacggtggtacccattctgctagtgcgaaagttgttcccgtttcttcgtgatccgatccggtatcagcggatactttaattttaccgggaagggttgaaacagcgcacttcgaaagatgatggtgtattctgaggatcagtccgttttttattgaattcgcaaattgatagatctggatgattcaaagaatgattcttccctgggcccggtaccattatttaaattggagcttttcaattccattttggagattgagggttcgattctacctcagaacgatcttcatgaaagtgaaaaatcttcgtcttaccaaaaccggatcttaaaaagtgttcagtgcccaacaagcaacgggggcccctttgtttctgtatgaatctcttaccgcacaaaatctccatagccaattttacaaattagatttttaaatcagaggcagcttttggtactatggcatggagcaagaaaatggattgaagcagagagccagcacaccttagtgaatatcattatttaggacaagcacgaagaggaagagctttgtccttcggccttgaatcagcataaagcccctcgccgagccacttctttgacaatacatcatgatgaatagggttcgactcattcatgtctccacacccaggttgtgccgcagccgcccttctgcccgcagccctattctataaatttggctggctacgttacttataatcgcagaacgagcaatgaatccccaacgacaaacgaacaaggggcgaggcattttcggggagtagccgcgaatccgagtaaggtctaaaggcatcagattgaggaaggaaatagagaatgttttcatagaagctttctttttcataggtcaactctgagatgaggtatgctgaaatcgcaagacgaatttattaagcctaattaatctgtcattagcacatgtgggttactgtagcacttatggctaatcgtagactaattatactcataagatacgtctcgtgatttccatgcaaactatgcaattatttttttatttatatttaatacttcatgcatgtgtcaaagattcaatataatgtttttggaaaaaaaataggaactaaacaaggccttaactatttgcaattttaaatttaatgtttaatcatttgtcacacacgtgttgatatatgaggacgagtctacggctcgggcacccgattggtttggaaaaaaatcgggcgctgacgtcagcgtatgatttacgtgcaaaactattttaaactgatttttctcttaaattacttatccaaatcatgatccgattgcaccattaaatttattgcaattaaatcttcaaaacaagaccatacatggatatatttcgacgggaaaaaaata

SEQ ID NO: 60921 - DNA, 6658 bp, Oryza sativa
ggccaaacccacatctacagaagtattcaacaactggcccctggtccccagcaacccaagaatgctcacctacagcctgcagggtgatacgatttgctggatctgcaagacaaccacatgtggaaacacaagagaatgttcattagtagaataatatatctggcactaagacacaaaatgtgccagaatcataaggcggtgaaacagtttattttgaaaaaagaacctttgcagagaagcctttccagcaaatcagcaagttgggggttcatgttgtcaggtatttgcaccggatcattgacaatctattccacagcaatgtcttgaatgagttgaatgaaaaggtaaagcaaaaggaaatggaaggggggtatttttgtaccttatcataagtttcctgtaaggtatctcctagaaatggatagtgaccagtaatcatacaatacagagtaacgccaactgcccatgtatcagctgcccgaccatggtaggctgaacctgaagtgaattagattgaaaggttggtcatatttagccagcctgcaccaatggccaaagactatatgtcgcaatttgagccaacggcaaaagagtcatggtctttgccctctttagtttttaatcattggcataacattcatagccatgctttggccgcttaaagttgcagtatctaagtaattcgtttatgtcatattctaaatctaaattgcatatttatgttggactcattccgtttgcagttgggtgttctgtcgagaacagattactttatctgctattctgcaatcaagtaaaaggggaacatctacagctgctgtctatctagcaattgttgaacttcatacacataatttggtgactaactgattctgcacgcagtaaatactagtactcaaatataaaaggtaggcagttgtaccttgacagcattctggtgcagtgaaaacaggagtacctggagacctccaaagcagatcatcatcatcctgcaatacaatcacataacactttatcagtaaagtactaagccattagactccacaattgtacgaagaaattgcctaaaaacacttactccctccgtcccataatataagaagttttagagttagacacggttattaagaaagtaggtagaaatgaatggtggagggttgcgattggatgagtagtggaggtaggtgggaaaagtgaatggtggagggttgtgattggttgggaagagaatgttggtggagaagttgttatattttgggacaaatcctgagggctaaaagttgttatattttgggacggagggagtacatgttaataggcatttctacattagcacacaataaaaaagatcatgtatcaagttaaagataatcaaatgtggtatgaaaccatcctgttttactatataaagtcatgggcctgcttaactaaaaaaggtggcatgcaatcatctacttgagtaatcttaaaaatattcaggatggaaggaaatgaacaatatcttttgaggtttttgaattaaaaaatgcttgtcttagaaattgagccccaaaattgcatttttgatacagtctacagtctaaatcatgatgcacacaattttctggggatccattcaactgaaagccctttatgccatgacaaggaaaatagcattcattactacaatacagaggttagaggataaaggcccacctcaaaaatctgactaacactgaaatcccctatcttcacactgccagtgcttgtgaccaacaaatgtctggtttgatatcaccatgaataatattctgcgtataatgacaggaagcattcagtgacatgatgagttaggaagcacataacacagtgcagactgcataacgtagataaatgtgtgactagagcaacatgtatctgattataatatagaagtatgtacaaattggggaaatagaaacatcaacaaggaccaacttaagaagtaatgaattgccagatgttaaggaatcaagtaacatgttaccaagatacattatgcacataagagcatggataaattaagatttcttatatgcatatcactgtcctaatcagtgttctaaaagtcgtctctaggcgccgggtagccgccgccattaggcattcgatggtgtattaggcagctgagctaacttggctagtgttttttttttttttgctattttagtgttatatagtctaatttctatgcaatatgcgtgctatttttttggatttgactagttgacctgacctaggcgccgccttggcgccaattaggcactaggcgccccccagccacccaactagcgcctagtgctttcttgaaccatggtcctaatgattgaagtttaactagtatcatatttctagctaaatttaaccatggtcctaatgaactcaatttccaatacaatcaaacaatggataagagaagaaatgtgtgtgtaggcacaaataatcctaatctagaactaaaatgggatttaatattttctttatgaaaccataaccattcaaatagtaccacttagctgggcccaaaaaagttggcatatgcaaatgcaataattacctcaaagacagaaagttaagtagctaaaggaacaaggaaagtaacatgcaattagaacttcagcctacaagcatagactaagactatagtacaaataacgataacttaacagtggatctcaacctctgctcaacctggtcaccgatttaaccaagtttaagcaagacttttttagaaaatgtggaagttaaaatatgttgcttgcattaatctgcacaatacaaacttgaagctgcttaaatatatttgtacagagaaactatcattatatgaccagttgatatgactgctagtggaacacactggcaaatttgaatttcctttgatatgaccagttgatatgactgctagtggatcaaactattcatggtaccatgaatagtttgatccatatacaattggtgtttataggctgtagattctgatatatggcatggcgttcaccacaatttaacagatcttttagtgaaggaaatttgaatcttacatgagaatgaagatacataacaccagagattatgtcgcgcaagtaatttctggaggtagcttctcctaaaccattgtcacagaccatttttccttcaacatactcaagaactggcaataccaatggacaatgttaggtagaataatatggagaattaaataaagatgctcaaaagttagcaagaaaaatctcatgctacaattaaacaaaaggaaactattttttttaaaaaaaatgagaatgtcattacatacccatgtagaatttatctgcatttgggtcatcaatcacttcaatgagatttactatattaggatgatccaacattttcatgatggatacctgtcaccaatacactaaggtgatgctgtcagataattgagacgttaaacagtacatagagattctttaagcaagcaaagtttattccagttattttattgtgttcatgtcctgaacagagcaaaatcagtgagcacactcaacttgtatcaactcaacttgggtattgggctcagggccaaggccctaggccaaggaggaggaagaggtgcacatggacatgtccagtatcgcatggttattgttcacatgggtgtatagaatagattgatttgctagctatttataaaatcttagagataaactccttcaaggtcaagccatcctatttaaataaggatgggctgtatgtccattcgttaatagtctctccctaatgttcatcatctaagtctaagttctctcctcatctgcagcaaccatcgccgccccagctatcctctggtggtgtttacccaccatgatttcggaccatgacaacttggttactatgtatgtggttggcccgatagtgtcagtgttatggtagcgatgcatcctcaaagtgcacacaaccaaggttatcataccaagcccagcccaatagtttgaccaaaaaggacctgaagtgagcctcccggtagactgtttttccttagacaattctataatcatccatttcgatcaggagaaaccatgtttgaactggctagtttaagagtgaacaagtcaacatgagccagacgataaacccagcttaagaaatagccaaaaataatgcacaatgcattgtgcatgaactaagtgggcttgttggtttgttatttattgtactgagaaacttatgtaagtccatattgagtgcaagagctatgctaattatatcaccacatttacatattacccatttaaatagaatgtgcagacactgacccaaatcctaactgggtcaagggctgaatgggcagcactacttttccagagcacttaagtcgtgtcatgacaaaaaagaaaaaaaaacatgtattacaatcacaagtaaactgagaaagttactcacttcccgaagaacatctgtcatggcagtttctgatcgcacaacacgtactttcatcatgtaagatttattcaaaacctacaatagaagggcaaaggctacagttccatcagttagatgcagacactgtgcacgcaacataaatttaaccttgtaaccataagaataatggtgctgaacgagtaaaaccaactactcagactagcagctagttattaatgagttcagatgcaagaaataaaaattagtaactaacataaagaaatcagcacataaggacagcgaaaaaccctaccttcactgcgtaaagctttccatctttcatgcttcggtataagacctttaagccaaaaaaaaaaagatttagacatttaccgtgggaagtcacttcataacataatgtgagctatcttaccactttgccatagcttccagaaccaatcttccccaggtggacatattggttgaccatcttgctgccattttcatcctaaatgtgccgaaaggaaaaaagttattgtactgtttaatgcaaaaaggtaatagatcgcatacagctttatggatttgcaaaggtcacgacaacactgattgaaacagtagatcatctgagcatggcgccttaaacaattaaagtttacatcttatacgtataatgcaaaagatgttttaaccgatcatttataacacagttataattttctataataagttaaacaatgttactctactaaataatataacgacaaggatagattaattaccaatcattccaaaatcgtatactacatagcaacaaccaaataatctagactttccatgattggttagtgggcttcaggttgtcactttcctagcaggaggtcccacattctaatcctagcagacgcacaaaattaggacaaatggcagttattctacaaggatggattaattattaattgttccaaaaggaaagtggcataatgtgcggcattagcattgatgttgtcgtagaagatgccacgttcaaaacctagcagaggcgccaaaatttgcattcctgcatgatggagattcaatcactcgaacaagactgaactacgacatttacctatttcgcagtctaaccgctgagctaaccttgtctttaatacaatggtccatgtgtgacagtttctcatgcacgggctagcttgtaaaagaagtctgcactagataagactatacctctatatatgggcatgaaaaatggaaatgaaaatagaataacagtggtaaagaattcaaatctaagaggatagtacctctgagcgaaatacttttttagtctccttaactaggctttctctacatgcaaagccattctgagcccttgacagtataatatcttcagatctcttccttggctgcccatcatcacttccataaagatgatcaggatcatctccatcatagaagcttctgtcagggtcatcgccattgtagaagcttctatcgagatcatccctgtcgtagaagcttctatcaggatcatccccggtgtagaagcttccatcaggatcctccgcagatttatggttcaacaagtcttcagataggatgccatcagcgtcgcgaggtcgacttacagacaccctaggcttccttaaaaagccaaaacaactacagcagcccatgtcggtcaggtcagccattcagaccaagtaggcaccaggaaccctagtagaacaaaaacaggtgaagtagcaagaaacaccatcagagtaggaattgagaagtatgtcggttaatagggttcggcgtgaaaccaaacaaaaatgggaagtgcctactcctcttctacttagcatcatttggctatcgcaacaccaacctactgtaccagatcacacatcacagtaaaacaataggcttattcccttacaaataagtcaagactacaacacaaattcctcgcgggaaaactcacttgatcacagactttagtatattcaaagttaagaggtgataaacacatccctgggatttcacatcagatgaacacggagatgaaatcacctaagcaacacgactacgcaggtatctgctggtaccacccgcacgcgggctaaaaacaccagctccacgcccccgaggcacccaggtgaccagatccccgcccaaaaccgtcccgactcccggttgatcctagggcagaacagaataatcaccggaatagtgaatcgcccagcctacc

SEQ ID NO: 60922 - DNA, 3954 bp, Oryza sativa
ggggggtggtgtttggttagaggagatcgcacggagggggactgaccgctctgtcggtttttttggtaattttgggtgcgtctgagccaaccgttcgggcaagagctcgtaaaccctccctgccctaaaaatattttcagctcactgtactaaaaataaatttatttttaataattattatattagagtagagtactagacagatctatattgtttattggaatttaacgaaatagggtaatctagtcttttgtttttttaaagtatggaatagataaaattgaatttattttaggacggtggaggtagtacttcggttcaaaactactccaatgctatggctcatattgatatatgaattttgaactagtaaacaattgaaatgttacgtaagcatgatcaatagataatatgcccaatagtagcatgaccccgcctcctttccttcacagcgttcggcgtcctatgcatccaaagtcattgtgttttggcggtggaatacataagtaaacaataagtaaacaatatgttagtatttagttatgcaaaacattgttgccaagacttactcaactcacgactttcacctgcttccggtgataattaccactatcatataaatgggagagtagagtaccaagatatagggattagctagcagatacggtttatttattacctttacttgataaaacatgagaggtgtaccaccttttgcctaaagtaaagaattcaaacgtttgcgacccaatttaatagcgccagggatgatttaaacacatccttagtggaacaacggcttcactcctaaaatgaaatcattaagaacccacgctcaatctctccacattgttagtccctcatgcagctttgaattaaatatatgatgtggcctcgctcattttttaagggttgtgtatgggctcttccctatatccgcaaagagtttagtttaaaactattgtgtctgtttgatcctaagctgcaaatgagtggaatttgatgttgaatttcaatcataaacttttgagagcaggaggttttgcctcaactcaatccatgaatgttatttcatttccgctgaattcaactcagtcttcatcctaccctagagttatctctcaaagttgaagctaggaggtatttgatttattggatttcgagccccttttcttgctccttgccattagcgcaaccctttttattttcttagctttatttgaagtatggtttgttacctgaaaagatactcatcatattgctgcggtacattgggcatattagcgggcctattccatcttagtatccgtccacctcaacgtctatacaaaggattacgtatggacaatattgaaactgtactttccagtagtatcgctgctgtttttttgcagctttcgtagttgccggaactatgtgatatgggtcagctctcgcaagcttattagagcattgaattgagctctactaagagtaagatggcttttattctactaaatccaaagaatgctggctagggtgacgctcgtgcttctttcgagtaaggcaaacttagtaaggggacttgtcttgtatagtgggcagcggatctcttctgttcagttctttccctgctacgctactttgtgatgtatcctgcctgccatcacttcctatcgtcaagtaagctgattgagtgattccaggtggtagtcatccttgtaatacctcatgaagaagcaaggctgcgctctgcgcatattgttcttcagatcgattgtgtcacaaggcagacagatagactcctttcccgctgctaagggagagcaagaaactaaatcaaatgattgtttttttcaccagcgccctttttttgcgggtactaagagtcctctcactaccaatctgcagacatcatcatttggttgggtcttgccggtatcaacatataataagcactcttatcaataaattaggttaggtattgtgcggttacctaaagatacctgctcaacgtagatgcaggggtagaaaggctgattcaaatttagcgccaactcttttgtagtgaccacagagtcccgggttgctttggtgcacccacccgtaagtattgtgttgtacaactctcccccaacgtagattggtggcaatcaaccatgaacaaagcactacggtattgactcccaactgaatcttctatacctttaaaaataagcaaccataaaaccatcctctcagcataacaatctataataggcagataaaaaaatatctagttaaggtaatcaacatatcaaactgttatatttatctcggaatgaatacctcaatactatacaattaccacatcatgcatttgatatatacataggcaaaacaatacatgtgtaaataccaggtgaaaaatgggcacgcatagcactcttgtagtctcagtgaaatctgactacggtcaatatgaaatagattatgaagcagattatttctacggattatctacttcattataggaataaattaaatattttaataaataaacctaacaaaatcaagtggtctcattaatataataaaagaaagttttggtagaaactgtacttttttagtgtggagcaaataatcccattcaacaatccagtaaataattaaaaacaaagcctcaaatccaaggttagtcataacaagagaatgaaccattcaaattttcaaaaccatctgtgtaaataagcatatgtactgcattattataccaataaaattgctatggtagtccctggcaaactaatttttgttggaccaaatgcaacgggccggtaagccaaacatgtagatttatgcacctgtttttatctccttgggacttttctttaccaaagaagaggacaactgatccatttcttatcctcaataactgcaaaattcactaatctataaactgttcttgcccgagcacaatccacacacgtctggattgaaatttacaacactaagcgtaatttgttaacttggtcattggcaactgttacattcatagttactaatgaatgtaactaacacgacgccgaatgtttacatgagtgaaacaaacattggtacataacgtccgagcatagcatttgcatgagctgatcagaagtcctcaagcatgtatcaagtgtaacaacagcctcgaggcaaacaaaaatcaagggaaatggagaaaaagtgaaacaaaaactcaaccatgtataacactacttattccttacaatcagtaaacatcctggtaaaatatatcatagcgaagtcttaagagagactagaaagaatataagggagcatatctaccgacgcttatctcgactgcgtaggggagcagaggaggcctgaagcatctgcaccaaccacggcaagctcacatatggtacaaagctgcccttcgatcgaaggaacaaaccgggagccacagtacgggcaggaaacatccttctggccacggtagattggaacatacgtggcgccacagacaacaaatggatttctgtagtcatagttcagctcagagctatccttcttgccactgcactgctgctgcacctgtcgagccctccttgcctgggcctcattagggttgttctccagaagcatccttgcaaagtgctctgcagtagcgaagttcttttgcttgtagcacagacccatagcgcttccaagcacaagcctcatatgaactctctgaagcttgcagttagtgaaataagcagccaattcttgttggcggttgacatcatctctcaactccttcctcttaagttccatcctcaggccaagaacatactccctcacaatctcgatcaactctttcacttcatccacttccctcctcgagtctaccacgataagagggatggtatgcaagatgctaaggaactgcctcagggcttctgggaacttaccatctgtggtggccttataggcagccttgagtctgtc

SEQ ID NO: 60923 - DNA, 1130 bp, Oryza sativa
aatccagaaacgatcatgttcccgcctgaacgtttgaataccggttcgctttgtggcatcccagatgcgaatgcttttgtcctctgagttggacacaatgatgtcttgcttagcatggaacatcacgcatgacacattattcatgtgtccccgcaaagtatcaacttcccaagccttcgtgtctgtccaaaaaaatagcacatttagattacattaattcaaatacctcaatagcggtttgctgcatatgcatatagttttgtgtttggccagtctagcaatatgcagaagaatgaagtgctatgcaacaagaatgaccacctttcattccaaccaaagtgacaaactagaggtcaggagctagttactaattgagtaattgtgaagcatgtttcttgcattcagcttgttcggtaattactacttctgtgaaagtatgataaattgaagaaaacaaaaggaattcataataaaatcaaatccatagtttgtagtaataatatatggaaggacaaatgaataaaaacacaaatatgcaagcgtttatccatggaaaatggtaatagaaaagtttaaggccttgtagcagtattaccattcattctccatagcttcacttgtcggtcatctgccccggaaacaatgagtggcaatgtggggtgaaatgatgcccagttcaccccacggtcatgcccttccaacacatattttacaactgcatcaacacctccaaacagatctgtgttcatctgggtgagacgcaggatgtcatctgcaggtgacaccgtcttcttcctcaaagcaccaatatcccaaacacggacagtctgatccagtgatgctgacacaaccaggtcctccttgggatggaatgatgcgcacatgacatagtggttatgtccagtcagcacagctacacatgtgcgtgactgccagttccagatccggattgtctggtcatcactagcacttactatccatgggtattcgtggtggaattgcacggtgcgaatatagtcaaggtgcccgtgaagtgtgaagaggcaacggtgtgtcttgtaattccataccttaatcttgtaatcatcacctgcaatgcatcacagaaatcttagaatagttcagaagtt

SEQ ID NO: 60924 - DNA, 1948 bp, Oryza sativa
attcctgcagcccgtcagattggggtagacttgtttaggggtgagtcagcttggtccgtaaggtacctgatgaatactgtagcttcagtacgaaggcagcgtttttgacttgtcagtagcagtagagaaaaaaaaaagtttagggccatttgaatcgcatggttgaaagaaatgtaggaatataaaaaagacaggattctgataagaattgaagtgtaaaacagaggattgcaatatacatgaatggtcgtttgattagagcgcagaaaaaaaacgcatgaatcgaatgagagagatagactcaaaggacattttctaagaggttggagctcttgctaaaattttcctctaaaatccacatgcaatgtgtcattccataggaatttcataggttttggaaagcttcaatcatttgaatcaaagtaccaaatagaaaaatttcctataggatttgaatcctatgaaatttctacataaatcctttgtttcaagaggccttaccttttgtagttatgtcatttatatttaaaaaacaggatatatcatataaaaaattataaccatgctagtagaaaaaaggaatttataaggctggttataaccatggtttatacttatgctagtagaacaaagagtttccatgtcttaaaatgtcacaacagatgcaagcaaacaagcacaaccataatacttgccgattttggcaggtacagtagtataggaatgagcgttggttactgcaattgtttctccgatgaatcaataagtgcattatcgattggaataagataacttaatggacgatccttcccgagtcttcatcaacaaccaagagaaaacgatagacatcagaaaaggttaaaggtggtaaacaacataattccataaatggaaggggacaaaagacctagacagtatatcactatattagatctaatcttgtaaatactttatttgaaaaacaaatctaaaatattcctaaaataaaatagaagggcctcctcaccatcgacaagggtgctaaagacagtagggaagggaagggggactagatgggttgtgaggacgaaagccttcatgaattaaattggtgattcatggtacgctctcgctatgacatattccagtttaccatccaaatctatataatactttatctatagatatatccacctagtttatttgctataaaaaatctagcacatgaagtttaaagtgcatctaggctctaattcaatttcagtaatcaatgactagcgattagagatgactaacacctttgcatataactctttgggcctacatgtcatgtcagtggctagatattatggaacttggtccctaagctttctaaaaatcttgaataggtccttatcttcaaccacaaataagaggagtgtaataagtggcgcgctcagccaagagccaaggcatgcccaggggacctccgtggtcccttcgggtgcagtaggcacatcatagagtggctagaggacgacgggcgacgagctcctgaaaagccgtggccatgatgcttatggtggtgggtaggcagtgctcgggtggtagaacggcaatagctctagcaactacatgcatagggaatagggaaaccgtaagcaggctagggattttctcacttagaagggcttttcccgcacttagtgatggcgggaggtagcagtggtgcttcggcaagatatgaacaatgttggtaggcgcggctattcgggaaggggaaaacgagatcagtgcaacatggggaaaaaggtgatgcacatggttgaaaggtgatctcaccgaggacgttgcgataggctcttgtgcttaccagcaccaatgatggctcctttattcctgacaagagagagagccatgagctccctcaagttggaatagaatggggcgagttgaggaaaaggagtgcaacaggaaggtttatgcgggc

SEQ ID NO: 60925 - DNA, 6828 bp, Oryza sativa
agggattaggaaaaatttcaggggtatataagggattttctcaaagaaatatggtgagagatgagtgttcaaaggcgagtaaaaaaaattctacaaccacattgcataataaaaaaaatcaaataataatttcatataactagactagaacaaagcttaagaggtgaaaggagttttatgctatgatttagtagtcgttgagacctatgttactcaaaattttagactcaatctacggggttttttttttgcccacgggttggtgggtacgggcgtgtaaagaacggaccatacccatgtacctaacggctaagagttttcgcccgtcaatagactcatgggtataagagttagaacatgattagctcctaatagagtaaaaatccgtcgggtgtcgggtcacgggtccccattgacatctttacttccaagtcatcatgcatggaaaaaaaaaaccaaaaataatttagcgcatatgaatttatgtacatcattttgaagttttcactacttcattttcttcttggatgttgcgtcgatgatgaacaaattgaatgaagttaaatttctatttcaatggtagaatttaataagtttctaatccatgttaagctaatcttattgaagtataatattttctataaggtcatcgggctatgtgatgtattttgccaaaagtcttcacagtttatttatgggtgatttaactacaataagtgggaaaagattatttgtttagatcttggtttaaaattctaatttgactgagttgctggggcatcacaataatggtaaagattataaaatgtttttgtgaagtctgtttgttttacttcggatcgagttgtcttagccccaggccccagcatgctttgtacctttcctccatgtatgaaaaatagtcatgagtgttaacatttttatgtattgttcgtatattataataacatctaaaatttactaaaatgtacttagtatttatttgtgattaggaaaatcaattttgctttgataaaagtatttttccttgcatttcatttgcataaaatgttgttacgtgggtgcatggtttgggattaaagacgtttgatttattatatttgcgtatgctatgttttgattttcatttatatgtaaaataaactattaaaatgagttttaacattttaaggcagctaaatgcgtcccctccccggtccagtccccggcattctcagcggtgacgagggaaagggtacccatcttaggatttattccaattacatcctcctattatcaatctaggatatttctcccatggtgtttcttgaatcaggtttggttaaattcttttgctctttttacatctcttgttggaggttatttcgtttgcaagattcccagttcgccaatgaagcaatcaatggcaccacctttaaggttagggtcaccgatttgctgatttatcaaaggagtgaagatagtggcctgtgttccttgatttctttgtgtgcatgttggagttggttagagttgtctcactatccattgttaataagagattaagcagcaaacaagagactaaaatgtggtaaatttccagtagcatggaaggaatttatccgttcactaatgaatgattaccgcgtctaagagcataggggtttgacgccgaacaaagctaggcctatatttttcagttaggacaatctatatatatttttaacttttctggcatgaacttaatgtgtctaattgtactttgcccccaaaaggcttatgcccaataccttggatgtaaagtgttttttttagtcatttactccctccatgtcagaatatagagagttttaacccttgacatggctattaaggagaagggtagaaagatttatttgccattttaggatagatgatgtgcatgtactgactataattaaaacaaggaatagttaggtaatatgggtagcttagtagaaaaaatacaacctattactaatactattttgctatatttgagacaaatcttgaattctataagttgttatatgctacatttgagataacttttgaattttatatttgagataacttttgaattttatatgaggttatattttagtacgaagggagtatgggaaaatatgtaatgtagtagaaacctaaaaactacagttggattcaaaaaatagcacccgagtgtaaattttttactcttaatgacgtgaaaaaatctcatacatttattttttttatttttagatcaatgataattataagtttctattacatatgtgcatttttaggtgcaacggtagtttgctgggggagaattgctgttttttttttccagtacccaagtttacactgcgccaacaatacaagggaaatcttttcccagcatttgggtaaagttctctctcctacttgggagcaccggatttttttttctcacctatataactttttctcagaagttaacacatgacatgctatggaattgcatagtttactgcccaaaacactgtccaggctacgacattgttctgttgtgccgcagcagaagcaacgaaaaatagaactgaagcagtacgttctaaggactaaggacttgtttagatgggactaaaacttttaaatccatattatatcggatgtttggacactaattataaatattaaacgtagactattaataaaacccatccataatcttggactaattcgcgagacgaatctattgagcctaattaatccatgattaacctatgtgatgctacagtaaacattctctaattatagattaattaggcttaaaaattttgtctcgcaaattagctttcatttatataattagttttgtaagtagtctatatttaatactctaaattagtgtctaaatacatggactaaagttaagtccctatattcaaacaccacctaacaaactataatcctgcaggtcctagtttaggccaaagttggcaatgaacaaccaatttggaactgaacagcccgcttgaagatttacaacacacagatcatttgctactcctaaaaggagcataaacaagtatcacaattctttgttaaccaaacaatcttaaggtgatcaacattgtgaacatacagtgtaacaaaagcaagcgtggacggtgacaatcacaagcaacagaatgaacaaaataatgcgagaaagtagctcaataggatgacaatgaaagtaacaccacgacaaaaaatttccaagagtgaaagtaatattggtacatcaattgtccaggggtaggcgcataggccaccatgagatgatcaaaagtccatatatgacaagtgtaacagctgcctcaaggcaaacaaaaatcgagggaaatgagggggagaagatacaaaaacacgaccatgtatacactcctcaatcagtaaacatgcagctaaaatgtgagatagagaatccctagaattttaagagactaaaagaaaatgggggagctctaccttagcaccacttatctcaactgtgtgggcgagcagacgaggcctgaagcatctgcaccaaccacggcaagctcacatatggtacaaagctgcccttcgatcgaaggaacaaaccgggatccacagtacgggcaggaaacatccttctggccacggtagattggaacatatgtggcgccacagacaacaaatggatttctgtagtcatagttcagctcagagctatccttcttgccactgcactgctgctgcacctgtcgagccctccttgcctgggcctcattagggttgttctccagaagcatccttgcaaagtgctctgcagtagcgaagttcttttgcttgtagcacagacccatagcgcttccaagcacaagcctcatatgaactctctgaagcttgcagttagtgaagtaagccgccaattcttgttggcggttgacatcatctctcagctccttcctcttaagttccatcctcaggccaagaacatactccctcacaatctcgatcaactctttcacttcatccacttccctcctcgagtctaccacgataagagggatggtatgcaagatgctaaggaactgcctcagggcttctgggaacttaccatctgtggtggccttataggcagccttgagtctgtcttccatttgtgggaaggtgaaaacaagtgcaggagggcctctcacattaggacttgcagactcgctccaacctttctcaacagcgactggtatgatgggggcagttgcaagtgcatgaagatatgagtggctgcccatgtgcagatcaagaaacaggggcttgaggggagcaaagttttttatgcccaactggcgactaagcaacctcattgcagtgtcaaagttccctgctgctgcatgctccccagcaagagaagatttctgagtccaaatcaggctgacaggcatgcctggtggaggagcaacgaagaccgctgagcgtgcattgccagcattttttggggtctctgcttcaggcagaagttccagatcttctaggtcccaaccaccttcctcgccatcctcctcatttgcttcaccctcctcagcatcaaaaccgtcaccaccattcgccatcgcttcgcttgcatcaacaatatccaggccctcatcaccccagtcagcaccagcagcttcatcgtcttcctcaagttcagccttcccagtagcatccagtccaccctcaaagataccacgcatcacccgaagcaatggccaatcaccactggctgtgagaggagcaggggggatcaaaagagagcgagcttttccttcaggaagagaaggaatattttcacccagctcagcggcaagcctatcagcaatttctgtgagcccatgggtggtagcagtaatataggcaagaggtagctgtccagcattctctaggatctcaactctcttcatagcatcaccaagatacagagcattgtggaattgacccatcaggttattgttctgtccagcaattttgcacatgaaccccaccttgtccatgtaaccagtaataagatataggaaagcaagcctctcaaaattcttcgtacgttggtatgcatattccacaataccaacatttccctgcctcagggcctcaattcccaacctgtaccagtgatccttgtcatcaatctcttttgcagaagcaactgcgatttggatgttaccactctcaagagcaaggttaaatcttgtcttctcatctttcacaaagtggagggcaacttctggaaagcctttctgttgtaaataagaaatcacagcttgcccacacagctgggaattcttgatcatactcatcacatgatcataccgtttgcgtagaagggccagcttgaaaatgtactcagatgcatcaactgtgaccagcttgttcttaccatcacgatctagacagaatatattgttcccaataacccttgttatgtatataggaacatcgagggttttaataatcccactatctccattgggaaggcaatacttgatatgattcagggtagtgtaaataaacacaccattctcatcccaggcaccacttttcacacgaatggtttcgtgcagtgtacagcgatggacgagcttcttgtttgctataaccaccgcatgcttgctcagcagtgcgacagattccatatcactcgaccaaacaacatatttaacagaaggtgcctggagctcgccaagaattaacctttgctgcagatcaaagatggtcactcggtcttcggctttgcacagcaagctaccagtcccagcataataaattgcatccgtggcaataggaagagggcttttctttacaatttcgttcttaagattcctcaccaaaacttgattgctactcttctcaaggactgcaaacctgttgcgtgccacgaaaacagctgacccaccagcccccttctttgcatcctgcaaatagtcagccctgccagcagaatccttgggaacaatgtagagttcgtatgagcctccatccacatcagagcaaatcaggacagcattttcagttggactgtaagatagtgtcttgggtgactggttcaagctcactgatccaggtcttcttattggagcaagctgaacttccttctgtgtggtgaattcaaaaaaacgaagaaaacggtccttcacatagaaaacagtatctccactcacagagaaagctggacgttccctctccaatttaaacacaatcataccactgtcatgaccagcggcaagaagattcatctcagggtgagcagaaagaatccagaaacgatcatgctcccgcctgaacgtttgaataccggttcgctttgtggcatcccagatgcgaatgcttttgtcctctgagttggacactatgatgtcttgctttgcatggaacatcacacaggacacgttattcatgtgcccccgcaaagtatcaacttcccaagccttggtgtctgtcaaaaaacagcacatttagattgcatcacctattatccctttaaataatgcaatggtgatagtggaagtgaatgttccacaccccacaaagtttgcagcacatcttttttacttccttgaagttctttagtttgttaatatcttattctcatctctaaatcaagtttatcacagaaaggtctacggtggtaaaactgacacatatatatgtagagtaatgtaaaaatcattagtgctacttgtacctagaataacaaagatgaagggtgtgttgaatgaaaaagtcataattcatttgtttcaaacaatattagcacatgtacaattcatcttgcctgttgcaagtagcaatgcatggttatttagctagttcaaatatttt

SEQ ID NO: 60926 - DNA, 13473 bp, Oryza sativa
caacacgccacgaaacccatgcccgccgccccgcgagggagagagatctagcgggtctactcacctccggagacgaagagcggctgcgtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcagccccttcacccggttgctcttcgtctcgaacttggtcagcatcttcgcttggccctcccgcccctgatcgtcgtctccggcgacggcgggcgcggcggcggaggcgaacccctagccccggaggcggagacgagcggaggagaggggaggcgctggatctggggcggggtggagggaggagagagagagagaggatggcatggttgtgagattgccacttaagcagtcacttccgatcttagccgttcaaggtgcaatcaacggcggatgcatttccctgttttcctaaacaccagaaccgagagaacggacaatatgccactctatacgtggggattcgataaaatgccactcaatatgatgcaccggataaaatgtcactcagtatgttggtatcaggtgaaataccactttgaacctatgttgatttatttttggatgaaaagaatgcttgttgtatcaatcaaattggccagacgcccattttgatttgatatcagcgtagttggcccattttgatttgatattagtgtagttggcccattttgatttgatattattgtagttcaaccggctaaatttcttgtggtaaaaccaaccccctaagtttaagtcctagtcttgacgttagtgcttataattatggctagttattattttccagtgatagataatgaacccgccaacaatgaaatgctcgtggtgacttcgtcaatcttaccgacccaatctttcggaggtgctcatagaggtaaggtgagtgccgtgtgcacgttataaatgcttgtgtttgtactgtgtttcaaaaaaatatatgccttaccaaattattgataccttaaaagtactttagttcctattaaaaagcactttggttagtgtttggtttgctattaaagtgttccaataacacatgtctatattgcttttttaaaaaagttagtgctcgtagtgaacttgccacatcacctactctcattataaattttacaaaataccctttattaaatgtattaatattaagaaacaatcaaatctaaatgaatatctgtcaggattacggataagacatatctcgtatcctacaattaaccaagtatattagatcggtatacctcatatcccaagatatgtttctatatgcgataaggacatatataaaatattataggaaatatccttatgagctggagactactagagtcctactcgggaaggactaggactattctatatcgtgcagggttcattgtttccgagttcaacttggagactaaggcaatccacggtataaaaggcatacccctggaggggttctggattatcgaatcatagcgccaacacgccgaccatagttttcgaagccgaaggacccaagctgaagccgccgggagatctcatcgaacaatctcgactagggtctcgtcggtctcaacgagttcgtatgttctctctgtattctgtggtcttccatatcaatcccatataaactgaattagggttattattttacgaggggccttaaccaatataatcattgtattttgtctattttaatgtcgtatcgtatagatcatcgtaccaacataccctaataccctatttatctggtctacgggtatcccccgttgacaatatccatatataaaatcaaaataaggggaatatttcctatagaaaaggaatgagtaacacatttcatgaaaaatttattttagaaaatattgtaatgtattttcttttatccgtagcaaaacatatatattcaattagtagataaaaacaaattggcagtactgaaatttgcatgtgttgacattgctaatattttgtcatggtagcaaactaaataagcccaccatcttgccaaaattttgtttaaagagtggccacgtcttaggcaagatagtaaatattaaaccatggcatgattgaatagctgcttttaaaaagttaggaaagtatagtagaaattaagcaaacaccctatgcttctgttgtgtcaatgatttcttaagacagatttttgatggtacaccaaagcttcagtgtagaggattaggattagtgactttaattagacatgttgttttgcgtcgtgacggaggttcaaacgtcccaacgtcaagaaaactaacttcccaactttagcaattgattgcatgctgctctctttgaagtttggaccatacatacatacatacatacatacatacatacatacatatatatatatatatatatatatatatatatatatatatatatataataagctaaaattggaacgatgtgatgaaaaagttgaaagtttatgtgtagaaagttttgatgtgatgtaaaagttggaagtttgaagaaaaaagttgggaactaaactaggccttaggtttaaaaaaattgcaagtcaagatttaaaacttttaacttagttttaaaaactttcaagtgaagattttaaaccttaactcaaatttaaaaacttttaactaaaattttgaaagctttttggatttgaaacaaaatcagatcaatatttgaaaaatatcaactcaggtatgaaaacttttaaatcaaaattaaaaactttcatcttaaaattcagaacgttcaaataaaatttgaaaactttcataccaaaattcaaaatattcaactcaaatttaaaaaaactatcaactgaaattggagatgagaatatttaatttctaaactaaaaaaatagtgaaaaaagtcaaaaaccgcgtctggtcaattagctttggaaagagtacgaattaccccctcacccaccccgtactatcgtggttgaccgaattaccccctaaactcaaaaaccagatatctctcaccatgaacttttaataccggataagttacccccctcgatccaatccattgtaagcaaagaagtcatctaaactcgaatattggatttcaaatcccgtctggttttcgcgcctcgatcaatgaaatctcactctaatactgaaactttcaggctctcgaaacactcacttcatagcacataatatgctatggtccttcaacccttcacaaccaagactatcgacgactcaacaagaaaagaaattgacaacattaaatattttttacataataacaaattttattgaagttaatcaattacataaaaacgataaccatcaatacccttttacagtatcatatgtcatacactacccgaattcccgaaaccatgttcaacgttcctttccattcagacagatccagcaggctcagcctcctctcggttgcacagcacaacactaggcataaaatctcatcatcttcttctcgttttccacacgcatgcttttcaaactgctaaacggtgttttttttaaaaaaagcttcaatacgaaagttgcttaaaaaatcatattgattcgttttttaaaaaattaacaaatacttaattaaccacacgctaatggacggttcgatgaacgcatcaggttgggaagccaggcttccgaacgcagcctaatccagcggcggagtactgcccaggagaagcgttctgaacacatgccccctcctgaaacggcaggaacatggacgtgggcacgtaacagcctgtgaatgcagccaaacaccgctgaaaattcccaacaaacttcgcccgtttccaaaggctgctacgacttcaccataaacaaaagtcacctacccacagcaagaagcactcactgatgactaatccctgagagaacttatcagctaaacacaatcaagtagtgtaatcaacagctggaacagattttgcccagcactccatccatccgttccgaaataaactacactaaaataaataatgtgttatttatatgacagtaccttgtcgcaaaataaagatatttctccacatatctcctcctatcaaccagtcacaaccattttctttcacccatttttatcttcttaaccaattacacccttcctctaatcattcttacatattttcttaatatctatattaaccctataaatacttattttttgaaatagagaaagtataacaaatattgatatatccttagtttaatttattttaaaacggagatatatcttagtttttttttttgcgtgacagcctgacaggcaagcgtgagacagaccccgtgaatgtgtgatgccccccgagtgcccagggaccctacctacctccacctgcgacagctgctgctgctgcgtgaaggcacgcccatgacgaacctaggacctcgtcttcagtgtcgccatcacccggcagcacatgagcacacaacaactttgatcatcatcatcaccattgttatgcatcttatccggtggagattggagaaactgattgagatcctcctcgttgtcgtcgtggatggaaggaggccttctttctttctccgcgtcagcaggctgatcgctcagtttcggtccaaaagcaaaagagagagagacatcgcattctcagattctccgcatcgtctgtggtacaggaaatttgcgtggaaaaattggtcgccgagcaggtgagcgagcgagtgaccgcgatttcggtcgtgttcttgtccgtaagtctgtccgaatttatcagattgatgctgcagattgcgttcaggtctttcgacagtccaactgtaacatccgcggttcatcacactgtaacttcacacgccaacagctcagacatttctaccaggagacgaaacgaatagattgacagctcaagacacgctaagcaacgatattggaacacttcatcaacaaaactcgggtcacctttggaagctagtaactgtacaggattttcaccggaactagttcaattcccgtgagaaaatcctccgaaaatccttattccataggagggatcaagctgaagacgatgggcattgatcatccttatggatcaagctgaagacaatgagcattgaccatcatcaattttgcagcaggaacaacagcaaacaacagggaagcagtgagtcctttgcagttcttgcttgaaatcaaccactacaatgtcaaaagatctaggcagaagctaaaatgatcaatgatcaatacagtcatacactgaaacaagaagcacaaacccggacagtatctcccccgaatcaaaacgatcaactaaaaattgcattgcaatttctgggcgtgcgtgacaacagatacaggatacaccaccgggaagcaaaggctgctccggcgacaaaagggtagcagcaacaccacgaactgaaaacacaccacctccggcggcaaccggcaatcgccgtcgtcgtcgccgtcatcgtcatcgtccagcacctacacacgctcctccctgaattagaacaacacgaacggagaaagaactccacatgaaacaacagcagcagcagcaggaaacttgagtgaaatgttagcgattcctctttcggccttgggcttgggcgtcgtcgtctcacacgaagccgacctcggcgaactgcgggcgcggcttggccgtcgcgccggggcgcgtcggcggcggcggcaccatcccttccgggagagggttcttgcgcgggcgccctcgcgggcgtgggatcttgggcggcgcgtgcgggtcccgcggcttgggcgggcggccacgccggcgcggcacggcgggggcggcggcggcgacggagccgtcgaccggcgcaccgacggggacggggacgggtgcggcggcggcgggtacggccgggtagcccggggggcgcaccttcgggggacggccgcggcctcgcttgggcggaggaggcggcggtaagtcgtcggccgagtcatcatcggcgaggaactcctcctcctcctcctcctcctccgccaccgccgccgccgccgccggatccgccggcggcggcggcggaggagtcgggcggagcgcgtacttcccacccgcgacggcgacgagctccccggcggctgacatccgggagaggtgcgccgcgacgagcgcggggtgcgacggcgggaggaggccgccgccgccgcgggccgcctcgatgcggcgcgcgatggcggcctggctagacccgttctcctccgccagcgacgcgatcgcctccacgatcatctgcagcaaagagaaggagaagacaacccaagaaacccggtcaattccgccacagatctgggcatctggccaggaacagctagggtttagaaagagagcgtgcctcggggtaggaggggaggacgaggtcggcggcgcggtggccagtggaagtggaggtggccatgcctggctggctggctggctggctccctccctctcgtagggttggggtggcgggggcgaggggcgctgtctccttccggcgttggtgctgcgctgtgcgcgtgtgggatttggggccgccgcgacgcggatctgagaggagaaggggggttgtggttgtggtcttgtggatgtgggggggaatggaatgcaagtacagtttagacaaggaatctgtcgggtggtaccgggccggacgaccggtcgcggctgcacgctctactcctcctgtgactccggtccggtttagggggtgtttgggataggaacttcttttttttttagagagagagagagagagtttagcccctctctcccaaacagccccttagtctattcgcaagcttaaattctactccctatgtactaaaaaaaactcaatttaaaagagagaaaaaaacagctaatgagaagctcctttgtcgtgcagtcttgtacctagctttgatcgcttgtcttatttattttttaaaaaaattaaaaacataagtcatgcataaagtactattcatattttattatcttataataataaaaatactaattataaaaagttaggtacggaaacttatggttgcatttaaaatatgacggatgtagtagttggtaataatttggataagctaggaaactcagcttcttctagtttctaattcattttatgaattctacaactataatttcttaaaatctaaataagaacctaaattgtttaagagagcctctagcagctgaggattttagaagaaactgcagctacgaaaacttctgcaaacataccctctcagtccggtcttagtctccggtcttactccggtctgatcgggctggttcggccggctcggttcagtgagctggtgattagtatactagtaggattaatatatacagtgataagcattgtttgagtggtaaagtggtttggctaattggctcgtatggtcgcatctggtttgtggtttgtgaaagtgtcaactgggcaaaggatagtctcatcagatgctggcgagtttggcggtcgttttcacgtgacttgtgacggtggtggtgttgcgtggtagcaacagctggttgatcctttttttgttactagtttggctaatagtggattttatttaatctctggtttctttattaaaaaaacttttaagctctgaaggggtcaatatcgtttgagtgcctatttactttgatcagcggaggctcataatttgcggtaactggtgctctctttgtacagctttaaattcaaaaaaattttgagttagattttcctaagagcaagtactagaagcctctaaacacaagcccaatatatcatgtaaacttagataataacgtggaggagagaaaaagaatagagagatgactagagtatccacttcttatgcaaggaacaacctccatagaaactctaaaaataatagagaaagagataaattgattggtgaaaaatatattgggactagtgtcctacaggcaatatactgtatatgttagtttttaaatttaagagtatataatatcgataaataagagctgatcactgcctctactataaaacttgatctaacttaataaatccatagatctagaactatgattacgttgataacatttgaataaaacattctgctttcatttcaaatgaaatttaaaattttaaatatctataacatgcaaacttatttttttctgtggatctgagatatgaatctataccaaacatgatataggtagccgaatgtccatgatatttactataactaaaaccttgaatgttcatgccaagtgtaagaacatctttagaccttttcaactctgttcataccgttttatatatagatactcgcacacaatttgcgtttttaatagtattttactcacattagggattagggatttatggttagtctttgtctattatgcaaagaatgtgttagagaacgcatatccatgttacatgtgcgtattattataaaaaaaactttagtcatttcattttttttaaatccccgtttgctctttccaaataaatgcttctactcatttattggaaacaaatgctaattctgtcacaaattagaataactcattttcccgatgcagtataaaaatgatgcgcttatttactggggttattttcttcatttttttaaacaactatgcgcatgtaaaaagataaaaagagatttatttaacgtgcagtccattacttcagtgggccgcgttctgcgcgagaaaaggattggaaaaagtacaccgaaggtccctcaacttggcaatgggatacaaaacatccttgaaccgtaaaaccaaatatgctgggtccgttaactatacaaaactagtcatcagaggcccttccgcggtttttatccgtgttttagtctacttgacggctgagtcagcgtgggacctacgtggaccccacatatcagctgggcacgtcatcaccctctccctttctcctctctctctctctctcactcttctcttatcttctggcgactgggcaagccggccggaggcgacggcgcagggcggcccaaggggcacctcttcaaccgggcgccgtcgccgcaccagaatggcggccagagcaggcgaagcggcgacggtggcgggcgagcacggttgcggagaggcggcgtcggcgggcgagagcggtgcggcatcggcgggctggaacgatgcgacgtcggcaggcgagagcggtggcggcggagggagcgtgcctgctcattggcgacgtcacgggcgcgcagctcccggatctcgtcctcccacctgtccaccctctcctctccttgtggatcctgcacacgccaaattcacaaacaaaccagatgcatcgatgattatgctgctcgtcatcaagcaaccaaccaaaccaattattttattagcgggtgtgtgtgtccatggccatggctatggatggtggtcttacgagcagaggcgatcctcgaagtcggcggcgaggttcttgaacagctcatgccccgcctccagcatctccgacacctgcattggcattgcaatctcatcgatcgatgaaaaattcagaatgacaaatagcgaaatcaatgaatggagagaggtggacctggcgagtgaaggcgtcaatggcgaggaggatgcgctgcacgtgctcctccgtctccgccgacgccgccaccacctcctcctcctcggcgacggccatgtcgtcctccgtctccgtcatgggcccggtggtgatgttgacggcgaccccggaggaggccgccactccccctcccgcgctcccctggctcaaccatctcctcctctccctgtcctccgttgccctgcacgcatccatccatccatccatcccaaaactcagatcagattgagccatcaaattttcgacccaaatcaaaaatcaaatgcgcctcaacaactgaactgattgagacagtagatgaaatggaacaagtcgatcggaacggaatcgcgtggccttggttcgatcaaagcaacgaacgcagctgacgaccgaatccaatcccccagaacgaacgcagctgcatggactcgcggaccacgaccgccgccgcctctgctccatcgattcccgggtgcactcgccgccaacacctcacccgccgccaaccacgaccgcgcggccagcccagccccgcgtgagcgccgcatccacgaccgcctgccgctggtctcccgcgcggtccgccgcctgcgccatcctttccccatgccggagagtgtgatcggggaggacgagcccgccaccgcgttcacccgccgccgccgcctcgcccttccgccaccctccccttctcccgtgctgcatcgtcggccgtcggagagaagagtgtgtgagagagagaaacagcagaaaagggagaggagggaaaagatatactgacatgtgggacccacgtgggtcccacgctaactcagccaccacgtaggccaaatccgggatcaaaaccgccgaagcacctctggttctgtacagttaagagaccctgtatatctggttttgcggttaagatgtttttttatcccgttgacaagttgagggaccttcggtgtacttttcccaaaaggattcggcgagaaaaacaagagttcgtaggcccatcagcccatcccatgagcccacctagaaaaaaaaaaccctaaaacacgcctgccgttttgatcggcccaagccaccatcgccagccaaccacagactagaggagaaggaacacttcgccggcgacggcggcggcggcggcatggccttctggcaggcgcgggacttcctcttctgcggcgtgtgcggcaccctcctcaaattcgactccgtccgctccgcctcctgccccctctgcggcttcaagcgcaaggccaaaggtcgtcgtcttccccatctctctccctgcaaagccctgggctgtgttcttcttgcggctgatgccttcgttctctttttttacggcgcagatatcgaagggaaggagacgcggtacacggtcacggctgaggtgcggccgattgctctaccctctagctcgcgcgaaaccctgggctcgtctgtttcagtcgcgaccgattttgtttcccctcaagtatctaaaatccataatgcgattcattcagtgtagtaatcctaggagatatagtttagtttgatttacgcgaggagtatatatggttgtgcggtggagcaatccagtcttgtggtttaggtaaaaggacggtttcactgtgtcgtgcttcagtatcgtatttcatatagaggaatggcttggtgattattgaatctacatggcagtgcactttagtagatttttagttttacaaatatccatgctgccttccttgggataatgcaatgcatctcttgggagctactccctctgttccaaaatataaggatttctaggttgtttagcaagtactctactaagattaggtcaaaagattttttttttctttattcattgcagttgtcaatttttgaactttgattttcttagattcccttctgaagcatctgattggctctgcgatcattgaagtgatgggaatcagtgcagaaatgcttatattgtggtacaacatttgaatcctagaaatccttatattttgaaacggagggagtattggtctgagattttattttatgtgctgagatgactcaaatggcaatatcctcatgctttcacatgcatgaatcaactgtggtaatggaatagtatgagttgtaggcaaacatcttatggagcagcaaggtaagatgtatagtgattttctggcttggcatttgtaggctactctgagtctctgattaagtcctatgctccatacttgtacacttctagtacttaacaaagacatagcacctaaaaggtgccaaatgaacattttaattttatggaccacaggtcctgcctttttaatgaactgtgcggtttcttgaatcttgtcccaaccatttatatcagatatgaaagaagatttccatggctatttatatgtagttgacattttgcatgctgttgacaggatattagaagagagctaaaacttgatccatatgtgattcttgaaacaacactgaaggaggaagacgtaattgtcgaaagagctacagtaagttaagctttttcatcaatatatagtctgatagtattttgtagttctgcacatattcataaatccttttctgcattaggtaaataaagagtgtgaaaaatgcaaaaatcctgaacttcagtattacaccaagcaggtcagctatcgatccttgaacatttgatgttcaataagcttaattttcctttttctagctttgatgcttaactactttatgaaaaatgtgtaattgcagttacggtcagcagatgaggggcaaactgttttctataagtgcgcaaactgcaggcatgagttcaatgagaaccagtagtcaccttagaatgagctttttgatcacttctacgattgtggtctaaaaaatggccatgctttgacatgacaagtgattttgaaatattttttttatgcctttgcttgaattatgacaagtaatggtgtgttcgggagaagggtttaggaacctcttccccgtgcatggaaaacggggtggcttattagtgcattattaattaagtactttaacgcatggtttagcagtttgccaaaaacattgtatgtgcttggaaaacgagggagaagaagttggtaaagtgtagtatagaacataccctaaagaatcacattactttgggccacatgtccaatcctcaatcatgctgtttttcgcgggtgctaattgcacataaccgaagtgtttctgttttctaaagattattaacctgaaactgcattttggaccttacggtgctcatatgagctctcttacttccctcaaatcctttatgccctcaacctatgccatttcaacctgttccataaatcatacatgttcagcttctaggagatatggcattgtttgctaactgcaaaaatgaaaaggtgtataagaaaggctcgtatggtttgaggggtgtactcttgtcagcaccaggattccaaattttgcgataaatgggtgcgtatcagtagcgctgtgactcccggtaagagctcatcttgagaggttttctgttgtcgtttcaaatcattttctgttgggactttcaggttatgaccaagttatcaaatccagtgattagtttttttaaggagaattttttcttaactagttcgagatgaagctgggacaaattcgcagtcccaattcctggtctaatggtctatatgaatttctggctatcttgttcttgagctcgagactgcagcttgtttggttcacgttctggttgctcatgccgtgccgagcactcgtgctacctccgtcccaaaataagtgcagccattgatattcgtgcccaatagggctgcaggaat

SEQ ID NO: 60927 - DNA, 1242 bp, Oryza sativa
aaaatactaattataaaaaaaaattaaataaggcaaacggttaaacattaaacgtgaatagtataaaattgcacttattttggaacggagggagtagtattagctaaagctgattgtggtaaagagccaaagaggtcagatgagcagtcatgctcatgcgtgatcagaattcagaaggatttgaaatcctttgctcagtttgttccccttttcccaactcctatttctcgttttccgcgcgcacgcttttcaaactgctattttggtgcgttttttttaaaagtttctatatgaaagttgtttaaaaaaaatcatattattctatttttttaaaaaaactaataactaaataatcacgtgctaattgattgctatgtttttcgcgcggaggagtttggttcccaaccatccgaaacgaacacaaggtccgcaaaatgaacacttgtacactaaaattttggcgaggcatactcatttcagattgccgtagggatgcgaaatgcatcgcgagacccagcatttgtgtacgtgtatgagaatctcctacgtggatggtcactgtgaaaggccttagaggcaaggggttgtatgtcagttttttacttgcaacgtttaaccacttgttttatttaaattctttttgcaaatataaaaaacgaaaaattgtgcttaaagtactttagataatcaagtaagtcacaaataaaataattaataatttcaaaaaaatttaaataagacaagttgtcaaacgttgcaagcaaaaactcaaaatcccttatattattatatgacagagggagtagtagcaaacctacattatacatattacctcataatttattggttgttaacaggaatgaaattagacgtaatagccacctccactgcaaaacttaggcattcaccattctctacgagaaaagaactcaagaccgcgcagtctcccgagttccctcgattggtaaagatacagtgaatccattgactaaccaagcgaaccaaacagagcagtatacttgccccgagaaaatttgagcactgctatttaaccagatttatacccagtgaatggtattttgaagtgttgatagttccgagtacagggatacctccgagatgacaggaacttcattcggtcattcccaatcacatgccacaatgaaaaattgctcagaccatctacatcttcaagggttctatttgcatacagtaaccttgaccaaatcttggtggcaccca

SEQ ID NO: 60928 - DNA, 11203 bp, Oryza sativa
gtaattgatagagacaagttgtgatagattctgcagcaaaagaagttagaccggtgtgcagaatataggcacaaatgggctaacaataagttttctacccctacttttaaggattgatactgtcaatgaaacgtgacaatcacaaatttaatgagaataaaaaagaatatgtatttgttttgttggactgctagacactaagaactttggtttgtctttgtcgacactttgcccaattccttttttccactcattgtctcgctggcccacatgtcagtgagccatcagtgataaaatattcagtggatttttagattatgtatcacaaggatctaggtgctattttataatgaacattgtactatcgtttactgtgtggaacaattttgccacattcaagggaatcatcaaactacattttacaaagcacgtgcttgtgaagttgtgagcatataagttgactgacggattactagtatgattcataccaatagcattaaatatctagcgaagttattccaatggtttgagctatattacagtactgtgtctagcgaagtagagatgtgactactatgatttgaagcatattgtaactgaaaaaggtgttattactgcttggtaatgcaaatactgaggacctgttcgtgagtaaatacaagggaaatgtaaggagctgtgggtaaacttttctgcccgtaagtgaaggacatgcattacacattacacgttcattttaaaaaaggatccatcatggttactcatgcttcaatcaatcacattatgaacatgaaacaaaataggtggactgtgaagccgtaggcttactttgactgagaaattgtaaagaaaaaaaggaataggttatccaccgtgataacaccatcatgcttcaattattttaaggatataaatatgtgaaactgtaggattaccttgaatgagaaattgctgaaagaatagttgacatttgagctagattcaaactcagtgaagccactagactcatccccctatttgcacaatttgcacaattgtttagtaaaatgactgaagaataaaaaggcagacaaacaaattgtagttttcttttcctctacttatataaatgctgatgattcataccatatcatcttggtgattgctcacacagctactgctgccactaaggcttccattatcactggaatcctcaaattcgtatgcttcatagatgttttcgtccgatggattccaagaataacggctggtgaagtagctcgtgtcaaatgcactatctgaggaggggacaaaggcagcctgcatatgattccgtgttatcctcggtacacctttacaatggagatgcaactatgtttaaagaataaatagttaaccatatcccaccttttgcctagcaagggtatcccagctaatgtctttaaaaaattgatgctgcttaacctgaagggaataggattataagcatcaatcatttatgtatcataagaagttttgaataatccatacaacggatgaaggtttctaaaaccctcaaaagtcaaaatacctcagaggcgccatttgcacctagccgttggtgagggtcttctgtcaataatctgggtaaagcagtcataatatcacattagttacataaaaaacataaccacaataaacttcacaaaggattttgaaattgagcatgaagtagatagggagtattgtaataatatgcttaaattgcatgcgtaaagattccaaaaatacaaatcatattgaatagttctacctttgagcaaacagatgctataaaccatagaacacaactgaacacatataatatagcagtgtgctactgttaccctataagctgaaactggaaaaaagatagggactgacctatggcaatataaaatatagcgagtaccaagttatcaagcaagaaaatgtaatattttagagcagatgtgtccctgcctagtttgacccaaaatcctaattaaccccaacattcatttgtgttatttggaacctgaataatacagctaacaatctgacgtacattaattcacaatgctgatacgagcaacttttgggtggtgattttacagtacaaatgagggagctcacttcaattgttattgatggtgatgatcatggcaaaaaccctattgactttagtatagaaatttcatgcttgtcattgggataacacaaaggaaaatgcagtataaagacaacaatttattatataattggtccattgaccctaaaagtgacgtaaaagctgtgcaatctagcataatcatctatcacattaaaacttggaagcaagaaatagtaacatgcaatcctgtaagactgaaacatgagttactgtgtattcagaatactcgaaacatttcttacttgtcaattagatcctgagcttcagaactcatctcttctgggacatgtggccaaggtattttgcggttcagaatgttgtcgaaaattgtctacaccaaatacaacaagaatgtcaagttgccacagtttcaatacagcaaaaaacaacattgacttatatagcgacattttgcattaaatagatgaaaacccatgtgttttctagcagaccaaaacccatgtattttctagaagacctctttctctcatattctcaagagatctgaacgggagctttgcatgcttaatgaaagaactttactcaacgtcacataaatggcagagaaatattcagtacatgaaagtctgatacctgggggtgttctgcgttgaatggaggtattccaacaattaattcaaaaagtataacacccacagaccaccaatcagcactagtacctgcaaggacaatcagtactcaagagagtcaaaacgagaagacaatgcagaggttgaaagaaaactatgtcgggcattttaccatgtcctgtccccaaaaggatttccggtgctaaataatcaggagttccgacagcagagcgcttttgtctccgtgctcggtgatccatttcctcaaattcgctcatctgaggttcatcatctccatacaacgaagacccgctaacagcaggaccagatagatcatccgtgctgttgatcagaccaaccttggacaacccaaaatctgtcaactggagaattaagattgataagcaggacatatagaaggcattaaaaaggaacatattcgaaaaagaacgaaaacaatatttattgctgaattacaggttaaatgaaatgaaaactcagaaggaaatatgtgtagcattatcatcaattcattaagatatggattcacttaattagaaaagagctagctgaaatcagcatatatttgatttatgtggaaaccaacatgtcatgacatgaaagtttttatgcattgcctgattgtcatgtggggacgtcactactcactaagtccggcgccggcgacgacagcaagatacggaacagtagtttgttagcatcctttttcttagctaaattggtttgttagtttagccctatgatttgttatgatcttatctcttagatgggtatattaagctgtaaggaagttgattaatgcaagcagaatttgagatcaatctcatttcattgttcctgcctcaagggcgcgtcgcggatcacggcaccgccgcgccgtcgaggtccagggccacgtccgatcacctctttcaaatacaatcttcgccgagttcctccttccaatttgctaactcgtgacattgatacaacacagtttgaaacctcaaaaagtttcaaaactccaaaaactgattctcctcagaactctcataggatatgtgtttattttatctctcactagatgatgccattgtggcaattgctatgaactgctacatcactatctcatttggttgctggaaccaaaaataggaatatatcttctagtcatcagagaacagaaaagcgcttacctttgagaggcatgtgaatgattttttagtttatcatgtactccctccttccaaaagtctaagtcctatttcattctttggtttttccaaaagtctaagtcctatttgtagtcattatatgctatattaatttttttatcggaacccaagaagtcattttagtactttataggttgcatgttcattggttttgtcacatgatgaatgagttaactacatattggtcttggtgcaaaaagaaataggacttagacttttggaaggagggagtatctaacattgaacataaaacaagaaaaatggagagaaaacttaacgatcatgcgcacacataaatacctttatatgcccgtcatgagctatcaataagttgtcaggtttaagatctctatgaactatgtgcatagagtgcaaatattccaaagctagcacctgcagaataaaatgattatcagacaaaggaaaagtgaaaatggaagaaataaattgttagtaaaagaaacttacaacttctgcaaggtatatacgagcaacatcttcatccaagcaccctaaatttctcagtagagaatacaggtcccctccattcaggtactccatgactagatacaaattttcccgggaggtaaaagaatagaagaaacgaaccttaaaagaacataaccaattcagaaccacagtatagctttcaatgatgaagggtcgcatttgcaagttcactcaccacaaaaggattcctcactgtaatcaagatatcacgttcagccaatatactctcaacagcatttttccgaatcatatctgccttccttaatacctgtttcaaaagtaagcaactattgttagaccacatggatgccccatccatcccaaaccgaaaaacaaaagctaataataaagggagtttagcagtcaagcccccaaactattgctttacatcttagagctatcatgctgagcagaggcaaggtgttgtgtgctcagcaaaaccaaaattactataccaatttatcattacttccttttttgtgaggagtcaattcatcattcatgtgaactaaagtcacttcaatctaaaacctatgatggtcaagttgtcacaagtaaagcatgaacatgatgggccgctccactgtcattctgatcccatttttataagtaagctatgactatcaaggagactaatgcaggtaaaaataactacttagagtccaatatcatgtccagtctacaccatagtctagaaaacaaaaactaccaaaccaaacaggcaaacacaccatcaaaattttgccactaccaaaactttggcattgcccatatatttgtctcttgttggcacaaattggcaccaaaccaaacctaccaactctaccctaccaaaatgtgatagtgccaaaagttgccaaagatacggcattaccaaacttttggtagggtatcgaaccaaaatgtgatagtgccaaaacagcataatgatttaacgggagcaactaaatggatcccattggaaccgactccatattagttaactttttaaaagcaaacagtcatataattttaacatatcctgtaatcacataagttacttatctaacaagacgcagatttgattaaaaaacaagggatgcctaactaatgaaatcgagtgcagtttctttctcgaatgaattttagaacaagtgatataattcgtaacattgaccacatgtaccaaatgaaccagcggaacaagtggtacagccaggtttttgtagtatggatagtgtactacagtactataaatatgaagaggtgtactacaaatatgaagatgtgtactataaacatcaaggtgttaatcttttttgtggtcaactagtcaaactgggagcaaattaaaaaagcaaacgcgagaaataccatctctctaatcttccttctctgaacattgaaggtccacaggtatttcctttcttttgcaaaagttttcaatccaataatttgaccatgtcatgttgatcacaaggggtccttgataataaataatgaatgacttccagctggtggttctcatagaaatgtgttgtttagaaaggtatgcataaatgtacgaaaaacctcaaggccctttctaaagtatcattgcaataatatcacaatggcaggggttatcaactgaacaaaactaccgccgagtatcgacaagaacaaatattcttgagtgtgttttattgagttttggggaagaagactggcaagtcaacatatttacatcaaaagcaatttcctttccccttttttgcatgctaaaattctggtttgcgtctgaaagatagtcatatagcaatatttttggtttttggtcaagaatgcctacaacattacaggtacaaccaaggaaagcaagtctgggtacataagggaacaaatatatggcaacaaatacctttatagcaaagaggtctcctgtagttcttttcttggccaagaaaacacgtccaaatgctccacggctgataggtttaatgatttcgaagtcatcaatcgaagtacgatccttgactgggtgaacaggactagctcgtaagctacggacaacatcatcttcttcatccattacagtactcgctgaatcaactttgtccatatcaaccgaatcacaaagcagtaggtacttctccctaagaaattatataaatgtgaagggaaattacaaatggaaactaatataagtgctaaaagtgacctgcaagaattattttcatgtgcttatttagtataatgtcaactaagataagccacttgtgtagtgaactcagcagagactcaccggtggagtttttctatacgtgtgccaaatgtctgcaccgtgagagcctcatgcttcctacgattgacaatttcttgcagatcttctatgcaggtaaccaatagggagagtgccctttcttcatctagaggagtagttgcaatgcaccgcgcaatatcagcaagttcaacaatctgcacagattgaaggacactgttaatcagcacttcttgcattatattacattacaaaatcatttactactggtagatgatgcatagtgatcctaacctagattattatatggtaaataccacactgaggaccagtgtgaaggggggagtccgcttggaaagggaggtaaacatgacaggagtgaactttttaatctttcttcttgcttaattcttaaaagaaaacaaatccccttgagctcccaaaggtgcagctaagacattggagatagtagatgccatctaatcagcaccatctctaggtatacttggtaacaaagcaaactaaccaactaacagcatctctaatgaagggcttgattggtatagcttgctgcagctgcagctgtaactacagtaccaataacaggttttgtgatgaagctgctatagtgctgcggctgtgcagcagcagcaaagctgaaccaatccggcccgacatctaacgtgtggcagtggcagctaagcccacaatcatacatggcacattcgttccagccacccaaccatcatatatacgcatgacacagtggttgattggaaaaatagtggcattattaccattccttttcaacaaacgtattctgcacaagagaaactaaattttcataaacaaacaaaatattttaccatggccatagctttgctcactttgcacattgtaccttgtacaaaaataaacaccgactattttctatagtttagcctagcaaaataatcaactatctaatatatgtatgtgtgattgagagagcttacctgaggaagatcatcgctctcattaattgcacttcggccagctaaaagcatgtctatgtgattagatcttggagttgttagtggagatctaggggtcatacttcctgctgaagatgtagccattccatgatcagattttggcccaaaacgagtcttacatgtcatggaaggaaggttttttatgtcatccagtgaaatagtgctatcagcctcctggaggtagtcaagcatatcagctgagcctcttctagaccaatcagagagttttggagaggggccatcagattcttcattgatgcttgaatttgatacttttgcaacatctggactgccaacagcatttggaaggtctttttgtgtataagattctaccaacttttcaagtgcttcagcaactctaattagacgttcatcaacgcttacacctttttgatcacatctgtcagcacttgcacatattgctgagtgattttctacataatgagtagggacatattcttcacatatgcgacacattattgaaccttcttcagaaatatttggctggtcagaccagtgaccccatgaagttttgtgttgatgcttgggaggaagagattgatgtgatgtagattccactggactgttcaattcagcctggctactaactgcagggggtgtatctgttttcttattaggtgattcctctttaataggggtagggtctttagggggttttgggacaggtgatggaaaaggtttccaggaagatatacgctccctggttggagactcaacctcctttttaacatctgttgtatcaagcggtgaaagaaacttaacaggctttatctcctggcttctcttccattttaaattatgttgctcttgactgtacgattttcgtacatcacttttgctgcctctggttgtagtgtcatcacctggttgagccaatatctgcctatcagcagattgtatgatcttatcacgttgatccataacaacttcatcctccgcaaagccactctctttgtgaaattgaagcaatcttgtacatctcgtaaggataaaaagcatccgagtgtacagtttcttcagcacacccattgggagctcctgacgatgatcatctaaatcttgcactatgccttcacattgaagccaaaactcccccggtgtcattacacagcagctacgtgcaagtatgagcaaatcttccaaagtttccttccactcaggatgagaatctgcgtacttttccattacaccaaccaagtctcctgcaaatactgccaaatctgaatttacctcctcctttgctttctcaaatctcacctgaataacttttaacacctcctgtgttgatgacagaaaacaagattaattttgctccataaatagcaatatgaaggtcattaatcactatccacgaagaccatgaattgagaataccttcaagttgtaaatgccccgaggcttccaaaaagggaatggtcggacccccttggagttcaactcatgcgaaaaactttttatatctgcagggactctcttccttggagcactggtagcctgcatgatggccttaaagcgtggagattccgattcctttggtgtttcacagggatcatatgcacactgtggattaagatgacagtacagataggaggagtaagaaaagagcaaaagatggttttgtcattgcttgtttaatttaaaaatgtgaaatgggcttgtagaagcatcagtaccacattatctggtatgtgagttggagtcctcaaatctccagaatggttccgcaatgcattcggtttaactgtgtatgagatagattgggcacacacatatcagattttcaagttacaaaaagacacacagattatacattgttagctattgttatatgggataaagtagaatgtgctatggacaaggctacaaaaagaaatgcattttcatatgagaggagcagaaactattaaacaccggaagcacatattatagaataaattcagccagttgtagcaacaatatgaatctttatagtaaaacatttctcagcaaactactacagagtttgctgcggactccaagaagttcgttttttttaagaactagcaaattaaactgaaggatatagctccgatagacataaacaggtatttaagtaagtaatctgccacaagtcaaatgaacacctcactccagtcatatatccaatgagctgtgtatatagaattagaagctgtgcgcacaattacattaacttcaatcatgaaatcgcaggaatagcttatgatcaactgctaaaaatagcaaccaattactagctttgaatttaaattgtctacaccttttaataactaggcgggcattccttacttaaatggtaagaatcattcttacgttagcaccggtggttccaagtttagcatctagacaccatgcggcaaaatgaaaatcatgggcgccaatctccttataactcaacacatctaagttgaaattattatgtttttactgtttttaacaactaccgtcgacacggtaagctctgaagggagcttgaattgaattgcttaatgctgttctccccttactatcaatgcaagagcttggcaatgataagctaatccccctatcttccaaaaacctgtagccggcttgcaggatcatgatgcaaaaacctggaaaacaagtttaaaggatgttcagcttgcaggatcaacaaccttttgcagagctctttccttccaggctcgttgctgtggcgccccgcgctggatgttcggccgctttccctttcccccggctgccactggtcgaatctgcccatgagcttccagccttcctcccgccgccgccgccgccgccagccgatgcagccgacgggtccgcctgcgcctgcccacgcgatagattactgctcccgagcgcggcagcgatgcggtgcccctcctgcggcaggggcccggatctcgtcttaatccggttgaggcccagcgaggacgccaggatgggcgacagcgccgccgccgacgccccgcccgcgcccccatcccgaagctgcgccgcggcggccttcctcccgtccgccgacgggctcgacgaggccgacgcaggcgccgcccccgcgccgcccttggaggcggcggacccggacgcggagccgccgaagagcttgtcgcgcttcctgggggtctccgatttgggcttcttcttgtcggatctggacgacgacgacgacgacgccgccgccggcgaccccgccgcgggcggcgcggaggtgggcgtccgcgggctgttgctcccgtccgtggggctcgacgactccgacgacttgtgccgggacgagaagaacctccccttgaacaccatctcctcgccgcccgccggggaggcgttcggtcgaacaggtggtgggggcggccgagcgagcgagactgcgagtccacaaggagagagagagagagagagggagagcgtggtagtggggacaa

SEQ ID NO: 60929 - DNA, 2293 bp, Oryza sativa
  unsure (1)..(2293): unsure at all n locations
gtggtagtattgacctagtctgtggcgtcgacatggcgctttggttctattataattaaaaaaatatatatgtgggatccatttgtcattcaaaaaaaataggacccacatatcatcctctctctcctctttcctccttcctctctctcctcttcgaccgtctgcaaggggcaggagttggagcagccggtggactttcgtccgcagcacacgtatgctgcatccggcctacttgacctcgccatcacgctcctccgcctcacgctggacccaaccaccatgttctacagctccgccatccacgtccacacctcccacagtctccagctcgccacactcgcgctgctctctgagatgctgggtagggggctcctcccaacctcgcacacctgcgccgccgccgctgctccagccctgctcctcgcatacggccaaaggtggaaaaggggagacaaagggagagataatggagagagagggaggaggaagaagggggaggagagagatgatggcatgtggcccgatagggttaatggactcttctgtcagatatggatcatgtttgaggagacgaagattctaaaagctagctggtttggtaggtagctatagcctctaaaaacatgaaaaaaaatggttcctcagcttgtaattttcagttattttctaaatagattgtatagttatacatcacataaaatatgtacgctttaaattggatcatgctttaaattgtaagtgagtttctagtaatggtaacttctcttacaatttctagctcttaaattggatcatgttttttttaaatattttcagcttctctatataattcaaattgtcaatcatactctattacaatgtcaaaaatctaaaacgacagagtagtagtaatattgaataaaatatgatacatttgaaagggtatagttcgaaatgtacatttgaatccaactcgggacaattcgtcggtatgctgtgtggacgggattgagagagacctgacgagtgggtttgctgttccggcgtgggggccgggggagtttctggtttccagcatcgaggattcgagatgctgccattgtgccatgctgctggtagcctgtgctagtcagcctgttcactggtgcagtggtgctgctgatgctcagctcagggcccggtctgggagagtcaaagattcccggtccatggtttgaatttggaaagagagaatttctcttttacttttctagtagatctgaaaattattttaattttgctaaggtgaaccggtgtgagctgagatctactccctccgtcccaggaagaagggattctggaagcccaaggtagttttagaataaagagtaaaagactaaactaaccttagtactagtacatccaattattagttacaaataaagtattactactgccacacattaataaaatataattagtactccatactcaaacacacatggagatacagggcgccaaggtgccaaataatttgaatgaagagttaagcgccactttattggcgggatgtaatacaaatttagcacaccccaccacaacaaaccctacaagtttcaaatctgaagtttccctcccactttatcacttcataactctgcaaaaacacaagtttccctcccactttatcccttcataactctgcaaaaacacatccatggctttagatctaaatatagcattagatgatggagatgaacatgctatacctaacctcaatgaagcagtggctgaagaaacagcagcggctgatcaggaggatgaccaggttggaggtgatctccatggaggtgccaaccgtgagcttcctggaggtgatttccaaggaggtgccaaccatgtgcttccttttgatctcaacttgcatgcatctgaccaaaggagaaatacatctaggtaaccttgtaaacatgaatagaaaataaatgatctttgtagatatggcttgcataaatcactctaaaatctttgccatttctctgtaaaaatgatctataacatgtgcattgatgcaattgctatcttcttggaacaaaattggtctttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60930 - DNA, 10090 bp, Oryza sativa
  unsure (1)..(10090): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcttctttcaggtaaacatttgctatcagcagcgcagtggagtctataataattcagacatgcctaaaattactttttttttttgcaaaccagtgaatattaaaagttgcatcaatgtggcaatagaagaacagaataggctgcggtgagacatacagtactttgaattcctgttacacaaaagttattcccttattcatagttcatacaggacgtgaattaacaatcatggcaagctagattagcttattgcttacaaattagtttagattaaattaacaattgtgtttaattttaactcaggacaaaaaaaagtgcatgccatctacccacaaagactgaggcatatgttactaataaaagttataagtaaaagacttcgttgataagtaacaaatgcagacatgttcttcacaaaagttaaattaaatttgattgttttagttcctatttcctagggtggtcttgcctgtgctctgacaaatgataacaaaacacaaatgaataggtgatcgagcatgccttcattgcttgttagttgcttccttaatataaactctacctccaaaattgttcgtcctatgactcgtattcctatcgctaacaacagcataccgccataccctacgcgctttgtgtacgattaagtccagaacaaaacagagcaaaattcgcccaaattcacatgaaaattaagaactccggaacaaaggatcaaggggtaacgaaaataacctataaccaacggcaacaaaatggatggggggcttggaacagaccggagcaggtagaacaccttgcactgagcccgtctcaccggcatcagcatccagccccctccccacacccacacccacggccgcggtggcctggtctagtatctcaccgtcctcggcctcgccctccgccggatccgccgcagccggcgagaccctatggcggtggcgatggtggccgcgcttgtggcgcttcggggaggaggcgccgtcctccgcgtcgtcgtcgtcgtgcggcgagcggcggtgcttgcgcggggagaggtgcgagcgggcggcctcctcgctggccatggagacccgagggaaccagctagggctagggtttggtacggaggaggaggggatcccgcgccgcggcgaggaagggtatgttggtttggagttggaagaaggaatcggatcgagcccgggaacgaattcccctcgtgatcaattcggccaccgttttgtaggaggaacggtcgattggagcagaccgttcgagttagacacggatgaggattgaggcggtgaggcctcccttcgagcttacagatttggggagatttcaaatagttcgattcgaaaaatgaaattgggaggttctttgataattgaaacgcagagatccttaagattattttatataaaaatagttcgaatcgtacaaaatccttcaaaaatttcacgttcaaacggacttcttagaaagcaagggaaccattggcttgggccattgtttcctttccggaataagttcactttgggtccctctatttgtcgcccagaccgattttcgtcccttgaccgcaaaactgggtatgacccgtcccccaacttacgaaaaccggggaaacatggtccctcggcggttttaaaggcggttttggctgacgtggcgcatacgtggcttgtttgattaggtctccgtcccacgtagcattgacgtggcgcttacgtggcaactatatctcagcaaaataataaaaagtgtggccccacatgtcagctgcaaaaagaaataactttaaaatggtggggccatgtgggccccatatgtcagcatcactcctctcttcttccctctcccttctctctcttgttccctttcctctctctctcttcttcccgggcagaggacggcgcgggtggacggtggagcaggcgagctccggcagcggcggtgggcgtggtcggcgccctggaagatgccatcgatgccgccgacctccacgcgcgccaggacggcatcgccgagcgcttctacaccgcgcttgtcgtcctcccgccgcctacgccgcgctagagccatgccgagctccctcctctcccgccagcgagctagaagggcggcggatggctaggcgagctccctggtctaccggcgagcgcgcgtgagtcgctccctcctctcccgccagcgcagagagatggggagttgacttgaacatataataaacattcaatgatgatacaaactgcaaagacagcttgagaggaacactagaacactgaactctgaaccattctgcacgaggtagtacattgtcataaacaaacgtcgcaaacgaccagtctaatgcgtgctctaccactcaaagtggcaaccaaatcgatggcacaaccaatcgaccaaacaaattcatatctcttcctctttgatctcttctccctgctcaatctcaagaacatacattatgtgttcaacaaattttcatcaaaaaatctcaagaacacgtcgtgttcaggcaaaagaacaacagagacaagaggcgatcgatggcaatggccatggcgaagctgttcatcacagggctgagcacggtgatcgcctactcgtccgcggtggtgttcaagggcgccgccatggctgtcgtgctcctgctcatgctggtccagctcccgggctacctcagctgcctcctcctctgcgccatcagagcagccgtcgagagggccgtggcggccaccttcgccgccgccggggacgccgtctcagcggcggcggacgctgcagtggggtagagggacgccgcgtcgtcgaacagcaccgcggcggtggcattcgtgtaggccgccatggggaggcccaaggcgctgcttgccgagatgctcgccatattcggcctcgtcgcctcgctttcgtgcagtccagcgacgacgaggaggaagacttccttgttgggtccgccccgggcgctgccgcggcccgccgccaccttcttctccggcgcagttctcgctatccccttctctctatccctctctctctatcctctctccttcctcttctctctatcccccctctctctccctgagaatggtgagtggcgacggaaggcgcacaggggcggcgacggagctgagacttgagaggcggcaggtagcttgtggagcggcggctggaggacgacgagcgcggcgtagaggcactcggcgatgccgtcccggtgcgcggagggtgtctgggtggtcggcggcggcgacacggatagtggcgaagcgacggagaagaaggtggcggagaagaggagagagagagagaggaaggagagaggatatagagagagagggtagtgaggatgacaggtggggtccacgtgggccccaccattttttttaattattgtgtgtgaaactgtcatgtggatcccatagtttttaatatttttcggatcaaattgccacataagcgtcacgtcaatgccacgtcagatgaagaccgagtcaaattagccacgtaggtgccacctcagccaaaaccggggtcaaattcttccgagggaacttatttaaacggtttcgtaagttgggggacctgttgtacccggttttgcgatcaagggacgaaaatcagactgggtgacaaatagagggacccaaagtgaacttatccgacatgcctaggcgtcattcgggtgtcatttcttaaaataggcgtaactttctcatacggactcggaatcaggcaaatgatatatccacggacatctacagaaaatgttacatccgattctcctcagctctctcccaaggggcgacacaacacgagggacgcagtggcgtgagtcaaaagagagagagagagacaaaaagagattccttcctttccacggtctaaaatccttggcccagttaggcagaccatccagccaacccactgaacagcccatgccatgacggagctgagacttgtcggtgactcgcgacacgaacgttctggctagatcgctggacctgaccaaaccaagaccaagaccaccccgctacgtgtccacccacgattggacccctcacgtggaccgttttcacggtgccttgtgatgtggagctcgtacagggccagaacactccggcgagtcctactccgatctcctcaccataatccagaacctatttaagccccccgcatgtacagcaagcatcgaccgatcacgatcattctccaagcctaaggctgtgttcgctatgggttgttcccaatagcacggaaaacggagcgatccattagcacgtgattaattaaatattagctatttttttcaaaaatggattaatttgatttttttaagcaacttttgtatagaaactttttgcaaaaaaaacaccgtttagcagtttaaaaagcgtgcgcgcggaaaacgagggagataagttgggaaaatggacgtccgaacacagaccgactagatactccattacacagcttcaccaaatcgcacatcgtagagacaagtgttgcatgagcagagcaagaaacatggcgagagataagcaatctgctttaatcgtcgcagcgttcgtactcctctgttcaggtaagcaccatggaatgatgcttggtttgatttgttttcaaaatttgcaatgtgctcaaatttgatcggttttttacttctttttttttttggttcctgtagggtgtttgtgcggagttgcagatggggcgaagggagggaggaagacgaaagggccggtgatcggcatcgacctcgggacgacctactcgtgcgtgggggtgtaccggaacggccacgtggacatcgtcgccaacgaccagggcaaccggatcacgccgtcgtgggtggcgttcaccgacgacgagcgcctcgtcggcgaggccgccaagaaccaggcggcgctcaacccggaccgcaccatcttcgacatcaagcgcctcatcggccgtaggtaaatgttcctcactagcttttcttcttcttcctgagctctctcgatgcaaatggagaagctagccgtggttgattgattgatttgggtggatttttccggcctgtcgccggcaggttcgacgacgaggaggtgcagcgagacgtgaagtatctcccgtacaaggtggtggacaagggcgggaagccgtacgtcgaggtgcgggtcaaggccggcgaggtgaaggtgttcagccccgaggagatcagcgccatgatcctcgccaagatgaaggagacagccgagtcctacctcggccagcgcgtcaccgacgccgtcgtcaccgtgcctggtttgtaatgcgaaagcttctggccgccgctccagaggttgacgacgacgacgacttatgctaagtgtgctctgcttgatttgcagcgtacttcaacgacgcgcagaggcaggcgaccaaggacgccggcacgatcgccgggctgaacgtgccgcggatcatcaacgagccgacggcggcggcgatcgcgtacgggctcgacaggaagggggcgggggagatgacgaacgtgctggtgtacgacctcggcggcgggacgttcgacgtgagcgtgctgagcctcgaccacggcgtgttcgaggtgctcgccaccagcggcgacacgcacctcggcggcgaggacttcgaccgccgcgtcatggaccacttcatccgcctcgtcaagcggcagcacggcagggacatcggcggcgacggccgcgcgctcggcaagctccgccgcgagtgcgagcgcgccaagcgcgcgctcagcagacagcaccaggtccgcgtcgagatcgaggcgctgttcgtcggcgtcgacttctcggagacgctgacgagggccaagttcgaggagctcaacatggacctgttcaagaagacgctgggacctgtccggaaggccatcgccgacgccaagctcaagaagtccgacatcgacgagatcgtcctcgtcggcggcagcaccaggatccccaaggtgcaggagctcctcaaggagatgttcgacggcaaggagccaaccaaggggatcaaccccgacgaggctgtcgcctatggcgccgccgtccagggcagcatcatcagcggcgagggcggcgccgagaccaaaggtaacgcaaatgcgtttgaattaccagcgtgttcggctggtcacgccatgagtcctcctcacacattgctgttcttggtgaccagacatcttgctgctcgacgtgacgccattgacgctcgggatcgagaccgccggcggcgtgatgaccaagctgatcccccggaacacgaggatcccggtgaagaagtcgcaggtcttcacgacctacgaggatcaccataccacggtctcgatcaaggtaagcacatttcagctcgtgcattgacctgataacattgattcttcagttcttgagactgacgaagctctgaatttctttttcaggttttcgagggcgagcggagcttgacgaaggactgccgcgagctggggcggttcgacctgtccgggattgcgnnnnnnnnnnnnnnnnnnnnnnnnnnnnnnnnnnnnnnnnnnnnnnnnnnnnnnnnnnnnnnnnnnnngacggcgtcggacaaggcggcggggcggtccaagtcgatcaccatcaccaacgacaagggccggctcagccaggaggagatcgaccggatggtgcgcgaggccgaggagttcgcggaggaggaccgccgcgtccgggagcgcgtcgacgcgcgcaaccgcctcgagaactacgtgtaccgcatgcggagcgccgtgcgggacggcggcatggccggcaagatcggcgacgacgacagggagaggatggagtccgccctgacggaggctctggagtggctggaggacaacgacggcggcgcacggacggcggagaaggaggactacgaggagaagctgaaggaggtggagcaggtgtgcggcccgatcatcaagcaggtctacaagaagagcggcgacgcgtcggccggcgccggagacgacgacgacgtgaatgagctgtagagcattttcgctgctccatgtatagtgtccgccacttcagaaaggaaagatgttgtgaagtgtaaacggatctcttaatctcttatcattagacactaatcttttttgtgttttaattaccattaatcttatctggaatgcatcaatggacaaattttgaggtatccctatctaagtctctaagctgttcatcagctagaggattaacgaaatgcaagcctcccactacgataactttgtgtttgctcctacacttacacgggcccacgtaatacaattagctaacttgctcgagctaacacgccagcaagttgcaacaatcttggatccgtaatactcgatccgacacacgagatgacgaggacgcactcacgcacaccgacatctacacatatgcatctgcggccgcgtggccaaggcaactcgcgtcgcgtgctcaaccgcacccgtcatggcgcgccaccacgaggacccggcggctcggcggcgggggcgcgcgctcgtcgtcggcctccgggccgaacacgaaccgcgcccactcccttgcccgcgcctccgcctccgcctcggcctcctcccgttcccgcgcgctcccagcccccgacgccgacgcgagcaccgccgcaacgagcaccacgacgagcaggggagccagcagggacaccacctgcgccgcgctctccgcgatcatcgtcgtcacagcgagcgagcgcgcgcagccgccacagaggagtcgcagcagcgtgtgttcggctgctcttcccgggcgtctcggcggcggcggcggccggcgccccactacatatacaggttcgccacgcgttagctttctcgtgcgcaaccaccgcgccatggatcgcgtgacgcagctagcgcgcgcctcgccgtctttcggcttgccgggtcatgaaaagtaaagccaatagcctgggaatggagaagagcagcgttctcatgcgtgtttgtgtccctcgtcgtcagctttacggttgcctgcgttggcgggaattaactctgctcccggtgatcctcggtctcatggggtaactgggtgatgcaattcattactggttgggagtttggtagtagtcgatacgcgcaatacacgagccgcacggactgaaaactgatgcagttcttgaattcgcaagaattgaaacagaaaccgagactgctttgttgctgtcgccgaaatgttgcattggattctgcaggtgactacagcggctgcggaagcacttcgtatagaaggagatttgccagattctttcgataattagtaggaaattactttgaaaataattgtcttttaaactatattaaacatttaaaaattgtctataaataatatctactttaaaaacataggataatatgtatagattaatcttgaaaattacttcagtataatcatatatatttattaatagccctacatatattcagagtcatttttaggataccgtgttctcgtctaaaacaattttttttttctaaatcgacattttttaaaaaaaatctggagagactacagagtatacatgcttcgttgactgagcccctttcagttgaagtatgcaaatcattcaggcacaacaagcatgaataaaacccactgctgaatttcataccgctatcatctatattcttgttttctgatctccaacataggatcatccaggggaaatttagtacacaataatcgccagctaattatcataaaaactacccctttccagctgagtgaatcttgttcttgtaccatcacgtacatgtcttgctgacttgtagaaccctatagctccaatagccaaccttcatttttccatttccgatgtcttcccgacgtcctactcaagagccggtgccacctcggttgggttaccttcaaacacatcagagcctgatgattctgactcttccgggaactcctgtgtttggaccgattccttgtaggaaggagtttctctgaagtctgtcgctccttcgttatacgttgccacagcgaacccacatgcaaccagctgcaaaagtatgcaaggtcaacagatacaaagtgagaaccaacatacaattgtaattttatcaggtcctcgagagataacatgaatataatcgatcaattgatggtaagaggatggaatggcatgcaaagttatctctgcagatcaggcggagacatgctgagaataatgttgaactgatgcgtgtcaatgaaaaagcaccaggtgctatcatcagtttaactcaattaagaaatgtcagatgatgtcttgctaaatagcatgtaaagaaataacttcatgtattcagcggctgatttatttccactattgaaataaatgtattcagcaaccgagcaacacacactttcttttccatccactagatgactagacactgcaatggaatcacttgtggcaagtaatcagtgtgctaagtgctaacaagcaatgcgatcaaatcctatatatatttttagaaggcgcaaaagctttgtgcgtcaatatattaaagatcaaatcttacatatgaatgaccgtaaatgaatttgaatgagtatgatgtctgatactctatattttagttggaacatcaagctcatacaatcactctaaaatttgaaacttgtaacttcagccccggacagtgccatggcatctcttctcatcacattgaagggcttgtccggaagttgtacttccattatcgaaggttttgtcgcatgcagatttcctttttgcacaattgcacattttgaagtttcagaatagaagcgtatcaattagctgaaatctaagtttcactaactgcaccaagctaaagattta

SEQ ID NO: 60931 - DNA, 1254 bp, Oryza sativa
tctccgggtccggcagctcgggcatcggcgtcgttgacacctcgaaccccagcggctccccttcccagtccaccccttccccggcggcggcgtcctcgtccatgtcgggcggcgcgggcgccgtgacgctaccgcctccccggcgcttattcttgccgcgctcctccaggcgccgctgcgtgcgggacgagacgccgcctctgcgcgcgcgcgccacgtgcagcgcggcccggctgcccaccagcgggaggtcgagccgggtcgccgcggcggcggaagcgggaggggcgcggcggcggacggccgcgccgccgaacggcgtgggcgaggtgaggagagacatgagccggcgccggcgatgtgacgtggaggctcgagaggctggagctgctgctgcgagcaactcctcttcctactggctgtcgacgcttctcaggatctgtgagggctgggagtgagagggagatgagataagattttcattttttctttttctccttttgttttctagttccgcttctctatttttcgtttttcatcgtttcagtcgtgtagcaggagcgctaaaagccatgaagaaactcgggtgttactgcattagatttcgccgaaaaaaaatcatgagctagttttgtctggtactccatttcaaaagagacaaaattatatgacattcggtgatttaggtacttgtataattaaagtaccctctctatttcatattataagtcatttttccttatttttaaaccattcttcttaaaacttctaccaggtttatagaatatatatatatatatatatatatatatatatatatatatatatatatatatacaccaccaaatcaattttattaaatctaacattgatcaaagctaaagaaacttgacttttaaaaaaaaagttaaaacgaattataatatgaaacggatgtagcaattttttttatcaaaataggtttgtttaatgcaataagtttgtaagatggcccaatagaaatatttttcaataaacaaatctaacatgttatttttatgtttttaaactactgtaaaattcattagtggttaaaaattttagagtttgactagacctaattcaaaacatcaaggatttatgattggagaggatagatttattaccataatataaatatagtgcttacgttgaagagttcattcttccttccttaaatataccagaaaaactatagaacggtctcccgttctaacggaatgactcaatataata

SEQ ID NO: 60932 - DNA, 10319 bp, Oryza sativa
tctctcccctcgacacgctccctcctttactactgttgatgcggcccgcgaggggggtgagggacgtattaaatcgttctaattatatttgtgcttatattttttaaatcatgattggaagaatgattataaaaaattgtgattctaagggctcctttaaattgcaataatttaaaaatgtaggaatagaaagtgataatatatgtaatccacaagaatatgtcgaacatgtattgtaggaattttagaggaagaatattatcaagattagacttgaaaggagagatgatgcattggacttccaaaaggaaaccaaaaccaagaggtttgggctcatgtttgaaattccccaaaatatagaggaaaaaaggattcatatgcaatttttctagcaaatcctccaaatggaagggctcagaaaaattcctataggaatttaatcctacgaattttctataaaaacaatgtgttccaaagaagccctagacatgataatattttagtttcatgccctgataatatatatttttgtctctggtatatttgacgtttatgataagatttagataaacttcttcaagaaaaaaaaaggcatcaatagtttctcaaataccacttaatttaaaaagagataatcgcaacacacataattttcacatagcaccatccaaccaccattcctctgtgcccaatcgctggcaaaacaggttatccatgatcgtactgaatcaccatacagttatacattacacatgactctgcgaagggagtcagggtgagcatccaccagacaaccacacccaaggctacataatagctatgaaaagaacaaaacaatggcatcaacgacagctttgtcagcagctgcaaatatgaactccagttcagtttcaccagtctaggctaatgctcctcgagaggaaaaggttgtcgatgtagtctatgatagggctagaggcatcgatgtatctcctcatctccttctgcacggagcaatctgcagtagcaacacagcaccatttaaaatcacaagaacgcagaaagatcttcacccaaaggagaaatactcatttaaattcctgacaaacaacattcagggatgtcgcatttttgcgtaccagtttcgttgagcctcacgatcagctgctccctgcttggaagagtgtacatcccagcaccaacagccttcctgaccgcccagctgtgaaacggcgcgcaaacctgcccgtaagctgtcgtagcagcatcatacagcgaacattccctgcagaaaagaaaaaaaatgaatgccagaaaggccgtaagctgtcgtccattagagcagaacagaactacctgtcaactgtgtcttatatgagttacggatgccaactggccaataattctaccaacttagccaccatcggctgaatctgaatgtatatgtagtactaacaattgtcgccggccagccttgcctcagaggaggacaaaaggcacaatgaacaagttgatgaatatttattggtacgagacaagtttcagactgtcctggaatcgcctgatatgcttcagatttcatttcgaattgaaaaaaaatatggtgtgcttgggtgagagggaggcgacgtactgggtggagaggaactgctcgaagagaaccttgatgaggccgaggccgaggcggaccctgcgcaggttgcgggagtggctgccctgcttcttgacgcagtcgttctcgacgtctttgtccaggatgtcgttcagcgtgccgtacgacttcgccgctccgatgaggtcgttcacctgcagcagcagcagcagcaggattggtcattcacaagggaaatcgccgttagtacatttcttgccgccacaagtacatttcttgccgccacaagaattcttcgtggccaatcagaaaaaagaaagaaagaaagacgcaaagtcgcaaacgcgttttcatggagcatcgttgagaagtttcggtttttttttcctttcttggtttgcttttctagcgcaagaaaataacggaaaaggaatattccaaatcgggggtaggaggtgaacgctgcaagatctaatggggaacaggggatcaaacaggaataaatcgaaatttaaccagagtcaaaagcgaaatttcttgatgcgttgtgatgaagagatccaagaaacaaaataaagaatgagaaagacaataaaattaccaagaacaacaaccacgaacgagatcgagagcggtgtgggggatggacgagggtttaccttggcgacgtactcgatctcggcgaacctgaaggccatgccgaggcagctgaagaggacggagacgagcgcgcacgtgtcgccgaagggcccgaggcggagctccccgccgtcggcctccatcctccgggccagctcctcgaacgcctccgccaccgccgtcagcggcgtctccatccccttccgcgccgccaccacggccgccgccgcgtcgccgcaaatcggctccgcccccgcccccgaccacggcgtctgcgacctgaacccgagcatcctcttcctcctctccttccctccctccctccccgcgcgcgccggccaaactagccaaggcaccaccaccaccaccgccccaccaaccgcgcgccaacggacggtgcggtgcgagggtgcccgaaggacgcgcgcgcgcgtggcgcaggtggtgggattgggacgaggctggcaatggcgtacgcggcgacgcctatgtataggaggaggagaagaggaagccgggagaaatggagaatctctttgcccgtgtgggagacgaggaggaatggaacaacagggggtgagctggtcggcagatcggacgcttcctttatataggcatcagcgtcaagattcgtgctgggatataggagtacgtgccacgagcacgagtgcacgaggtggagtcagccagcgaaatgggaacacacaaaagtcacggggtcggcaaattttacacaaaaatataaagtgcatgttcttacaaaagggaagcattgcctttcatatacttgtcactcgttactatccagtttttaacatttgggacatgttcactttaatgacattttcaaccttaccaagttttggtatagttgctaaaaagaatggctacatttaatttgctgccaaattttaataactatataagaaatcttgccaaaatttggcaagttaccaagtttttggcatcaaagtgaacaggccatttatcactcatcttctatgtagaagttttatagtactatatacttagattgagaaaaaaatatttcttaatgtgatatccaccgttctttttcgcattattcaaacaattttaaaaatttaaaattaacatgataaataaatattaaatatatcatttcataaatatataagttcagatttacaatatttgagttgtaataaaaagaacaaatttatatgtaaacagtatatacaattttttttatatttttaccttgcatgtttataaagtgatatattatatattaatctattttgtttctttttgcaatttttcatgactgtttgaacgttatgcaaaaaagaggggatatgcattaacaatataaattatagcataaataaaactttcaagaattttagttaatcattttaaatgtattaatggttaaaatcgaaacactaatgttcaatgtaggagagtatatgaccttaatttgttactactgctactcatatttttctacgagtaaagaaaaaactaagggaagcttccgaagatgtttgcattgagccggaatcgaccgttgaataaagcacggagaatcggagatgcatctgggagcttcttcctaaagtgaccttgactagtgtaaccgtgtgagccatgacctgtacccaaagtaatctaggagcatcaaagcgaatatacttctctgattgcgcaaaaacctttatatgtttatggacctgtctagatcctatttcaaatttttttactctatcacatcaaacgtttaaacacctatatgagatattaaacatagattaaaataataactaattgcatagtttactactaatttgtgagacgaatcttttaagcctaattgctccatgatttaataatgttgtgctacagtaaacatttgctaatgatggattaattaggcttaataaatttgtctcgcgatttactgacgaattctgtaattagtttttttattagtgtccgaacaccccatgcagatatgctaaaattttacatcccttatgttcgtgaatgtactcgttcccccaaaaatattaaggaaaaaacaaacaaacaagagtactcgttccagcatgaaagcaatgctaaacaggcagtagacagtactactaatcattatatgtgttacactaaaaatgtagttttatggaaccgtgccagaacttcagaacgggtccggctcctcctgcgcctcgttgtgaagcaccactaaaacagtctggatatatcattgtcgtgtacaaaaatgattacgagtcaagaaaacgacccgaaataatgaaaaacaacatgatataacaggtgaagattcaggcatttcttaatgctcgagagcttcgcaacgacctggatttctttttgctacctatcggtttcggaatgcttaaaaactcttgaacatttcgcatcttcgggcaggcgccgtcgtatgatttttccgacgcaaccgcaacttgcacgctggaatgctcacgcgcgaggcccagtgacaccgcgaaaagcacaaccgtctaaactgtcgatgagctggtagtgtacagctgcacatgctgcgcattattgcgaaaaattctgggcaactgttattgagcggtacgaattcaaatatcgatgaacaggttatttgttctattttttaagtttggtttagctatgaagcaaaattcagaccgcatatgctttttgtttagtggtgattcacatcggggtgctttagacccagtttgaagcaagcaaaataggagcatgaaacaaaatcaggagaagagaatgcctcatcagttccgttttgtaacccttttattagttccgagttgcaaaccggaccacgaatccgagaaccgggtgaaataactgggattatctttagtcccggttggcggttggtggactaaaatggtagcaccacgtgcatattggtggtttttttctttttttattgtttttttttgctgtttccatcgaatgaacatcacaaattcacatatcaagatttcttttcattgttttttcttaaattcacatatcaaattcacaaactcacaaatcgaacatcacatactcaaattcacagatcgaacatcatagttcaaataaaaaaaaattactgatcaaatagacactacaacagattcacagaacatatgaaaaaatgttcatctaaaaacatctaaagtcacaaattcacaggccacctgccgccgcccacccccctcgtgtgccgccgccgccgcggcccgcgagaggggaaggggaggagggtagggggcactgtcgctgccgacgcccgccgccaccaccgcggccctcgaggggggaaggggggagggggggagatggcaaggggggtcgctgccaccgctcgccgccgccgccgtggcccacgagaggggaaggagaggagggcaggggagccaccgccgctgccgacgcccgcgagagcggaggaaagggaggagtgaaggagataagggagagatagagtgtgggaggcgtgcgcagtggattccgagaagataagggtgagtgagaggtgagcggcaacggttttgtttttaaatttttggtatctggatacaccaatcgaaactaaagatttaaataatctttaatcccggttggtgttaccaaccgggactaaagtgaggatcttttgtcccggttggtgccaaccgggactaaaaatccttagccccttgacaggccgttgaaccggttggtatcatatagtccctttggagtttttttagtccggttaccataggaaccgagactaatttgatttttggccaacccagcaaatatggtttctccagcagtgaacggaactccaaatcggaaatatttgccgggagtgaattgtagtgcttccttcataaagaaaaccttaagcataagcatatttcatttttctgtttctatataaaatgagatggtcatttatgtggtttttgtgtattcgagacttagataagaaaatgtgtttaaaaaaatcatctttccatttcgtttaatagtgctattaaattattgatcgaaacttgtacagttatttattttattacttgttttttacatttatgtacaattttgttttcttcattactcccccgtctctaaatatttaacgccgttgacttttttaaacatgtttgaccgctcgtcttattaaaaaaatttataaaatatgtaaaactacatgtatatataaaaaaatatttaaccatgaatcaaatgataggaaaaaaataataattacttaaattttttaaataagacgaacaatcaaacatgtttaaaaaagttaactacttaggagacggagaaagtatatgcgagcgagatattttttttaatgaagaaatatgtaatttttagattgaggggaatatatacgtacatccacgcgttgccacgcgccccagcgccgtgccgtcgaggcatcgaaattcgaaccacgcaacacggcaagtcggcaaccgaaagtgtcaaactgtcatcaaccacatttacctccccggtcacgatgtatacagtatacgtataggtgctattcgacgctgtttgtttgaaattgaacgctagctagcgcttgcacgttcactgttgtgcacttgtgctcacctgtactccatactttttatataaaaaacaatttcttgtttgacattttttttagaaagttcatcgggggagattttctacctgaattttttttagattggaaaaaatacttgtgcgtcacaacgggtgaaaactattttaatcttattattgttatagttaaggtgaaatatattgtgataactcgtttggatatatatatatatatatatatatatatatatatatatatatatatatatatatatatatatatatatatatagaaaatcatgagatgtaattaggagtccgatcgtcttaacttagtatgcgagttttttaaaagagattatacgattccttctatatttttaaaagcgaacgaatttaaaaccgatttaaatacggatctgtatttctaaaaacgaacaaacttaaaaaagacttattcacggatggcgtaccaaagtactggcaaaaacatctttaaaggtacttgtttgacgtgttagaagtggtttttatagaatgaagagaatatgcacaaacaatttcatcacactcattattaacattgccttacaaacatgcaagccatataatattactatactataaaaacattttaattggggatactggtcaggatctgaatactttagttggagcattgggagtttgagactatcgtcaagtgtgtccaactcacctcgacaaaatgaggggaattctgctgggagactgggaggtgagccatgccaattgccacggttcttgatagtaagtgctctctctctatctctaatacaaaactatagtatgacacaaacttttatttagatttacagtattagttttgtttttatgagacggacggagcgtacatcttctatcaaatatatacttccgtcattttagccttttttttcaaaatgtatgtcgttttcatatttcaaaagtacgtattttagacatgaattttcctttatgaaaatattttcgaatgtaaaaacagcatacattttaatcgttactttgacaaagacaatcaatagcgtgtggtttttgtttcgactttcagagcagtcagccagtcacaactcagaaaaccgaaaaccagagtcctgataatgggactgcatgatgacgctttttgggccatcgacaccctctcgcctcgctgcctcctggtgggtttgaaatctagagttgctttctcagattgggccgagagttgtgcatatgacaatttggcctcaatagatctaagcaaccgtttaatagtctaaaaacattctgcatcttcttataaacggatacaaatggtttataagtcagacatactaatgcatataagtatgtactactactagaattatagcacgacagtactaccatgaaaataaaaagaaaaagagaagcacaaattcatgccttctcaaacacgctgccattaattaggaaaaaatattagcatacgaagaatttctcaatactccactgtatggtactctccaaaggttacttctgctacaggtttctttcatttaccgatttcctggcaaactcaaacagaaatctcgttcacaaatttccgcgcctctgattaattacacatgaatgaagtgctgcagattcctgcgacaaaacatttaaaacccttttgttccaaatgagtactatattttgatgacttattttcttcagagttcagacattccatgatcctttgaaatgcaagattgtaaaatcaaaaaaacataaatgcgcatggataaaatgtcatacgcccattgaattcggatatagaaataaaagacaagtgaaagttttcatatgaaatatcctattacatagaaattccaaatgaatctatattcctttgttccaaaggagcatattggaatcaaactcttcaaaaactcttcaaaaaacaatttaattttctctcgttacaaaggtgcacttttacgagtttctcttaacccaaatctaacagtgacaaagtgagcgtagctcgactagttagatccttgttgtggcactagcctatatggattaaaattctagacttgacagttgacgttagtacccgtatttatgactaattattctttcagtattaggcgaggtacctgtcaataacaatatgcccgtcatgtctgtgggtttataatgtgtttttttaaaaaaattaacagtggtttttatactactagtatgctggtacacggtcggtgcacttgtttagccgcgcataccacgtgacgcgatcggcgcacggttccctccccggtccgtaggccgcagccacccccacccctccaggtcaaagccgccggggcagccagccagagcccggccggtccaatggcgccttgccacgtgccccctccctccccaccggtccactgcgcccatcccacgcagcccccctcttctcctcgcgcggactccccggtttgaccgcgcatcgccacgcgtcggctcaccattggccggggccgcgccaaggagaggccaggcgagcttcccgaggagccgcacccgtcgctttctaattttttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgatctcttctctcccccctttttcttttttttttttgcttgtctcgctttttatttttttgctacctttacggttgctgggatttgggggagttggtggttggttggttggttggtggttgcgtgaatccgaggggtgaggagaaggaggtggagtgttcgttcttgatctttcccgcagttgcacttcgatttgagattgctcggtacggatctgcagctgttgtttttgtttggaatcgtgttagatctagggttggagggtatggctgtgtggggttcgaggtcagatctgatgcgaaagtttagggttcttggtgactgtgagatgtggctgtgtttagttcacgccgaagttgtaagtttggttgaaaattggaacgatgtgattgaaagtttgtgtgtgtatgacaggttgatgtgatgggaaaagttagaagtttggaaaaaaactttggaactaaacacacctcgttttattttcttgccatgtttactggagatcgtgttggggactgtagtgaagactcgagatctgcgtggaggaagcctgtatttgattattcacacaaaatatgcactcatagctgttcccctttcgagctaattcggttcatcgatctatggtttttttacctattagatacagtatgcctccgttgaactgcatatctattcatttcgctgctgttcatgttgttttaaac

SEQ ID NO: 60933 - DNA, 787 bp, Oryza sativa
atttcgaattcaactttttggatatgaaattcacgtggttcgtgataaccaccgtaccgaatgtgggatgaccgcagggccggacacatcctctaatgcaacgtgtaccatattttaggaaaccttctgctgcactacatgaaattagcattagcaaacagtgctacgatgttcatcgacacattgttcaatcacatgaaaattaaaattactcagcgagacagttaagtacagtcaacatacagatgcaacagtttgcttctatttggtctttatcccatcagtacctttagaaccaccatcatacgcagaaaggaagaacgaactctgattcttctgcagaaacctaccatgaattcccaattgatttagtgagcattttggcataaagtatgcctaactatcagggattgctacaatctggttagcacgtgattaaaattatggtattgaccggaaaattaattgtgtgggacagattttcaagcatgttttcaaaagtcggctaacttgagagatgctagtatatatagaagaaaaataacggctggaattgcatgaagaaatgaaggtgctaactgacttcacatatttgtgtatattgatgggaaatgaatatgctgctatagtgatgtacaacaataaaatcaagaaagatttgcttacttgagaatgtccagcaatttctgctgtagtttgttgagtgcatcttcttccatggtgacagacgcaagtagctccggcaatttcactgcaaagcatgcaagaagtgaaccctttcaaacat

SEQ ID NO: 60934 - DNA, 36241 bp, Oryza sativa
  unsure (1)..(36241): unsure at all n locations
nnnnnnnnnnnnnnnnnnnnnnnnnnnnnnnnnnnnnnnnnnnatgacttgcgaggacaagctccaccgcagcccgtgccaaggaagccgacgacgacttcacggcctcgccgacctcctccttcagcctctccagatccgccgtcatcccgtccagccgaagcgctgaagcatctaggctcccatagttaattttggtaattaatgacaagcgctaattgtggactaaccgttgctattgagataatattttaagttaggtccacgtcatgtgtgcacatggatgactatcgatggattaaaatttgatggcgcgaagcgaagaaaagaaaacggtaaaactagtgttttagttttaaaattgatcgaggtgaagggcgatcaaatttgctagtttatttgttagtttcgccgtactatcaaggggggtaatgacctagcaaagagatgattaaattgccacattaggtcattatgcatttagacttgtgctcacatttcacacacacacacacacacttcactgggttcggcctgaccaggggcggtcagaccggccacatagtggcggtctcaccggagtgccctggccggtctgactggccacaatacggcggtctgaccggaccataaggccgatctgaccggcggcatatgcgccgtcagaccggccccctggaggctgggatggtgctgctcggggtggccgatacagagccgacggagccgaagtcggtcagaccgagccgatggcggtctgaccgagccgaggccggtctgaccacccactcaacaccggtctgactggcaaggccgatggggccctctgacagcacttcaacggctagttttctagccgttgcagagtagcacggtctgaccggccacatatctccggccagaccggcaaagcacaatgattgggggatttcgcccccaacggctagttttggtgggtgggagtataaatactccctcaccagcagcaaggggtctctcttggcacccaattcaattgcatacatcccttgcacctctctcacacccacttgagctttgtgttcatccatctagtgtgttagagggttgattagccaagagtcaagtgcattgcttccatttgtagagttagtgtggtacttgattgatcatctccacgctgggtcattgcttgttactcttggaggttgctgcctcctagacggcttgtggaggagttgcccggtgacctctccgagaagattgtggaggaggcccggcgccggtttgtgagtggtttggagttcaccaccttcggagtaaaggaagaactaccctaatgatcgaggcttgggtagtcctcttcgtgggccggctcccgccttgcccaccccttgacgaagggggcgtgcggtggcttcgtggttgagcggtggagttgggctcgcctcaacagggagtaggaaaccgacgagtttccgaacctcggtgaaaaatctcttgtctccttgtctcattttattgtcgcatttacatttgtgcaatttacttttctagagacaaacttgagatcatatcaccctaggattgctaaacattgacataggagtgtgatttactttcttagagatataattgagccactatcaccctaggtttgcaaaacataacttagttgcttagttagagttgaccctcaccaagcctagcaacttaggttagttttgattaggtgtcatttagttttaaatcgcctattcacccccctctagtcgacatctcgatcctacaagcgcgagcgccggctgtgtgggcgggagcttcttgtcccggcgcacggagatgcccacccggcgtcccacgcactccagccgttcgatggcgtcggagagttggccaggcccgatgtcgttggtgaggaggggggccgcgatctccccggcttggtcctgcaccgggcgccccaggtcggcgagagtgccttgagccgcggtgagctggctgaccaactccgcgtcgccaggctgcccgtgcgatgccagttccttctcccaggcctccagctcggatgccctcgccgccatcgccgcgtgctcagcacagttgctttccagatggatggcctcacgcccagcaacggcctcctcacgcttggtgagctgctcgccaagctggcgcgccgccacctcgcggcggttcacctcggcctcgcgctcggcgagcgtggcatctcgttcccgccacgcctcctctcggagccgcagctcctctacacgacgggccactaaagcttcagcggcgagggtggtccaattgcgctcggctgtggcctcctcacggaggcgaagggaggattccgccttggccgccatcgcctcgtgggcggccaaggtagtctcgcgctggtccaacacgcgcgccctctcctcgagcgcccgagcccgctcctccagctcctgggcccgctgcgcatgttcccgactgcgcccctcctgtttgcgttggttgcggtcgagaacctcgatctgccggcgaattgtggcctcgaactcctgcgcggagcgcgtgcgctcgtccaaggccttgcgctcggcctcgagcgccaccgcccgggcccgtagcgaggcgtcgaccatcgatgcccgccgctcttgggccgcggccgcgtcgaggaccccgcgggtgtcctcaaccctcctcgccaggtcctcaccgtaggtttcatactgcaggcggatgtcgcctagcgcctcgtctaaggcgcttgagacgatgagcgccgcctgccgctcctcctccgtctcccgcatgaccgagtctagcgtctcctcgcgcgcctggatctctgctagttcggcttggcgcattttgcgccccacctccaacatgtcgtccacggcgcggcgtcccttgtcaacccgcgcgcggtccgtcacgagctgtgcgcattctgcctccagggccgcccgctcgtccgctagggattgaacttgggcgttgagcccctctcggatggtggaatcggcggcggcgagcacctgcaggagcggctccatgctcgcaggagtcggggaagaaaaggtcgcggtccgcccccgggacgacagagtacggctggacccccgcgagactgggggctgctctcggttccccttccacgtggtcggccccgagggtgccccaggtgcagaggggaatggttgctgccgtcgccccccacctcgggccctcgggattgcccccgagaagggcaccactgccgctgtcgcccacggcgggttgcgcctccccctccttcgtctcggtcatggtggactcggagccggacccggcgtgcggcccttgggccccgtcggggtgctgcgaaggctccgcagcaccggatcggccggatcccggccgctccggtcgctcggccttcgacccttgggaggggtcggatgccgagaccccttgggaaggaatcccgctacaagagaaccccggttgcgttaagaaagaaaagaagagaaaggaacaagaagctagaatggatgggaagcaccgggccgggctttggtgaccgtacctgcgaggggggcgtctgaaggtccacttcgggggctcgatgaagctcccccgacacggctccgtttgccctatcttccggagcagcttgttcttccgtcctgcctcgggcgcggcggaatgtttgtggcccgctggtggtcggtccactgttcgctcggcgccccctccgcgcggaggggagggcggccgagattcggacatcttccgcttctctttcgggtcgccggccgagtctccccggggccacggctcagaccgggcgccctggagccgccgcccccgccagagccgccggtccgactgctgcccgcggtcgtgccgctgctacctacgccgtcgccgccgctgccgccgccgacggtgccccggcgagaccgacccctgccagcaccgacgaccgacatcacagccaggatattgtcccggtcgtggtcgctgcagaggggaaggatcccgtccggaatcagcgtttgttcgacggtgtccaggcccagcacccgccgaaccaccgtcttcgcgtcctcctcgccccaatcccagcgcttgcccacgtgggtgcgcaatggggtcgttatgcccggtgtattcccacgcgccgcgggactgctcctagagaggcgcgatgcgacgacggaaatagtcgccgaacaccatcgccgccgtcaggccccggcttcgcaggcccctgaggcgatcccacaccgcatcgtactcctcgcccagttccgagaccgccaaccacccgacggatcattcgggagggccggcagggagccggagtcgcggacgatctggcagcgcggtgtagaaccaatccttattccaatcctcccacttcttgcggaggtggctctcgatgtattgccccgccacacccggccggggctggaagtagcatcctcccaccaccgcgcattgcagcagctgtgggacgaagaagaactggaacagccgcatcgtcggccgcaccccgacgaacatctcgaataggtgcgcaaagatggccagcgtcatcacagcattgggggcgagatgcaaggcatggatctcgtagaaatccaagacctcgtggaagaacctagagaatggcgggatcagccccaccatggcaaaggacaggaggtgcgcagaccgctctgggtaccgcggccgcgtctcccctgccctcacggcggcatcctctagcatgatcttgcggatgaggctaaggtgcctctccgccgtaatgcgcgatgccgggaggacggcatcgccagcgtcttgggccatggcagccggcgggaaacggcgaggagattggcgtacggaacacgatggagggagagaagcgctgggggctgaggagcgagtatgcgggtgtgcagtcggcgaaaggaaggagacgaactctccgcctcccttcccttttatctccgccttgctcgcgcccgcctcctcgtttctcgcccctgcggttgcctcctcggttctcgtgcctacttatcacgtccgccctactaaactcgcgcccggcgattaatgcgcctgtcagtggcgcactcggcgcgggatgtgcgatgatcacggtcgcggctagacgggcccaacgtcagtcccgtcgcgtgcctggcaggcgggggagtcgaggcagcgttgggtgacaattctgggtgtggtccggcaaaccccccgactttcactccctaagtatccccatgaacggcgcaattagtagcggtcaaatcgccgttatggccgatgagccaaccgggccagccggcggcggccgtttgaactccccgctaggcccacaaccacggtacgggaagtcatgaggcaccgcgccagaccgccctcaggggaccgctgtccgacgcggtgtcgggagctactgtcggtgatatgggcccgggggtatgtggagtatggggaagtcaccttcccatccagccacgcggccctatagcctggttttccccctacacctcgtacgatgcagaggcagccaggggggcctcggggtgccacgtcacacccctcgggccccgaggccctcgcccgaccgccacgtggcgggaggagcgagtggggcggagacccaggctgaaccgccatcaatgcgtagcgccccaaccgtccctcgctgaatttaatgcggcgaggggcgtgaccggattgtcaccggcctgtcgtcgggcacatccgattggacgggcggcagtgcccccacatcccgccttgtgctcggcggagtgggggcaggtatgccccgtcccatcaaggcatcgcctggaacgcctccacgtgagatggatcgccgaaagtctccgatcatttaaaggggaatgacaggggtgtcccccgtgtcaagcggggggcggcgctgggccccacttgacgacggacggctgcttagcttccgggcgaaggcacgaacggtcgtcggatcgaagcggagtgggtccccctcccgtggaggagtaggtagaggcggcgcatgtggtatccccttgaagtataaaaggagaatcttgcccaccgaaaaaagggacgactctcagttaacctaaaccccaggggaaaaaagagcgagagtgctccctggagtttaggaacctttgtaacactcaaccttaaatcccacgcacaggaatagggtgttacgctccatagcgccccgaatctgaataatctccgctctctcgcacggtctcgaagaactccaggcggatacacggtctcgttcagcgcgtcctttcctccggccgaactcacaaaaggggatgtctcgatcacccgctagagagggtcactcctcaacaacgtgcatttgtacgtgtatggaaaaaatgaaatcgtagcgttgggccgtatttctagcccaccacattcggtacgtgtattgacatgcataatttttttcatttttaatttttttttaatatctacaaacaatattgtaccggcgaaaatatttatagaactcccgagaaagtggcagggtaacgtgagggacggacaagatgaaaaaaaaactaggaaaatgtatctttggtaacgcgaaaattgcatttacccccttcagccttattagagggcggcaaaggacccaagtgcaaaatgcgcacaccttatcaccctagcggtcatttctgtaaatattttggatggtataatatttctgtaaatattaaaaaataaaaatttagaaatgaaaaaaattcttgacatgcattccgaaacagaaaaacgctaaagcatggcaacgcgttcgcgaggcgatgaggtcgcgaatgttcgcgaggcggatcgcggggccttacgcgccggagccgcatcgtcggttgggtcgcttggtacgcgtgataggtgggaccaggccagacgtgtccgacaaagcacgcatcgctggcacgctctcgtagtctgcggcccaccaccacctgtaccctgtacccgctgtcgctttggtacacaaatcgaaaaggaaaggcgagaggattaacggggtatatatattaattaattgggtatttacaaatttaccatcggtttttttcactactgtaagggaaattgctatacatacgacttgtgtccgaccaacactcagctgctgctcgaactgacccacacgtaaagaagcagacttatatggaatttatatggaatgcagtgattggctgatgaggcaggttggacaggagtcggacgatggggtcgtacgtatagcacgatgatgccactcgaatgatagctctagtggcagttttgtaataacaattgaaagtagtggtaaatttgcaattagcccttaattataagttgtttcttcttaggttgtgtttagttccttgtcaaaattttttatgcatatagacacacatttgaaatattaaacgtagactaatagcaaaataaattatagatttcgcctataaactgctagacgaatctattaagcctaattaatccgtcattagaaaatataaactgtagcaccacattgttaaatcatggcgctattaggcttaaaagatttgtctcacaatttacatgtaaactgtgcaattggttttttcttcacatttattgctccatacatgtatccaaatatttgatgtgacggaattttttagaagtccacatttaatacttcatatatatatatatatatatatatatatgtacaaatatttggattttttaaagtttcaagggatgtaaacacagccttactacttgagagggacgtgagtgcgtgacggcgccaatgcacgggtgactctatatgaaaaaaaagctgcacgacacgtatccagacgggccgatcgaacgggtcagtacgcgttcgcattaacaccgattaaggtggcgcattcattccccacgcctctaccacacggcctttataataatgatgatgatgaggaggagactctctcaccttctcacgcctcatcgctttgttctcatcccttgtcgattttctttgacctaaacccatcgtcttctccatacgcgacacagaacacgggcttccctccatgaactcctcctcctttgtcgaagaatatcttccagcaggtgagacattggatctgtccctgtcaatagctacgagcaagatttatcgatgcagcgttggtcaggggcctctccgtctatctgttcctatggaacctgccggccgggggctgcttccatgggagagaaaaaaaatagtctggcggtggttcgttccatagaagcacggcggaagtagtctggctgcggttcgtcccattgaaccggatctgacctggtacgttactgttctttttttcagttttcgagtatgttttttaatgttaccacaacggccggcgatatccatggatctctttctgctgtcaatagcaatgggtgagatcgatgccgcagttacccgccacaggccagatcgatctaccggcgtcagtgatatcgccgtcgaacagttcccatgttcgagatcgagatgaactaacggcggtcgggcgagatcgatctaccggcgtcagtgatatcaccggcggacggggttctgatctccaaggggagtaaagtctgtcctgtctggtggtgttttttacgatattgtatagaacaacggcgacggcaatgatatcgatgaaaataatttgtcgccctgtttctattcttcagatagatcgtcgccatgatctctccaaggagggggtaagttactatttcttgttcagtcagttttccttaactccgttttctagcatttaattacctatagcggcagtttgcgtgcagtggcttcctacactgtacgattttgactggagattgtgctctgcatcttcaatacagattgggtggttagcatcgtcgaatccaggataaaaattgagggtaggctggactgaaagtcttaagtctaagttaacaatgctaatatgaggcatacaccattatcaagtcaaatgttacacttacatgattaaatagaaaaacatagttataaaagaagtaacttgacttaccagtaagttgctaattttcttagatcttagcaaagagttaagtgagaagcctcctggatatataaatgagcaaagttagtaatgcataaatggtagaagtaaacaaatattaactaaagaaagcaacatactgctaagttgttgcattttgttcacgaggcaaggatactttacaggatactttacaggttttcagggcttggaatcgcttcatgattacattatcattgatacttttaaatatctctattacaaatctaccaacaaatcaaatattaggaaatgtaaatgataaatcccctcacttgccacgagttagtactcactaacaagtagtaacaaataacaatgaagtaaagaacagtatagcttactcactctgtcacttagagactcactggaagcagccaagtagcaagccgagcagtagcaggcaagcaactccggcggcctgctgtgctgctctgcgcttgctgccgcggggccaccagccgtgcgcccgcgccgccgcgcgcaggccccttccccttgcagcttgcgccttgtcggctttgccgcttgcgctgtgcggctgtgccgctgccgcaatcgctcgtcgcccgcagctgccacgcggccgcaatcgcacgccgccgcagcgccacgaaaaatccccacagggcaaaggttagcagccacacggtccaaactccaaaaccctaagccaagacaaaacagacacaatgggccaagtgggcttttgctaaagtgataaatgggccattttacgcgtaccggtttagctacatgacttccatggctcctgttcttcttcctcgccgccagagacggagttcttcgcctcttctcttcttcctgccttctccagctgtttccatggaagagatgctatatacttaaattttttttgcaaaaattggagggtaggctagagcctgatggagcctacatgctagaatcgccactggttagcattgctataatctttctcataatagcacatatactttcacattttattattaaaaaatattagaaacagcaatatgattttaacagcattaggatactgcataacttgaccaatatgattttatatgtctgatatctgattgttaatgtaagtcctatgtccataaagcaaatatcatggatataaaccatggtaggtggaagatcaccattaaatactacataaggtcattatcttcgctatcattaaaaatttaaattattagtggcttctctttgctatctgtagtgatatccttatacctactaaagatgatatgtcatatcttatgttcatatacgggttataaaaagtgttcataacatagtggaacagttataaaatattttatatcgtattttataagttatgaacactttttcattgtcacgttagtatagggttggacaatccattctcatctgttgtagttataattttatacagcttagacaatctagcctttatacaacttattaacacgtgaattcaaagaattttcaattaaaatgaaaacatcgatgtattattaccctctagaattaatgtatcactcctagtaaatcctccaattaatttaagtaagaatatactctactctcaatattatttacctagatttaaaaaagttgtcctcattcatgaactattttccttaaatttaaaatatttttaaattataatacttacttttaatctaattttaaaatacttttaagagtaaattttactttggaccatctttattgaccgaaatttcacattgggctagggctaggctcatgttttcacttaacaccacgtatagttaccgttgtttgcactttggacctggttttatagttaccattacatgagttgttgtctaggtgcttagcattttacaagaaacaatgatatggaaatctttgccatgcaaatatgcttagcacaagaacaatgattgtaaatgttataggatatcctatcatcagattaatgggacttcattactactacatatgaacattcacaacccttatactatagagacaaaattggagaaatattgagtttaagaactatttttctacaaaagatattacatgttttataatacccaactgtagtgttagtacaaattattgaattctaagttttctaacacaaaaaagaaatgagatcagatctacagtcattatattatgtgtaatttgtgaaacttggtccaaagtgcaaatgatggtaactatatatgttaagtgaaaatataagtcttaactctagtccaatgtgaaaatttggtaaataaaggttgaccaaagtgaaatttactctatttttaaattatatactcctacataaacttatttctccactctatttattatagtgaattacgctttgggctacattttattacacaagttttactctggaccacgcttaaacctaccttctcactttgaaccaggtaagtttgtcattgttgcggtttggaccaccccgaatgatttttttcactacacaccaatgaccttaaacacattgcgatctcctccatgtatgtctacatggcgagaaaagttattcagggtagttcaaattgaaaagataggtaaaggtggtccaaagtgaaacttgggtaataaaaggtggcccaaagtgcaatttattctatttattttctagttccaaatttagatatctctaaattgtatttctatgtgcactcttttccttaatagtatttatttttaatctaattttcacatataaatttctttttctacgttgattcttgtctctattattatttttcagtttttaatccaaaatttggatttttccaaaattgtatttctacacgtactattatgtcaatatttactattatttgatccactgcgatgctattattttattatgatatattcttatgtagactcattagtcataatattatttaattttaatccaaatctaaaatatttcaaaattatacttctccatggaatcgcttatctatatatttattttttaattcaaattttagatatgtcaaaattgtattttgacctagactctcttaatattatttttatccaaattttaaatatttctgcatttccacacggactctactcccaatattaattattttttacgatattgtatagaataacggtgatggcaatgatatcgatgaaaataagttgtcgccatgcatccattcttcagatagatcgtcgccatgacctctccaatgaagggggtaagttgctatttcttgttcagtcagttttccttatttgtgttttctaacgtttagctatagtggcagtttgcgtgcaggggcttgggacatctttatgtaggattttggctgggtattgcgctctgcatcatccatgcatcgccgtcctaggtctagaacttataagaaagctgagatgaaatcggctatccctacatgagagggaagtccggttcggggtgtctacaattttccctccacgtcgaaagaacagaacatttggtaattttttatttgttttactcaatttgtcaagttatagtacatagtacttttgagaaacaatacatgtattttcatagatttcagtccattgtggagtcgttccttctaaggatatgaaggtagaatgtttcaaggtttattcacggtctattgcctgtttaatgtgcttgtatgctaatattgtgaatgccgttttttaaccctatttgaattttcttagtacatacaatcctttcttttatggctctaaattttcgaagtacatacaatgtttttttaccttttttaaatctgaattttgaaatgccattttatcaagaacagatatgttattctgacctcacattttttttgtttttagcgccttattttctatcaagaaattgcccaagtgaagattgtgagacctgattttcttagtatgtgatttggagagaaagacttgaaattcactttattgcatgaaaattttataggaaatgtctaaacttggtcttaatcaatacctcattgatggtggtgagcagcgaacatctgccaccacccaccaccacttaaccattaggacctgacacccaagaagaaaaggttgtatcctacaacaacaacaacaacaaaactgggcttgccttttttacttgttagatgagatgttcattatcgtagaagcttgttattggatctaaaaaagaatcattggtattttttttgtttatgttggctaaatttaaatggctgaatcattattattagaagaaagatatacaataattttgaactctgattttataagaattatctgtatgcatatttttttacttgtctccttggctattatgaaaatagatttaatattagaattaccctaaaattaagtactacataggcacagaactctcggtggcacacattggactaaatgagagttatgtgctgttttgccttttaccagtgctaagtgctatcaggctgcctgtgattctttgttatgtgctgtgattctttatactatgtatgcatatatgcacttgttctcctggtgatgctaaccgaataggactaagtataattcaaaccaagtcctattcggcccaaacggaaacggacgggagtttttacaatttttgtggaatcggacagattcgtttttttcgcccaaattttttttaccgcgtcgatcgaatcggatttgatttgtttttttaccgggtcgcatttttttaatcgcgtcacatataattccttttttttttcaatgggacagattcgttttttttcaccttttttttaccgcgtcaacggagttggtttcgtttttctttctcgcgattttttccagctttttttttggatcggacagattcattttttttctcccgttttttttttctacccgatatttttttcgcctagtgtttttgtcctttaacttataagtactacatatgaggaaccacatgttatttgatatgggaattggtggcagatttactgctccgttattttcttcttttaaagtggttgtatattttaaagttataatcgctacaaatggtgtgctctctattctattaggatttagtctaattttttttacctttgaatctttgtatctatatattagtcaccctgttacttggttaaacactttacataatacaacaaatgtgatttgggctttcttgtggaacaatcatgttgttttagtctgtatagaaaacatattcaaattatgttgttagattaaagggttttttttttccattctctcaccttctccctctcttctctccctcccaccctccaaatcctattcagatcttcctgggaactccacctctctctccctctctccctctccccctctcctctccctcacgccctccaaatctcttcctgggaactccacctctctctccctctcccactcttccccctcttctctccctcttttctctcttctctccctcttacaccgtccaaatccgaacagcagcaggaggaggaggtgctgcagtgagtggctggaggagatgctgcagtgagcggctggaggagatgctgcagtgaggaggaggaggagatgctgcagtgaggaggatgaggcggctgcagtgaaagaaaatacaccaggggacagatccaatcacttgaagtgaaagagaatacaccaggggatagatccaagcacttgaagtaagtactgatgaaatgtgtttgccattttttttggaaatgtgtttgtccaacaactaaatgttgaaaaatgtgcagattggtgtaaaatgttgaaaaaagatccaaataaagagtgagtgctttattattttttatttaaatattgtttaaggtgcataatcattccctaatgaatatcttttttttttctctaggacaattctgtcagtttcagttgctggtgcccaaaatggcagggaagctcaatggactgttgataggactgtgtacacttatgctaacttctatgatgattttaaagccaaggtttttgactttggtgataggctcaagatttcgtttatagaattagttcagcgtcaagaaaatgatctattgcttggatcttttgagaaagagttaagattaaaagtacttctagcggatgaacatgatgaggtatccataaacatttgcttaatcccacccatgttcggttgttaagctaaacgattatctaaatttgttaggagttaaatgactatctaaatttgttaggagctagcatggttgttaagttaaatggctctatctaaatttgttaggagctccaaagtgagaggtttgtcaagatgcaggggaagcatcaacctgttggtttaaaaaatgagaaaaataagcaagtattgttccttttttttccatcttttttgtcagtgtttgtttaagttccatgtccttaatgttttgtgtatagctgttttggtaatgtagtgctccaatgtttggcaatcacggaaccatttgtttcaagactctttggacaacaatttggagaagaatgtatgatttaatcacaatttttttagtaaaaaaaatatttgtttaagtactaaacgtgtagtgttttaggcctaggaaactgtcacgcttgcgacctgcgccgtgatctgaagaggataagaaaaactggtgcaccagccttctttcccactatctttaagcatattcgatcattaggtggtgattttgaggatggcttgggacgtcatcgtgactcttctgagttcttattgtaataacttaactcaacttttgttgttttagtttgcatttcagttatttttgtgtgttatagattatttttcttttccaggttattactacaaaagttatttgatggtacacatggatgtttaacagatatgtttggtggaaaattccgtcgcagtaaagtatgtttgttgttttagcaattttgacatgtgtttcactgattttacatatagcaatgttttaatgtatgtgcaggtttgttccaaatgtggaatgctttctaattctgaagaagattttactttgctaatgtttaatatacctcatcgtgaacaagttgttgctgcaacattagaagattgtcttgatcacattgtggaagaaaacgtacatgattcattatcccgttgtgaaaggtaaaatttccgatttgtgaatcttaatcgtgtatcatcatgtttatagtaagttcaagttgtttatagtaagttctttgtttataaaatattttcttttgtgtagctgtatgaatgaccagaagtcaaccagtaagtgtacatttcatgaaactagagatgttgttattgtgttgcaaagatttgaaccacttacacttggggtaagtaaatactgttatttgttgttatataatcacttaattgaccatctaacacctaataaatatgtctttaagggttatcgaaagattggagaactaattaactttcctacggagctggacatttcaccatatatgagtggtgttgtaactgacaagcatatatatgaactgtttggaattatagttcatgaaggcggtgttatagggggtcactatagaagttacgtgaaaacaaactgttggtatgaagtcagtgatagagatgtaagtttcataaccattttgtttaatgtgaatgacaatattgtaaactgattcacatgtcaaaatgacattgcttgtatttgcaggtgaaaagagtaaatgaaaattttgtcctaggggcacaagcatatatcctgttctacaacaggtatcgtagttcattttgacaatatgtgtgcctttatgtgagtttgaaaatctgaacttcattttcaggaaagaagaggccaaatcattcgatgaggttttagcttttgctgctacagctatgtcttcatctgatgccgtgcctacatcaacttcaaaagattacactgaaagaacattatcacctgaagtatcgtctgctgctctgtcatgttggtatgtttaagagctctttatttcgatgcaccttcctatttttaatgaataatgttgactttttaaatgaatgacgttgttaacttttctatactgtttgtcttgttgaaaaaaagttatgtgaatgtcaattactttcttgtgacttgttttatcttcaaataaactattatcttaacttatacttttacatatgtgtgcactaagtttttgaataagatgaaaggtcaaacatcatgcaaaaactcaacggagccataaaaagaaatgtagtagtatactgtgaataggagtatcatgaaatatctaatttattgttgtttctaggattgatgctgcacgggtccttgagcccaagagttactcagaccaggatatcctagaaaaatatatcatttgtatggaccgtgacagttcagatgtatctgagaggataaggaatgccatgcggaattgtaatgagtccagacaggagtatcattttaatctccctacaacggatggacctttttatgatgacaacttggggcagtactgtcttcttcggggagctagatttcgaaccattagtacaagcagtaatgtagaagcgaagagagatagggctgttagaatgcacttccttctttctgaaatcttaaaactcctacagctgaaaaaagtgattgacgttggagctattggctatctggagaaatttaagtttgggaattattccaggagtgctcttttacggcgaattaatgatgcatgtatgctcttggggactaacagattatcccttaatatctcagttatgtcaagaggatctatcattgggccagtgctgttcaaagttggagaagatgtgatgattgatgcaagcttaagggctgtacagattccacacgacattcacttggtggaccatattaagttgaaaaaaccagtcagctttgttcttgttgttgaaaaactatcaatatttaacatgcttgtcaatcttaactttcatgtcacacacaattgcataatcatcactggatgtggaaaacctgatatggcaacaagaggtgcagtttttaaacttaattattgcttgccagtcaaagtttatatccttgctgatcttgacttggatgggctccagatatacttataaacttggcagcaaagtaagggcttttgagaactttgtgttgcatctagagatcttatatggctgggtgctagaccagaagattctctacttttacaagaacccaatgaatttaccagagtgcagcagaaatctcttactgatcttcgtgattctcttcccaatatttcggacagagatcgtctaaacactgtgttggactggaactttacattgaatctgcatgacattcttgattatgagaatattgtagagtatttgactaatcgaatggcagagtttgaagatccttgatggagaaagatctgacctcagctgtttgcccataagtgaagctgaagatgggttgccaaacgtgtgtcgccatttatgccacttgtatattttgcacgattgcatcttgtttactgcaataggcgatactgtgccagtgtgccaccatctggatgatatcccctactgactgtagttctcattctgggtaattctaattctggtttttaagagtatgctgtaacgtaggagcaatacctctttgctgataagagtttaacagatcaggcaatttctgattaacttaaagactacgtgttttgattaaccgtcgcttaaaaagtgtgttagtatgacatttacttttgtttgtctttgaactgtgctgaatcctgggaagtccgatgggtgccacagctgtgatatggtcaaagatgagatctccgggcggtggtttcccggattgtagatttgtagcacagggagtattgctgattgtaatgcaaacttttggtcatatttacgtactttgcttggtgagattgacattacttacatggtgtgtttatttcacgctaaaattgaaagtttggttgaaattggaacgatgtgatggaaaagttaaaagtttgtgtgtgtaggaaaattttaatgtgatggaaaaattggaagtttgaagaaaaagtttagagctaaatttggccgtactttgctaccgtacttgcagtagcatgtgttattcatctctcggtttctgggccttcgggtgtatttttgctcgacgcgggagggtttaggatgtccttggcttattgtttctctttggttctttatggcccggtcgtattaaggcactatataaatcataaatggtggcgcagcgaagcctgcactcagcattccggagaagctggcggcgaaatctttggtagaatgccattgccaatccctttgtctcttgctctgtccttgttgattggtgtcctgaaatgatctttatctcttgctctgtcccttgttgattggtgtcctgaaacgatttttcagaacatttgcgtaacattcgttactaggataggcaaggtgggggatgttttgacgattgtagactgaattcaccacatctaaggatacagcttccttcgtcattctattgatttccttcattcttaaggctccaattcaccacatctaaggaattttgcgtaaccatctttctcacgcatcaaaattcttcattttagctgtgtcagcgatggtcgcattatccgtgagaaagatgggtcctgcaagatttagaaaagtagccacctccatagttagttgcatacctaccaattcagcctgtaaaggagattgaaccactttgctagtggctttgataaaaatagcattatgagtaacaggcatttgaaaaaaatttcctactctagttgatccattgtcccaagccgcatcaatatagcacttgctcccattagtagtgacttctcttctcctattgagtccttccatccgttgttcctcctgcaaagagagctgagaggagaatttcagataagtgttcagcattgccacaccctgatattagtttcagggattaataaattatttctagaatttatattaaatattcattaatttacaagttaagttaatgtgggaaatacatttttctaaataaaaaaggctggatttaatacttattaaattatacatgattaattatattctatgaaattttctcagatttttcagagcttggttattaattttaataatacaaagaatatttcagcaattatttaaacaaaattaatcattaactgatctaaatattttttagaaaaataatttgagtgtccaagtagtttcaggattttttttagaattacttgagcattggaagtattttttaaaatgcaaagatcatttcagtgattaaattaaatgaaaaagtaattaaaaaccctcttgtaaatctgcgccaattctggataagtctgatgtacttccctctctttatcccgcacgctgcctcctatccggcgaagttcacttcgccttcctctccagctggcccatctttcctgaagtctgtatcacctctctccgccctgcttccttcgtaactgtcaggtggggcccaccatgtcatcccctaccgagccgcagctgtcgtgcgttgcagcctgcagccctgcagcgtcgcctccccttccaaagccggctgctaacattgctccccttccaatgcggaaatggaatcctcttgatatcctcttctttttccccaacaagtcaaaaaaaggaaatcccatttctatattccggtgaactcggataaaccctaattttccatagccaaatcctatctttcccgagccggtatcttcctcctccgcggatgccgaggtctactcttccgtttcccctttttcactaagccgttgtgtgcgcctccccgcgtgtctttctctccgctgccggccgctgctccagctgctgctagccgctgcctcggttgtcgtcggtcagcgccgtttcctcctacggcatcgcaacgaggacacgaagccctatctccacttccccgaagccgaagaccaccagaaggacatcaccgacgtcaagtcgatctacttcggctcagccgctgctagtcatcgatcgcatctgttagatatatctcgtgttacagtggtttccttatgccgacctatccatatctctctcggttctgtttttataaaccggttgagtatataagaaaggtctcgtgtctatatatactccgcaccgatatcaatctaatcattgcgttgagtctattccactctcatggtatcaaattgcttcgttctaccgcttccgcactaaccctaaccctactgacgctgccatgacgacgtcttcctcccccttctcgccggagtcctttgtcaacgctgttgccgcgtccgtcgccgacgccgtccgcgcggcctaccaagccccgcccggctcgatggtcaatgacacccttaccaagacagtcgccgactccgccgttgacagggcttccaccgctgctcgtgctgccctcaactagcatctgccggcgctctccacggtgcccgccgccacctcacctccacctgccggggatgccgctcctgcgtctgtcgcaccgaccccgccggcgctctcacccgagctggcggcgctcttcgcccggctcgcccacaacattcccggcgtaccacaaggcgccgcaccggctgcgtcctccaacgacgcgccgccggctcctgtcctcgacgacaacgcgcgttccgcgctccgctcccaagccgtcgttgttctgaacgtgaaggcgctggtgctcgtgaccctggacatcgccgccggcaactacgctcgatggcgtggtctctttctcgtggttctcggcaaatatgccttgacggaccacgttctctgcgatgctcctcgccccgacctagccgagtgggtgcagatggattgcgtcgtcctcagatagctgtacgactccatctcccaagaccttcaggaagtcttgtcgccgaccgccaccgaccgccaccaactgccacaccacgataaggtttcacccccaccccctaccccggaggtgggcagtcccctcgtgtgctacggtgaatccggcagctggacaaccggatgttggtatttcttagcgacactactggaaatataattcccagcaatagcactagaaataatcctagtatattatggtcacatatgtaatccgcaagtatttcacccggaagtattccaaggtatcgtatttattttatcccaagggaagatatgataagagcgtactatgctaatagtttatatattacttatatacgtcaaagtctatgcaatggttaattcagttcaaaggtagggtgacacacagaagacagaactaagaactactctcactaaaatatagtctaagctaagtggagaaagaataagaaaagtatcattactgtacttctagtatacatacatctcactaaaatatagtctaagctaagtggagaaagaataagaaaagtatcattactgtacttctagtatacatacatctttagtatacagtcatgaaactaataccccgtacccagtgtcctggtgtttcgagaagctacccctgactgccaagttccttacgacaacccgtcatgaccgtataaccggggctaaatacggaggagtaccctcctcagggaattaacttaagactatatacacgcgcggggaatacccgtactgagctgtcaccatcagcggcccacctctcatccgcagcatataaccccaattaatggtatctaataatctaagcaccgcgcttacattactaaatactactctacgtccttgcaaccgacatagagcaaccgaataattggacactaaacccaaaccaatacacctatctggaaagctagatacatgactattgattcaagtataaagtaaagtcgacactcaaataatatgaatggaataaaataccgaacttgtataaagaagaatattctattaattcaataagtcttacaaaagaagaaatgaatgctattaaagccataccggaatctcctgaagactcgaggactatgaagactattctatttcctactccactagcactagaactactaaacaacacttgagagagctcttgatcttcttcttgaggtgtgtgttggagggagtgaggggagctccttaaataggcaacttatgacggttggaaaggtcggaaacaccctccaactgtcatagggagtgaatctccaccgtccataagaaaccctgaatccatcggagcttagaggggagctgggccattctggcctattttcggcaggtggcccccttagctcctctcttatctagaacagtgaattttgggcctattggatcatgtcatctctgagttctcagcccatctatcgataagtctagttctcgacagtgtctgattgatcgttcgtctattgtctgtcgattctcctccgtttataaatacttatcctgcatatatgtaagtagcacagcacatagtggaagtagatattttatttgaaaattatacattgcaagcatagctagtcttcattaattgggtaatattgacggtcgaaactggtcgataacgaccgtcaacacctgacactccggccgacccaactccatcacgcccacccctcgccaccggtgcctaggaaagggtcgagctatactgcaagtcaagtagttacccattcccgcctgtggtaagcactgttagtcttccagagtttcccgtgaaccggtccttaattgccatggtgcgactagcaaaaccatgtacccacagcccaccattcagttgcattttagttggataattacgaccaatgaaacatggccggatgtctcgagcatgcagctcgtctagatactaagaggtctaataatgtaattaacacatcaaccgagctagtggtaattaagcatggctaagcacatagttctagctaggttacataagtaacacgagctagtcgaattatcacccaagtttaataaaggacggatgtcaagtaaacatggcacaagcgagcagataggtaaagccataatcctatgtaattagcaaaacatgcatatttatttgcaaatggtaaaacaattataaattggaatcaacatgctcaagggggaatatgtgactcgccttgcttcttcgaaagaatctcccgaacattgatccttgcgaacgcgatcttccgaaacagcgaattctacgcgctagtatgcaaaatgaggaaaaaactataataaaaaccaagtaaaaagtacattaaaagtaaacaaacatgtagagctcaattttagatgaattttgcaagttgaacggctcaatttggagttcgtatgaattagatatgaattttagaagttttgagccatttaattgaatttctataattaatattgatttattgcgcaattaatactacttatggcgtcagccgagggggaagaggtggcataggcaagtgggccccacctatcggtgattcacgggaggagggctcacggtggaccgagtccacgcgcgcacgggcgggggcacacgtggcaccgacggggcgccgacatggcagccacgtgtgtggacacatgggcggcccggatggaggccggggccgatttgacggccaaaatcggccacgcggtaggggcggcggcgcgtacgcgatgcgcggcggtccaagtggcaacctggtcagacggccaccggcggcggggagatagagggagagggaggggagtgctcaccgtgctcgcgcaacggcgagaaggggacgggaaggcggcggcggtagctcctcggggtggcagcggcgacggtggtccggcggcgttccgtgtgcgggaaccggcggatggctgctgcgaggacatgggaaaagcagtggtagggttaggaggatgggagaaggcgtgagacgatgggaaaaactgaccgaaggcgaatgaattaggagagctcaccggcgcgcaaggggagtggaactctggcgagttcccgatggcttggggcagcggccaaggtctggtggggcgtggcggcgctgtgggtggtggcggcttggccgggcgaggcgacactcgccggcgggaggtggcggtggctcgggttggtggtgggatcggtgctatgggatggtttggggagaaggagtggatgctggtgtgctacactgtgcggcgaagccgacggtggcggtggcgcggcttggcggcggcgggggcggcggtggcgtgcggtcggagatggacgacgagtagtggggagagagagagagagagagagagagagcggcgcggggagagcaaaactgggcgcggagagctcgggcggaaggggaaaaatggagagggaggtgcggtgatgttttttatagccttggggagggagaatcggggccgacgagggcggcaaccggcggtgaagttggtggcgatgtggaggtggagtggcagttaaccggcgctcccacttggcagacttgagggagagagagccgagcgggccgagggaggggaggccggcttgggatggagggggcgggaggaatttgggcgagcccgaaagggaggaaggggaagttttattcattttatttttaatataattgattaaatgaactttgtgctatttcaattatttcttgagctccaaaaattcacggaaaaatccggagagtatattagggcacagagaatattacaaaatatttccggacaattattttgaaaggaaaattttaatttcctcaatatttcacttgattaaattacttcaacttttatttaatttatagaaaatgcattatttaatgatttttaatcccgaatgaaaatcggggcgttacactttccaacaaggcgacctctctgtctccaagtactgttggtgcatcaagacaatggcggacaatctcgccgacctcggcgaaccacaatctgacgcaccctcgtcctaacgctcatcaatggtgacatgcaatctcttctccctgtgcagcaaccttttccaagttttcttcaagccaggtcgtaggtgctactcgaggagatcaccaagggaccgcgtccggcaaccgactcagccaccaccttcgtcgctaccacgaccagcaccaatggcgccactggtggtcgtggcaccaccggcaccacgggcaactcactgggcggaaacggcagcggcatggcggtggcggctccaacaatggtgctggcgctaaccctaatggcggctcgggtgctgcctctaggggacaaccggccggctctcagccggcccaatctggcttggtcgcacggttgacctggccctctccctacaatctgtgggccgacaccattcagatgtggccgggccaagcccacggaccaggcgccttgggacggcctcccttcacaagcgcggcagtggccggccagcccacctaccacacagcgtcgatgcaggccagccttcctcagcatatgggctcagccggttttccaaaccaggccggcctcgctccactccagcttcccgggccgactacatacagcacggccggctctgtccctgcctcgccgcacacatgggccggcccttcacagtgggatccacaggccctcgccagctccttcaacacctctacactgacgccgccaaactccaacgagtgttatatggattcaggtgcatcttcccacatgacctctaatactggtatccttagtgcgtctcatcctctcccccacaactttccctcacatattgttgttggaaatggttcactaattcctatcacttctaccggcactgcttactaaccttgtccgctctgtttctttgttcctttgtgcttaacgatgttttagtgtgtccttccattattaaatacctaattctgcacggtggtttgctcgtgataattggtgttctatttgtgttgacccttttggcctctctgtgaaggattatcaaaccaggatcgagatagccaggtgcaatagttctggtgatttgtcccccctctcggcggactccttacctacgacaacctccggtcaagcctttgtcgcctctacaaccaacaccgacctgcggcatcgccggcttggacatcttggtcacgaagcgctcactcgcttggctcaggctttcgtcatacctcctccgaagggcactacctcgttgtgtcatgcttgtgttaacgaccaaatttagtaatatcagcatcggagatgaagatgggatcgaagcagaatcaaagatgagggttgttgcggaaacagagtaagagtcggctggagtctggatcggctacgactgggatcggctaagtctgagttagactggttaagtgatacagccgattccgacaatatgacccgtttacgacatcgggttcgagttgatgtgcttcaagatgattgccacgcatggatagagtcctagggaggcaattgtatctattaattaggatattttatgtaaattcattagagataaatgtggtaaaagtctgccgcaaagacttatgatatcttagaatttgttagagataagagtcgtgtccaatatggacatatcttgtaattctcgggtataaatagaccccgagccctatgtaatgattaacacacacgttcaatacaatttcggcgcatcgccacccttttttgctttagttttatttcgacgagttcttgctttcgggttgagctgcatcggtttcaatcttcaacaagaggtaatacttgttatggcgatttacgttctcaagattagtgcttccatcttcatgatactctagtcttgtttatgtaattcgtcgagttattatatatcttgcataatctttgacaatatcgtcatctaacctgcaatcggctaacatctgctaccaaaaggcaggcgattaggataaataatgacatcggcttagattatataagatatccaccactctatgaaacatccagcggttgattgtctagatattgttcttcttttcatacttaatgttgtatcagttgagtttgatctattaagtcgtgcttagaatttcaatctctagcctacctactagttgtcgattagggtagtatcggggtttcagccgatcttatctgatttaactatttttatcctatatgcttgattgatatgttaaatctgccctttatgttaagatctcgttgcgtttaggtatattaagcttctgtttgatgtactttatttgctttaatatcttaatatagagtagtatcggagtattagccaatacacgctagatctatctgatcggctatgctatgagcatatatagtcttactgttaatatatattccggtctaagtgatttatactgtctcggcatggtgaccgatctaccccaatcacttgatctaagtatatatcgacataaagattatatattgttaatatctacagccgatcgagtagatttagttcttctttacttattcgtgattgccgatcgatttacatatgacatcggctcaaagataaatgatatgtcatcagcacctagccgatcggctatcatttatggatttaaccacggtttctttgcctttgtttcttgttgattgcaggatcaaatcaactggcacgctcatacatccgaaggcgagttttggacctgcactggagttaagcagatctcccagtcctcgtgttttctgtcaacacgcttttggcacgcccggtgggaccgattagaagtcagaaagcagcttccctcatggctgagaaaccaccgttgtcaccgtcgtcggccagccctagtaatgttaaagaaaagatccagaagctcggtttgactgacgtccatgaaggaaacattgcgcctattgatccagaaaagctcactcctgaacagaagaaagacttcgatgcaatgatgcaacaagcacgagatcaatttttaaattcattcatgcagactcgcaagggcacatttgttcagaggtacaaggtgaaagtagttcctgatgatcctgggaccggttcttctaaggagggagaaaagaaacaagttccagatgactcggcccagccgagtgacaaaggtgttacagatgggtcgacccatgagaaccagggtgaccactttcatggagtacatggagttcaaggtgatggcactcagggaccgcaagcgggaaattttaatcagaacgacaatgcattccaagattttttcaataactttcaagatcgggttgactatgccgtgtataatgctttgattaatcaatctggagtattgactaataccttatcaaatatgatgaaatcggtagccgatggttcaatagctgaacatcaggctgcaggcccaatttatttgcaagggggtacttttccaaattatcggcctttgatcaccgatgttcatccacttactcagggagttcctcctgttgcatcatcagctcagccgacggcaccagcattggctccagcacctgctgcgctgtcgtcggctccaggccaattagtcaatcctcaattattggtaagagagcaatcacagcatcctggaccgaatgtgactcagctaacacaagaccaggttgcatctatgtttctacctcctcagaatgctgttaattcagctcagcggcagccgattcagcaaacaccgcccaggcaacaggttgtgcagcctattcaacaaacatccccaatccagcaggtcgtacaaccagttcagcagacgccaccaaggcgaccggctttacagccgattcagcagacgccgttgagacagcaggtcgttcagccgatccagcagcaaggctcaatgaatgcgtcggctgggtttgcaacacctggtggtcagcctgtgcagtacactacaaatcaggttgtcccggaacacctggttcatcatgtgcaaccagatggctcagtagtacctcaagttattcccgagcatttggcgcgtggtattcagccgaaccttcacaattaccaggggggcaatttgaattatcaatatcagcctccatcaccttaagttcagtaccaacaggcaggatcggctcatcctcagtttgttcatcaatacaatcagtttgagcccacaccacaacaacctcaaggaacacctcaccagcgaccatgggctgatgtgatagctgatgtaatgagggagcaatttgggcttaaaccaaaagagactagaaatttgtattgacaaccttatcctgaatggtttgaaagagttcctctacctaaccggtttaaagtactagatttctcaaaattttcaggacaagacactacatcgacctatgagcacatcagccgatttttagcatagtgtggtgaggcatcggctgtggatgctttgagggttaggttattccggttgtcattggctggatcggcttttacttagttttcttctctgccacatgggtcgattaacagttgggccgatttagaaaagcagtttcatagttatttctatagtgggattcatgagatgaaactgtccgatctcacgtcgatcgagcaaaagcatgatgagccggtgcatgagtatattcaaaggttcagggaaatgaggaataagtgttacagcttgagcttgactgatgcccagttagccgatttggcttttcaagggatgattgctccgatcagggaaaagttctcatctgaagatttcgaaagcttgtcgcaccttacacagaaggtatctttgcatgaacaaaggttcgtggaagctaggaacaactctaggaagattaatcatgtttatccttatatgtatggatcggatgatgaggatgatgattctgaaatagctgcagccgagtgggttaggagcaaaaaggttataccgtgccaatgggtgaagaactcaggaaaagaggagaggtatcactttgacataactaaggctgataagatatttgatttgctacttcgagaaaaacagattcaacttcctgccggacatacaattccatcagctgaagagttgggcaagaagaggtattgtaagtggcataattctgggtctcatacgactaacgattgcaaggtcttcaggcagcaaatccaaacggctgttgagggaggaaaaatcaagtttgatgattcgaagagaccaatgaaggtcgatggtaatccttttcctgttaatatggtacatacagttggccaatcagccgatagggtccgtgcaaagggttttcaggtgaattcggctaatataatcaacaaatatcagaggaagtatgacaagcagcaggagaagcattatgaagaacacgatgacggttttgatcctcattggggttgtgagttctttagattctgctggaatgaagggatgaggttgccatctatcgaaaattgccctgggtgcagtgatatcgttgagagctcaagccggtcatataataggagtaatcggctgaggcaggaaagagtatctgttcatcaaagattgggcccggtgaatcaaggtcgtggccaacaggatgaggtagtcaggacaaatcaatggtgtccttctggtattttcacgaagaatcagaagagaagggttcaaacattgaggaacagggagcgccttcaggaggttgaacaagaaattaaccatcggctgaagaaagtaaagccaagacaggagtggcgtgttaagaatcaggttcctatagccgatgatattgcagccgatgatgaggcaaagaggttggcaaaagggaagagtgttgtaacggcaccaattaacatggtctttaccttgccagccgaattcgggattgatcaagccgatgtagacgaggtggaagaggagtcggctaagttggttctatcaccagaacaagcagtgttcgagaaacctgaggggacagagaatcggcatcttaaaccattgtatataaacggctatgtcaatgggaacccgatgtctaagatgatggtcgatggtggggctgcagtaaacttgatgccttatgctacattcaggaaattgggtaggaacgccgaagacctcatcaagacaaacatggtgctcaaagattttggtggcaatacatcagaaactaaaggggttctgaacgtggagctgacagtcggcagtaaaaccatccctacaacattctttgtcatcgatgggaagggttcttatagcttgttgcttggaagggattggattcatgctaattgttgtatttcttcaaccatgcaccaatgcttgattcaatggcaaggcgacaagatagagatcgtgccagccgacaggtcagtcaatgttgctagtgccgatttagctctttgggagatggatggccttgattgtttatctggaaaagtttgggatggagattttttaaaagtatccgattctgatatacagccaattgaagatggagaacccaagctattattttgagggcgtcgtggagggttcgaacgtctacaccatggatagagtagatgatctcgatgacaaacaaggtcaaggttttatgtcggccgatgatttggaggaaattgatataggtccaggtgatcggccaaggccgacatttattagtaagaatttatctgcagaattcagggccaagttgatagagctcttaaaagaatttagagattgctttgcttgggaatattatgaaatgccaggactcagccaatcgattgttgaacatcggctacctattaaacccggggttaaaccacaccagcaaccgccgagaagatgcaaagccgatatgcttgaacctgttaaggctgagattcaacgcttatatgatgctggttttattcgtccttgtcgatatgctgaatggatttctagtatagttcctgttatcaagacaaacggcaaggttagggtgtgcattgattttagagatttgaacaaagctaccccaaaggacgaatatccaatgccggtggccgatcaactggttgatgctgcgtcagggcacaagattttgagttttatggatggaaatgctggatacaatcaaatttttatggccgaagaagacattcataagacggcttttaggtgtcctggtgcaatcggcttgtttgagtgggttgtgatgactttcggcttgaaaagtgctggagcaacatatcaaagagctatgaattatatataccacgatttaatcggctggttggttgaggtttacattgatgatgtggttgttaagtctaaagagatagaggaccatatagccgatttgaggaaggtttttgagagaaccaggaaatatggcttgaagatgaatccgacaaaatgtgcttttggtgtgtcggcaggtcagttcttgggatttcttgttcatgagagggggattgagattacccaaagaagtatcaatgcgatcaacaagattaaacctctggaggataaaacagaattgcaggagatgatcggcaagattaattttgttagaagacttatttctaatttgtctggaagattagagccttttacgccattattacgattgaaggccgatgagcagttcacttggggggcagagcagcagaaagctttggataatatcaaagaatacttgagttctcctccagttttaattcctccacagaaaggggtaccttttcggttatatttgtcggctggtgagaagtcaatcggcccggttttgattcaagagcttgaaggaaaagaaagggttgtgttttattaagccgtcggctcttggatgcagagactagatattcttctgtggaaaagttgttcttgtgcttatatttttcatgtacgaggttgagtgtcacgcccagaaattcacgaaccagaattttctaagctgaatgtgcattaaacccctgtccagggccagccagggtacacaaacgacaattgttgacatacagatccacgtcttacaaaaatataaaagattacaaatgcagcggaaaaagataaaagcgagctaagcctgcagacttgactcctgcagcggacgactccattccacaggcatccttgacggcagcgacgaaaccaacctcttcgagacatcttcaactgagaaggactccaactctggtgtgggggaaaagagagcaagactgagtactacccactgtactcagcaagtcataccggaagaggaggtatgatgcaagatatatccaagggaggctaaaggttcttttgcataaagccggcatttcaaagcagtaattgaaagcagtaaaacagttgcagtaattaatcaatattaaccaatcactgctcaacgctacaccacgttgagacaggcccaaaccaccacctgaactaaccagttcccaaaagctaactaggggtgagactaatcacggtgaatctggtcgaccgcctataaccgcgggcacggctattcgaatagttttactctgatcagtggtgtacaactgtacccacaagacacagccccacgacacgttcccgtgcgccgacatgccaccacaacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaggccagccgttgcccacactggcttgtggtaagtacgataagttcttccagggcatcccgcgaaccggtccttaatcaccatgggcacgactaacaaaaccatgcacccacagcccaccatgtagtgtattttaattaaccaacaccattacggtagcactaaaccaaagctatgccgataatcaagtctatgctttaatgagattcccctttgtgtactagttgaactaagcatggctaagcatttcctaagccaacatctaatcattttgatacccaagttatcaatgacataaggtaaacaatgtatggttgagtagtatgacccatcccacatgatattgtaaaacaatgtaatatttaatagaaatgcgggacatttgtaaattgggtacaatatgaccaattgtaatgcatgacttgccttgctctcgcactgatgagaccacagcaacgtcttcaaggaaccgcggatcgacgaaacggccgaaatctacgcgacaaacaaagcacacaagcaaaacatgctataagactactgaaacagagaacaaaaccatttttaatggattctacatatttttcttgatttactgagacttgaatggacttaaacggagctcggatgaattagttatgatttttagaagattctctgtgtttttactataaaagaaaaacccttaatcaatttattgcgcaataattcatcccagggctgacgtcagcaaggggtggggcggcgccgacatgcgggccccactggtcagcggcactaagagagggagaaagggggcagctggcaggcggtcccaccgggcagcgtcacaaagggggggaggaggcggcctggctcggctcggcttcaagccggccggccggttatggcgagggcgacggcggtaagcggccgccgacggcggcggccagcgagaagacggcggcggccggcgggaagacgacggcggccagcgacgcgagcgacggcgcatcgcggtgacacgcacgcgaggagcggcggtgcgcgtgagaggaagagaaggggtgggagttctcaccggggattcggccggcgtgggtgaagacgacggcggccggcggcggcaagcagcggacggcggggcgcgcgggatggacgagacgggcctcgacctcgcgagtccaacggcggcaacggagcggcgcggcgacggcactagcgacggctagcggcggttggaggcggcggtaggcggcggcgcgtggggagagcggtgcggcggtggcgcgcggcaagcgagcggcggccgggatagccccccgcgacggcgaagctagcggtggcgacggcttcgcgcggcggcggctctagcagcggcggcgcgcgaccggaggtggcggcaagcggcggcgctagtggcgagcggcgcggcggcggtaggaggcacgggagagcccgcgaaaa

SEQ ID NO: 60935 - DNA, 19058 bp, Oryza sativa
  unsure (1)..(19058): unsure at all n locations
caaatcgattcccgcccatttgcgggtgcgcgcgtgggcgggaatggcggggagggcggcgacgtggggacgcggagtgggggtgcggatgcggaggaaacgggcagcgtggggaggtgggggcgccggcggttggagctcggctccaaccggctggaggaggaagacggggccgataggtgggccccacctgtcggtgacccggagagaggagggagggagacgtgggccggcccagcaaggaggagggcggcgcgggaagagtgggccgacggcccaaaggaggaaataaaagggggaaaaggaaaaaaaagaaaaagatttttcctaggattatttattgcggtttattgtttttaattgattaaaaatatttcgagagctctgaaaattccactaaaaatcttgttagcgaatttcgacatgtagaactcaagaaaaattccacatgccaattccgattattatttgcatttattaatttgaggaattagctctaggttaaattaaacaatttcttcggacgatttattttatgaattttaaagcaaggagaggaacttcagggcgtgacattgaggcattatctgttgtccaatgaatgcactgtcatatgtaaagccgatgttgttaagtacatgtcggctccaattttgaaaggaagggttggaaaatggatattttctttaactgagtttgatcttcggtatgagtcaccgaaggcgatcaaagggcaagctatagccaatttcatcgttgattatcgtgatgattcaatcggctcggttgagattgtgccatggactttattttttaatggatcagtttgtactcatggttgtggtatcggcttagttataatttcacctcggggggcatgctttgagtttgcttatactattaaatcttatgcgactaataatcaagctgagtatgagacagttcttaaagggttgcaattgctcaaggaggttgaagccgatgctattgaaatcatgggggattctttgttggtaatcagtcaattggcaggagaatatgagtgcaaggatgatacgttgatagtttataatgagaagtgccaagaactgatgaaggaatttcggctagtaactttgaagcatgtatctcgagagcagaatattgaggccaatgatttagctcaagaggcatcgggatataagccgatgatcaaggatgttcagattgaagttgctgccatgacggccgatgattggagatatgatgtgcatcaatatttacagaatccatctcagtcggcttctaggaaattaagatataaagtgttgaagtatgctttattggatgatgagctttattatcgaacgattgatggagtattgcttaagtgtttgagtgttgatcaggctaaagttgcaatcggcgaagttcatgaaagaatttgtggtactcatcaatcggctcataagatgaagtggttacttcggcgtgcggggtatttttggccgacaatgttagaagattgtttcagatattacaaagggtgtcaagattgtcagaaatttggagcaattcagcgagcaccggcctcggctatgaatcccatcattaaaccatgaccgttcagaggatggggaattgatatgatcggcatgattaatccaccatcgagtaaaggacataagtttatattggtggcaactgattatttcaccaaatgggtagaggcgattcctttgaagaaggttgattctggggatgcaatacagtttgtccaagaacatataatctaccgatttggtattcctcagactattacgactgatcaaggtttaatctttgtgtctgatgagtttgttcagtttgctgatagtatgggtataaaattgttgaattcttcaccatattatgcacaagctaacgggcaagccgaggcatctaataaaagtttgatcaagttgattaaaaggaaaatttctaattatcctcggcaatggcatactcgttaagccgaagcattgtggtcttataggatgacttgtcatggatcaatccaagttcctccttataagcttgtttatggacatgaagcagttttaccatgggaagttcgaatcggctcaagaagaacagagttgcaaaatgatttgacagccgatgagtactataatcttatggccgatgaacgggaggatttggttcagtcgcgattgcgagcacttgcaaaagttactagcgataaggaacgtgttgctcggcattataataagaaagtggtgcctaagactttttcggaaggtgagtttgtatggaaattgattttgccgattggagctcgggatagcaaattcggcaagtggtcaccaaattgggaagggccattccaaatacataaagttgtgtctaaaggagcatacattggtgtagagggagcagagcgcgacgcctcttgcggtggcggcggcggacatctccttggcgatgatgcaggtgcacctgccgacgttgaaagggagagggcggcagaggagggcgcggttggggagcgtcgcccatgacgaggccagcgccgcctcgttgtcggagaggtcccaagcctcgtactacgacgacgtcagcggcggcccaccgcctgccctgctcgcccgccgcggcttcctgttggggacggctggcgctcgcggccggatcggccgccgccgcaggccccattgccggccggcggcgggataggggggagaacaaggggaaggggcggcggcgaagcgccgtgggtaaggggatgggaggatagagtttgggagtcttttactcctatgccattaaaaaagtcgctgctgacttatgtacccaaaaaagtttggagtcatctgtatgccatgagaaaaactttccatttcgtccaccttctgttagaactgaacggttccatagctctgacatgtgggaccatgtatgaaaatgactaatttgcccttaaggattttcagctctattctcctctcttgctatctcccgagagtgcctgctctctccccgttgcgctgcacgccgccgcaccctaaccctagccgcacgccgccgccgccgcctcgcctcgtcggagtcgtcgtcgccgccgccgccgccgccgtgcgcccagggcggcgcgcccctacgccagaccgtcgcgcctcctcctctcctccagggcccacgcgttcccgcgtcctccctcgtcgcgcggcgcgtgggcggcacgcgcagcgggtggtggttggtctgggagggcggcggcgtcgccggtcgccgggtggtgcggcgctagggcgcagattggggccgtcgcgccctccgtcgatggccgccaccgcagctgagcgaatgagatatttgcggtggtcacgtaagattcgaatcacgatgtgctagctacggctactgctctcgtgctatctctagatctctcgctctcgctctctcgtgtggggtttcgagatgcatctgtatatagtttggagttctcgtcttttgcgagaaacggaatttggaattatgcgatggatatgccttcgtcatggatgctgcagctttctctctctgtgggtggaaggtttccctctgcaatctcgaagcagagctccatgtccagatttgatggagctggaggaagtcgtgctaatgctcgcagttggtcactgaccacctttttcgctgggatattatttttctttcttagaagtatctcctggtggtttgatgatgatgtcattctggctccttcatgtgttttgtgagccgccaacttagaattggtgccctttggaagctctatgtgtatgcttgattcgaagcattaaatacaaaaaaaaaagggcatatgcttgtgttagtgcgaagagtaaaatgtgctgtcgatgattattcattttttatgtattggacaataatacctgcccacatgaattcctgtcactcacaccaaactacaatatttgattacccgttatttgtcggtatgcaatagttatgcacctgttttttcttttttacaaaatttatttccgatttttccttattttttccaccattttctaatttttcccacattttccttttttttttcccggattttaaacatttttaaaatttattctcacttttttctgatttttacccttttttaatattattttccattttttctgatttttaacgcctttcctaaattatttttcacttttctgattttttaaacccattattatacaaagggcaaaattgtctttacacagcccctaacacctctgttatgtctccatacattcaaaatggcacacaggtcaacgaaagttgggctcatggcatacatgtaactccaaacttttttaaggcacacaggtaagcagcaacttttttaatggtataggggtaaaagactaaggggtgggagctggaaggggaggggataaatatgatgttttttcgtaacaaacctcgtatttttcatgtttacagcgctactcctaggagtagaactctatcttcttcgtgttctatttctataaaatacaagggttgtttcgtataaaacggaatgtggtgttagtcgatgggaggacgttcgcgctattccactcaaacacgagttgttttttttcgcataaataccaacacgtgtcatttgtttcgaggagacaaaacgtggcacgcatgtagtgggagaccggcagaaccggtggagaaaccgaaaaaaaaaaagaggaatggctccacagctcacccaatcgaggagcttctacaccctacatactacatatcacacctaacgaggagaaaaaaaaaattcaaataagagcaaggataatagtataactcacttcctactattagctcattttaaagccaacatatataatagattagttataaggttggctatatttttcttctcttctctctatctctcacttatgcattcaatatatttgtcttggagcttgtgataagctagctcttgcatgagagcccacacctttgattttttactatctctctcctccacctaagtttatagtagacttatagctcactattatacttgctctaacaccacacaacacatgcagtccaacacgtaatcaagcacgagaagccaaaacccaatttcaaatacgtgtcactagtaccgaggagccaaaaaaattaaaaaaatgagaaaatcagtagcactaggggttttattaattgatgaggtacgtagaaaacggagtggtcgattagcgcgtgattaattaaatatttattattttaaaaaaatggatcaatataattttttaaagcaaatttcgtatagaattttttaaaaaacactgaattttttaaaaaaaaaacacacatcgtttagcacatgattaattaagtaattattttttaaaaaaaatagatcaatatgattttttaaagcaactttcgtatataatttttttaaaaaaaaacatatcgtttagcagtttaaaaagcgtgcacacgataaacgaggaagatgagttgcaaaggtcaggaaaagaactcaactgggctacatcaccattgtttggtactatgtcaactcacctcaccatttgctttgccttttttttttcttcttttggttggagttcatctgttgtcctacaaaattttgcaatattcattttcccacttggctcctaggttatttatttgaggaaaaaaatcaaaattctaatgtgagctttcttcttgcaacccaagttattttaaaccgaacattgagccccctaaagattctcaaaagatccgagcaacccccaagtagatttgcttacatgctgcattaagccattgacccaacggttttcattgctaacaggctgacctaattatatcttggcatgacgctacaatctttgtagttgtgacattgtattatggtatttctagtgttgtcaaatacaaggttacggttttctgtttttcaagccaaagaccacggcttaaaggtgcgtaactgcacagtaaccacgaccttacctttaagatttgaaaatttcgaattcaactttttggatatgaaattcacgtggttcgtgataaccaccgtaccgaatgtgggatgaccgcagggccggacacatcctctaatgcaacgtgtaccatattttaggaaaccttctgctgcactacatgaaattagcattagcaaacagtgctacgatgttcatcgacacattgttcaatcacatgaaaattaaaattactcagcgagacagttaagtacagtcaacatacagatgcaacagtttgcttctatttggtctttatcccatcagtacctttagaaccaccatcatacgcagaaaggaagaacgaactctgattcttctgcagaaacctaccatgaattcccaattgatttagtgagcattttggcataaagtatgcctaactatcagggattgctacaatctggttagcacgtgattaaaattatggtattgaccggaaaattaattgtgtgggacagattttcaagcatgttttcaaaagtcggctaacttgagagatgctagtatatatagaagaaaaataacggctggaaattgcatgaagaaaatgaaggtgctaacatgatcttgcacgatatgttggtggtatatgtgaatgggaacatgaaaataatgcgtgccgtataggtgaatgtgacaacccaatagaagatgcaagnaaaagatttttgcgttgacttgaaagagatggtgccaagccagattttnctgcgtagtgagtgttgtngtgaggtggcgattcttgctctnccatgggttgacagcagcgnncaagtgaagcgtgccgggcaaatgttcgacgtgcagagagtcagcagaagaaaggtgaagcgcctgttgcaagacagttgtgactcttgccgttcgcaaagttattcgtgtgctcgaacatgcctagccgagcacaaacacatctcatcgttaaaacaaacatccttngtatttcattcaaagctaatgagggaaattcgcaatttattcatacttgtgaacaattatccagactctagttcaaactataatagaatacacaagggtcacaatagtcgattttaccctcttcaactatagccctaacctaaaaatcaaccctcaactatgaaattggacattttcaagctcaactaccaaaaccagttaaagcactaccaagagcaatcctaacaatttgtttgacatggcaactatttctacattgcttgcaaactaggtgccatgttagcaaaaaagtagataatttggatgccaactctgcaaaagaaccactgtacaaatcagattggactgatcttaaggggttcttttgatagttcaggggtgtacaccgtattgtttcatggctaagaattgatttctagactcaacacaatagatgaggagggtaaaataaattttactcagtcacaacaatgaattcaaaagtgaaactgatataattggtttcaacaagcgaataagtttagaaatgaaataaaaccttgaagaagtaaatttatatgttacattcaggaaggaagtaaacttttgaacagacaataaaccttgttcctaattgtttccttactttactgaataatcattcattggtggatatctcatgtaatcaagaactgcacataccaaaaaggcgcagtagatgctcagctccatatatagttgagggcgaaacatcgcctttaacctcttcagagtactgctgtcgctctttcttatacaaaagcattgcaggcaatgctttatcaaagtagcatcgcaatcctttcaaaatctcagcgtaagagtcatttatccttcagtacaaagtacaaacaatacaaagttttaatgggtcttttcaagaaaaataaatattttttaaaaaaacaagcttgacagacacagatgatgcaaataggttttggataagaataacataaaatctaaacctttgttgcataaggacagaatttccataattatggttattaatatgaatattaaaatgattttaggacatttcgatatagtgaaatttaaccagaaagagttaaaggtcagttgatggttttcagcatagtacaaagaaaaaacggcagaccagcagtctgaccataggaaaccagaattggcaacctcaatggttctgtttgcttcatggactgttcatgcaattagacaggtaaaaacaggcaaattctgggttacatgtgaaatctatgaaccatgaaaatcttgaaccatgcagccaatgtgcaacatgaaacatttgtccagggcatggaccaataaatgctggaactctccttgtgaaggcacacagtacaacagaaataatcccaccggtgaggcccagccactgaaccagaacagatgcatttcaatagctggtttgacttttggtgctttggttttcagtcatgttaagtaagagaatgacatgcacatagtaaacatactgttggattatgctgcacataataatcagtaatcaagcgcacagaacacataggatgaattacaaaccctaagctaagagtgggaattctgtggttgtgctgttgcaaaacaaagatagaaggtgccaggtgcagcaattgctgtttgcaatgttcacatgtgacgtggttacagtagtccacatcattagttgatttatttaagttaaatttatcctttaaccacaacttacaaagcatgctatactcagcattgttccacaaagatataattggccataggttttgtataactttggatggcaagttgattaatggcatgtgggtcatggggccaataaagtgtgtgccacactgccactaatttagcaacaaattggcctataaatgtcaaatttgcataagttttggcatattatgggtatagcacaaagatatgaatcaacaatacatgtcattcccatgtccgatacatacaggatacagccatatgcagcattccagtgtatctggacatgtcagtcaagtttagcatttaaaattaacaaaatgagatacagcaggcccaccatctgcgtctcataaaaatccacaattagcccaatgtcatactaagcccaaatccctctgtggaagcatactagaaaacttgagaaaactaatgagcattcttgaggaaatgcataatcagaaattcagaataccattttaaggtcgcattattcctagaagctatcctagggtgaaaacatattagttgaagattgaagggaaaggcggcacaaagacctgtccaaaggtgatagtccctgtctttgttttagattatcctgctatatgtggtggaacctaccacaattcatgaatattcatctgaatagccattttttgataaaaacctataatatactacacaaacgtaacttttcctagtttgtcagtgagtaatcttaaactcagcgattctcatgcaccaacatcctcctttttttttctgtttatttgttaaaattagagtaacttccaatattttctgaaaaatacatcaattctaattcaaaaacatgttaggctataatatctttccgcactttattttatcccttcttcaaattaagagaattataacttttctgcacctctgaaagtttactcgttcccttatttgcggctcattctctcaatgacatgttggtccagggtccacatgtcagcaagacattaggggtaaagggatcacatggatttccgagtagcaaataaggaattgcactaatgacactaacatttgtttaaaacatcatggtgtatgcctcaatacctacagtagaattccgaatcccgtactgtttataacttgctgtgtcaaagatatgccaataaatcagaatttatgtttatatagaatgcttacttgttatccttctttgtccggtgctccaagtacttctttagaatatcatcgaccgtgggggaccgaggtagcttcacaagctgcagtacaaggaaattggctcaggaaaggaactggtagaatgataaacagttacagttaactttggcatacatcactgaggacaaactcatcgtattcgtagttttctaacaagtaccttttcacatcagggattagtgcaacataatgacttgaaacactcaagtctatctagttgttagtaattcttacttcttgaaatagtaacctttttggggaaacttaattcttataagtttccttaacatgagaaatgaacatgacaacatattggcatcagtcaatcatgttcaaaaagatgcagaaagtccagctccacagatacacgaaatatacaaaagatacacaatataactaatgatctaggtaagtttgagtggtatatatcaaggttgcttatctaacagtaaggtggtatatgtcaaaatttagctgcggaatgtacaatgaacaatatatccactggtcaagattgctagtctttttttctgaacgaaataaagatttcaagtattcattctcttattggttcctatttgatacaaacatgcttctcttaagtacctgttgttcccatgccaactcagacacaatattcaattataattgaacaatgaaggttgtgatttggacataaataaatcaaagacagctcagggaaagatttgaataccttacccagctgcgtgacaaactcccaatcatcaacaagttgcttttttagcgttgaaggaaaatgtgacatgaagagactctcagatgattttctttctttctcctggatcaaccagggcagagttgtcattatgtttacaaatataccacaaaacaacttgatagataaaatgatctaccacatgcttgccaaatatagctgaaagcttcaaaatgttaagtttgtcagtctccataaccataataggtaggtaacgaattctcttcgcacaatgtaaaacattagttcatagttccaaactaccaatttaaatttaacatgtgttctaaatttatccatactaacaattcttacacagctagattatttttgctggtaagcaaacatcatgtagtccagaaatcggattgttgtgtaaagaactaaacgaagcaccgaagcagcaagatttcctaaaattcatcattacaattttagaaatgttgagaaaatgaaatagtcatcatcatacaacaaaaggtcaagaactttaagtgttatacttatattgtaaaaagagaagaaaggtccatatggaccatagaatgttcccattttccacatgtatgatgaaaaatgaacataactgccaaatcatgtacttcctccgtttcacaatgtaagtcattttagcatttcctatattcatattgatgttaatgaatctagacagatatatatgtctagattcattgacatcaatatgaatgtgagaaatgctagaatgacttacattgtgaaacggagggagtagtactagaaataaaaagagaattaataaaaaagtattattagttcaaaggagcagaaatatgcttaatatcagtagtttagaaatgatatctcaaaaggcaaattgcagtatcataattgatggaaaatgaacttcatggaaatcaaatacttcacaataaaacatatttgaaagtgagagacacctcagtcccaccaggctgacttttgcgtttcttccccttgactgcagttttaacatcacagagatcaaatgtaataagtatcacacaaatgagaagaaccaagaactttgaaaaatgtacgagtgaacttactaataatcttggtgtcttctttatcagtttttgcatctgctgaatgcaattacaataggtaagacatatttaagaggaacaaattacaaagtaagacataaaatggaaacccatcctttggtggaagcatgggaaaaattttggtataaccactataacagcatgggaaattccattctcaatgtagcaaatagagtggtagcaccccattaagaattcaacttcaaattgaatgtgtcagaaacaaaaatatttgttgcaaataggaacttctattgcaaataggaacttctatgttttctttccctttggtttaccatttgtcatcatttcttatttctagaagtacaaataaaattgcagttcaaattcaataaacagatagtttaacaactgaaaagaacatatacaacgttctgagagttttcatgctgaattggtgtcaaagccatggcagttttcatgattggactgagagatagtttccaccataaaaaacagaaatatgatcatgagttcataaccacaccgatatgaaaaaagatgaatgggaaatttcagaatgtcctatatgcacagtaccaacgcccataacagtaagctaccacgtacttgtaccagaagctatcacaaaattactccaagattggttcataactccaaacttcggaagaaatatctccaagggtgaagtttgagcttaatccatcaatgtaaatgatcacagcattcagttataaccatcacatattcacaatctctttgccatttggcatttctactcttttaagtacagattaagcactgccaggatgatgcttctattagcaaaatacaaaatttatcatagaaacatgacactcacagctacagaacaaattaaaaacaacaatttggcaaaatagttcctagaaaggaagctcccagtggaatagtctagacatgatccaacagcacaaacattgatttaacatacatctagcttgtcatggatagaagtaaaaactattgacccagtaaaaaaagcatgtgtcatcaattccaatggaaagaagagggaggcataagctaaccattagagccttttggcttatgctgcgctgaccgtccagattttacgcttttgtcaactacttggctcttttcaagctcttgttgtttgcggatattttcgtcggtcaatttcagtaagcgatcatttgtgacccattcatcccagctgtactcattgaaaataaacatattaagaagactgtttacttgaattaggagagcagaaagacaactaaatagcatcagtgcaatgatagaaacaagcccctcaacaggattcatgaaaatactattaagaaaaaaaattgcaccgtaagggcaaagatgtgagactacccaaacatggtggtagacaacaatatggcactgccagaaaaaaaataatacattagaacatgcataaggtcattcatatccaactcaaggtccaaaatccaacttagacacttttaaactgtcaagggcctcagtgaaatttttcatccagcacaactattaaaaaaatttgtgttgccatcacttcaattcacacgtagaaaatggattggtcatatttaaatatatgtcagtcatccgggctccaggcactcactcgtatcctaaaacaaaagtcaacaaaacgggtataggatcacttccccaactgagacacagatcatgttctacagatgaattcatcaacataatcattcaattatcatatttaaaattatgttccataaacgaatctaatggtttcatttacaagtgaatctataaatagcatttgatatattggtggtcaaaactataaaagtttgattcgatggttttaaaaaacatcatatatttccattacacaacaaagagacacagagtagccagagcctgttctgaattctatggattttatatgatgctatgatgtagttctgaattaatcagattgaggccagtgagatgcacgagaagctttgcatagtttcactttcacatatctcatgctactatatgtaataataatatcaattgcttgatagaacaaacatcaaatgcatcatataagtacaggtacagatattccttgtacggttaaaaaaatattcacatcaacataaagaactcgaaagcattggtaataagttattagctaagcatggaagacttatcgatcatccatggtatgcacttgcctcttattccaaccctacaaaagaaaagagaaagattcgttggttcctcgatatcgaaagggaacacccaaagttaatgatttatttttaagcacttgtcatggtgtacaatggcgacagagacttaggggacttacaagataatggacatgataccgccactcatcctccttgttttcggacttttgaaccttgagaaatccaaggggggagggaaatgaagacaatctattagggaatgcaattaacaagcaaaagaaaggctaggaaatgatgaacggaatagcacagtgcacagatatgacctagactagactagcagaaaagcacggcaagcagagggaatttaatttcctggtgcggaggattttgcacagtaattagtaaattactaaattcccttggtaaatactagtaatactagtaaaaatttcaaagtatcggagcggagcagcgcagctatggaggcgaatgcttgtttgtttgattgttttgtttggtctgcatccgaattgggtaaatcctagcgccatttcttcgcaaaattaaacgaaaccctaggttggattggagcggaatggaacgggagatagggggggagaagagagggattaaggagcggaccttggcctcgtagaggagcgggccgtggtaggcgagcactctctcgccctccttgaacgacggctccttggcagcggcggattccgatccagcttgggacattggtgggggtactttgggggaacaaacaaactgttgcttgtattgaggtttagggttctgaaattcggagaagagctccttcttcttccagatctagaagaagagaagctagggttaacgaacgaacgccaggaacgacgagagatgaatcagaaagaggatgtggatggatgctcaccaggatctcctcccctctcctgctctgctcgccaggaacgacgaggagacgggagatttctttcttttacgcacgagcacgagtcgtccaagaatctttagagagagatacttcaatacacagcactcacttatcaggaaaaatagagaaaattgtgattttgctatcgcgctggaatactattccttcaaagtgattcattaaaatgcaactaagggtgttcactgaaatgctattttgggtctttttggtttctagaaatgatttagctctattttcatttttgttcggaccaaaatacccttgccttgcctcagataggtttttaccggatggaatcgatctcatcccgttggcatcgaagctaactgaggaggagcgacatcggcagcggcgacatcgtcgcgcctccgcattgggtccggctccggcgccggcgccggcccccgccactctccgacctgctcctcccctccctcctgccccagtccactcgcgccgccacctcggtaatgacctcggcaggtgtcgacgaagagcgtggaggcctcaacgatggcggccgcggaggcgttggcgttggcggcagcacaggtgggaaggagcgcgccgagcctagcggtgttgacggggaagccgaggaggagcgagtcgcggagcaggtggcagaagcacccctccccgccgtcgccactgggggagacgccgcggaggaaggccgcgcagcgggcctccgagggcacgggcgcgggccgcgcgggcggcgccaccaccgcgacgtgcgccaggcacggcgccaccgacactatggtcgccgcgcacggcgtcgccggcggcacctccgagatgacggggctgtgccgacaccaccccggtgccgggaagacggggacgtgcgccaccaccactgctgccatgttcgtccgctcgcgtcgctgggtcaccgcggctgtcgccgaaacgtcggggtgctcgctaggtagacgccggcctcccctccccgccacgcctgctgcgccctccccacgcccgccggcggcagccggccatcgccgctcccgagagaggggaaaagagagatgagtgagtatgacaggtggggcccgcatcaggggtattttggtccgaacaaaaatgaaaatagagctaaatcatttctagcaaccaaaaagacctaaaatagcatttcagtgaacacccttagtttaggatagcattttaatgaatcactttgaagggatagtattccagcgaatccattcttttgcgatagcaaaatcacaattttctcggaaaaataggccaagtagaaatactccctccgtgtgaggttataagatattgattttggttaaaatcaaactgctttaaatttgactaagtttataggcaaatatagtgatatttacattaccaaattaattttattaaattaataattaaatatatttttataataaatttatcttggttcaaaaatattactgtttttttatataaacttagtcaaactgactttgacaccaaagttaaaccatcttataacctaaaatagagggagtagtaagttttagagggttatgaccgttgcaatacaaaccgccaatcagagctcttttatctagcgagtgtgttcttttggatgggttagattaacacatgattaattaagtattaacaataaaaaacttgaaaaataaattaatatgatttttttaaataacttttctatataaaccttttacaaaacacgtaccgtttagtagtttgaaaagtgtacatgcgcgtttgaaaagtgtacatgcgaaaagggagatgagtttcgaactcattagagagaaggggctacgttcttttgttgaagatctcaacagcaaggaacgaacgcaacccagaagttccgaggggtcaatgagattcgttgtaccaggagtagggagtaggtgagaccaaacaacttggtttggaatttcttttattttttagactttgttatatttttttaattttattaatagacatttccgaaaaatatttttgagaattgaaccttttggacacgctggcatggcaatatgacattgctacgctgctacgcgtggcgtaatttagtaatacacttcgaaaaggtctattaataagataaaaaaataaaaaaaagtctaaaaaaaaactccttagtttgacatccaacttcacctcttctaaagctaaaaccgaactaaataattttaccaataattttacctccacccaaaagggagcattatttagctccacccaaaagggagcgaaataggctagagtgttctcatgaaatgaattagagaggtgatgctacattgtagaccgaactaaatagttttagctccacccaaaagggagcgaaataggctagagtgctctcataaaatgaattagagaggtgatgctacattcattgctacgtttcacaactccactctagatccagctatgagaattaaatttaaaagtagagcaatgctaacattgtgttctttgccctaagttcctaactcacatctatcgttttccacgcacacgctttttaaattactaaacagtgttttttcaaaaaaaatatctatagaaaaattactttagaaaatcatattaatttatttttaagttgtttatagctaatacttaattaatcgtgcgttaatccatagctctgttttgcgtgtggagattgattagttcccaaccctcctccaaaagaacacagccaagtaggccctagaatactgacttaaaggttgaaaaaaaaggtattttcttctttgcattggcattatcctattcttgaacgggtggatcgaaatgttctggtaatgttgtactgccagaatatatagatgtttctgtatcgagtgaaacccccatagtccatactatccatgaaagtaaatgcaaagcacaacataaccagatctgtacaaacgaagggcaatgacaagatgcctaatgaatcagtgaagaacaaatagtttgatttctgcatcctaagatggtgtcctagaaatccataataggcactccttcctaagaggagaatccgcaaatattgctttgacaaaattttgtacctgcacaaagtaagcagatttgtgtaaatttagcctaattatattttcagttttagaaaactgaagtatcaaaataaaacaaacatgatagtaaacagatttctaggactatcaaagaaaactcgtgactccaaaggtagcccaaaaatctactcgctcacctcagacgatgtgaaaccacaattagttaactccccactttcccaagcggccgtgatggatttcaacgacatatcaagcagctctgagtaatattgtagatcactttagtattttcttgaggggaattaaaaaaacattaaacatatactatgaaaatcatagcaaggtgaaatatacccgctagcttccggaacttcttcaaaggtcgtataatctcatccaactcgatccaagtttgatggtccaagaactcattctcaaccagggacagaaatagtgatgagaggttttcaagagccaaatggataagaccttgcagctgtccgcatatcacatataataaatatcaagaatgatgagctcaaaccttccaaggataatatgtctcacctgtaatgtctcctctgctgccatgtcatctattaggagcatatcttttgtaattctagaaaagacagatccaaggatgtaacacatacttctcttgtaaattgatcttggcagtatcgattcccacataatgtgtattttttctaaaatgaacacaacctgaatggaagtcaatatataccataataatgcatcaatgtgcagaagtatgacctatattttgtaactcaaatttgaagaaaaatcaagacatttagttgacagattgaattggttgtgattgatgattttgcgctagataaagaagataattgtgattccattgcaggacatggataagatgttaagaacaaattctattctactgttgaccactccaaaagtacagtaaccggtctaggttattcactactatttctacaaggtccaagtaactgacatctttgcaatgaaacatacctgctcaatactgaattttgctgattcataatgctgaggttgg

SEQ ID NO: 60936 - DNA, 21217 bp, Oryza sativa
caactagtttctgtaggtcaccaggaaaatctgcacggtactggagaaaagcatcaagaaaggtcagtaaaaacgtaacacaatttaaaagaaaagaaggaatctttaagttcaacaggaaaataatacagtgaggttgcacttgcccaagggaaaaacagaggtccataaatgttatgataggcagaattatacagttaccaatctatgatgtaaaaacacttaatcccatgattatagaatgctagttcaaaccaacaacaggagaaggtaggctggacagcatgcagatagtgatttagcaaagaaaaaaaaatcaatctgctttccactgaaactgacaattaaagaacatcgtaagagcgaagagaggtcataaaacataagaataaaggatggagacaatacatagtccatatggcaagtctatattccagtatgaaggactgcagaaagtatactcacgaaaatcaacacatcaggatcaatcactataacaaacagcaaagagtaggatccacaaacctcaaatgcaagaccaagaatttcttgggacaaatggtagaagtcgttgtgaataatggcagctacttgattgatactatcgagttgcttctctagctgcagaagacccaaaaaaaaaagaagaggtgagtgccaaagttcaattagtttgtatcatggctcagtaatagcacctgtaactcttggtggcttgggaaatatggaatcatagaaatgactgtgtttaacggcgtcggtcctaatgtaatgactgtcattatggtggctaatgagtgtggcctttggtgtatgggagcttctttgcttagggagttcctcagtaggtcgctatccccacttgggtgaggtcattgttttgtggtttcatgtaaacttaagtcctgtatgtctgtagggtgagggattgcttctgcttccctccccgtgttctcttgcactcttatgaaatgatacgcaactctcttgtgtattcaagaaaaaaaaatagcgcctgtaacatagaattagtgtaatgtctgggatgcaccaaatagccacacataccaccaccaggagctgcggcatgacagataagtcagccagctccttatattttgcttaggtttatcttcagtccatttgtttcattctcaacttaagagtttgttagacagacttgcgatgtgaggaccaacacagcaacactattatctcatgtaccttttctactctcccaccccctgctgtcggttaggacttagggttccctgtctagggccttgccaactgaagaatagaatatggtatgatctactaaagggaggtttccccataacacaaagcagcaagccagcaattaaattgtttgaacagttttactgtgttgccctaaaaaacagttttactgtgcgttattaaaccatagggatgcaccaaataggaggcacattagctacatgaaacacttgcttaaactaagcatgccatgaccatgtgactacaaagggtgttttactgtagctaaaactaagaattatttcctctacatttacatctattagggtgtagttttagttaaagtagaatacacactgagggaaatcatcaagccatgcatattaaattgaatcttattctactaagttttcctttctccaaaagctaatagtgatataaaagcatatagatccttgctaatagacattcttatatcagcaacatgcaaaaacaaaaagagcaaaacaaacaatcacatgtacacctgaaggcagcaccatacttgcaaacaagaataaataatagtcattaattaacactccaaatataatggacatcaattgatatttctctgtggattatcctaaatggtacagctaaaagccaatccatatgattgaacagcagatgttatcatctctggagctttggttgatttgcatatgtacaaacctgaactggcacaatagccttgtacaagagtaaggcgtccctagcagcatagcataactcctttgcaactcttgcggatgacaaacaagcatcctgcactggttattcaacagcaaaaatggatgtatatcaaatccagacttttttgtttacaatagccaacagcatttgcacagaaatgtgataaggaataacaaaccatgtcaaattagtacaagtactctagataatatatataaacagcagaaagaatgtgggtccaggtataccttcagggctccatgaacaagtttcattaattgaagtgctgatttagatataaaacacttttctggcaggaaaagtaaatcaacaatggaatcttctcgatcatgtgatgcctgaaataacaggcccctttaatatgttttgtacgatgaatttcacactatactgctcagtagtttgcacatgaaaacagggaatcgaccaaagcaactcacaagaggattgtcgtaatcataatgtacaagaagatgtcttgcttttaccaagatctcatttctcttccttacagcgaaatggacttcaacatcatcaacaaattgggtcaacttgccatcccttttttcatgtgaaatgaacatcatattcctaagagtattctcaaattcagttgtacttctcacaacatcttggaactcaattagcttggatgcctcatgaggaacagcctgacacaattgaatgattactccaattaatcaactcttgagcataattttatcaaatgaataaggtaaatgcataccttggagataaaatgtttgataaccaggtcagatattcttgaccaagttaactttgaaaaagactgcatccatgtgatattttctccacaaatggtctcacatacaaacttgattatatctattattcttgagtaaagagctgaaccatctttgtagcccttgaataatagtaaccaattagatgactttccaagacaataagaaatgaatacaacaatcaactttccttagtactcaatgcatttccaagatatcataatcatcactcaagggttcgtgatttcatatatgaaattgtctaattttccatactcaataaagcagccagcagccagaaaaagattttaatctttttctttagaagtaactgcatctttaattttttgaatatgcaacatatatgttgagttaatgccttgaaaataacaggcacatgattgacaatgaccaattagctctggtgaatcaagaaacactacgaaccacttacctgtagttcctctgttggggttacacacaagattgatatagggtattgaggaccacttttctcaagttcttccacagaaactgccacagatatgttgctgatagctggaactaggacatgcttgatcatcaagtctgctagctttgtcattccatagtctacagcatcaattatctgtacataaaggaacatcagaaaatgagaaagtgacttgcttttcaaagctcattgcagcatacaggtcatcaatacaggtagtggagacatggagcttcctactatatcacatatggcttagcctagttattctgcaacatctggagatcaaatgattcagggggctagccttatggggacccaagagaagtaagaaaggttgattccacaaaccacagaatcacctgctacgtttggagggtatgaaaagaataaaacaatagtatcggtacagaagatctaacaaatatgattggtgcaatatgctccttttcaaaggtgcgaggagacaatttcagcactctgaaattatccacctctcccgctggcaaactttaatgctattattgttcagtacttaacaaattgtagagcttaaagacaatattaccatttgatgttccaaatttccatcgaaaactaaataccgtagcacaaaaatatgcacttatgtatttcttattctaaggcaatcgctgaacaccaagataattcctatgatctcctggcaacatttatctgctagatatgttttatggtccaaatttggagctctcacaccaaactgattttctcagtataaacctcacctccaaggcctgcagagccacgcgaagctccacaccaggtgttccaccggacttgcctacaggcgcagtcctcaccatcaccttccctccctccggcgcaaactccacacattcctccaagttcttcgcaagcatcacttgcaactacattatcaccaaaaaatcattatcactgacagttagcacaactgcacaaacacaaatcgtaacaaaacccgaaaccctccggagtagaacccccatcacctcgtcgactagctgctcccagtcgttccggagaagcccgaacacgacgggttcgtcctgactagatccagatccctcgggatccaccaggagaggcttgagctcggcagcggcggcggcggcggcgagggggtcgggtgaggcgcgagcggcacgaagtcgagcggcgaggtcggctaccgaggaggcggcggcgaggtgctcctgccgctcgcggagctcgcggcgggcggcgaggaggcggtcggagagctccctgaggtcggagaggcccggggacgaggagagcggggcgagcgccgacgcgagggaggactcgagggaggaggacgaggccgaggagtcggcggcgcggaggagcgcggcggcgagcggggcgcggtgggaggaggcgaaggagagcgcggaggcgtggaggcggtcggagcggatgcggaggcggtcgatgaggaggcggaggtccggggccgagagcggggtggaggggtcggcgtcggcggtggtggagaggaggagctcgcgcacgtcgtcggccatcgccgccggcgacgaggcggtggtgggggtgggggcggcgctgcgggatccggacggggaggagttaagccgttggggacttgtttgataatagcaacaaaggtaggggctaggggcttaagaaaaaaattactccatgagtaagggcatcttccatagttgcagggtagtactccctccgtcccacaaagaaggtcgttctgctcacaagcaaatgtcttatatttgttgacgctgcacttctccaacagcacacagttgcaaactcctagaaaagcatccataaagaaagtgaaaagttttgaattgattggactggttgcattagtttagggcctgttcactttgatgtcattttcaaccttatcaagttttggtaaatttaccaaaaaaagtggctacatttagtttgctgctaaattttggtaattatataagaaatcctgccaaaatttggtaaggttttttttggcatcaaagtgaacatgcccttaatccatgaagtagcatatatggcagtgtactagtactactcaagccatgaaatagcagatgtggctgtgtactagtactactcaagcatccacatgattagctctaatcccataaattaggggcaaaattgccattttcactcacaactaatttggctcaacaatcctagaacgtctagcattttgggacggagggagtggcagttgtttacagtacccacaaattagtttatgtagaatgaaaagtaagatgaggcttgctttgaaaaaaatcgtaagttttctagggaattctatgatccggtattagttcttcaccacctccacactacctgctattttattataccgcggatatcctaataatgcaaaagaaagtctctacttaaggcaatggaacgttttctagattctttctaatttttacatgtcatttaaaatgtcactgaaaaatatcaaacaaattgagttacctaagtctatagttgaatgcaaatcatatgaacactacaaagaagataagtttttccagtcatatatttaatttgagctacctaatataatgccaaataatataaaccaacatttcaagaacaatctgctgaaattctaaaaccccataaagcaggcaacaatctgtagagtttaggcttagttagtcaacgcatgaagttttatgatgattacatataagaaaacaactagttccaaacctcctttctcattccttatctttttcctcaccatcacttcaaccacccgcttgcctttcttttattgatattattcaccctactggaaggacctatgccaaattggattgttagtgagaagtcaatgtgctttttagactcaaccctcaatatgaatgacgggatgctgaaatttgtctgtcaacactaatgtggtgttgcctaatcaagacacgagcatggtgaaagatgctgctacaactcggtaccgaagggaagacgacgatgacaaaggaagtagagaagactatgctccaaatcaagatattcctagaaaccaaaaagagcgggaccataatccaagttaagatgcatcaacgccaaggccttgttctttgttcaacaaggagttgctgagagtttgttctcatgtattactgacgccaagaaatgaattaaggggaagttggttggaattaattcaactcttgaaacccttgtctagcctactctttagctcatgttttcaagtgttcccgaaacataagtcaaactagttcactgcaacacttgaagttcttagacaagtctagccacatttagtagctagtaactttactagcaggtagtagtactactagttgagctcattaaacttctgtgtatgtcgttgtatagcctataaataggcaaccatgcatgtatgaatgaccgatgatatattgtccaacactttgagtgaaaaaaaacaagctagctaaatacactatcctgactcctccgcttctagcatgagctattccagtgcctctgtcccttgcgcttgataaatatttttgaaccaataggctcctccgatgtcgacgttagtgaggatggatgccattggtgtcttcctctcatcaccaaggtagcatattttggtagtccctgatcttgccgagcgtggcaagccacggtactaggggagacagctctcattggcggcacacataaacgcgagagtgaaggacaacatcgagcgggtcgttgagaaggtcgagccatgagttgcaatgaccgaggaggaggcggtggcggcaacgatagggcctcgctcgttttctcgttgacgacgtagcgatctcgatagaaaacaagatcttcatgggcaagaatggaaaatgaatctatttatagcttctaattgagggatcacatcaggtgcaactgaattttggcaatttaaccttttttatgaaacttattatacaaccctagaaaaaatttaatcgaacctagacaaagcctcagctccaaagacttggtgatgagctttatgggaccgacctctataataataaaatacatgggctatgattcactaaatgtcaagcatcatggtggtttggtgtctacttgccttccccgacgcacgtgttcaactcctctatgcccctctttttttcatttactttttttatcaaaaagcaacccgctcgtttggattcttaatgtttattatagtagccactattaaagaaaactattttattgagtctgctcttttgttttattggttctattattattattattttaagaaagaggtgagggggtcaatgctaggtcccatggtactgagaagttgggccttagcaccaacgttggcgtagtttttgttaaggctcatttgtataataaagtttgtaaaagggttaaagtgtcaaaattttcatgtgcatggtaacaacgcaagcttctaaaatgcaatacacatactatactagactagataaagtactagatgacatcaaatgattatatttccaaaaacactcagatgattcaagtatgcaaactacaaaaattagcaaacagtgaaacctcaaatcgtggcttcaacagttcgatataacattataacctcatcacatgtatgaaagacatttgcaacattgctaaatgaaaaacaaattagccatatcatgtacagcatagacggtttgaagcatcagagttgttattattggtcgtgaagattatacatatggattaaaagaaaaataatgaaagaacaatatacagttctactaacctgtaattctgatacatacaacaaatgcatccagattgcctcttgttctgtttatcttaatttagaccccccacccccaccctatgcgaggggtgtaatcagtttaatttatttttctttttatacactcgaattaaagagcaaaactttatcctatcttcctttctcttgtatgtgcacttataacttggtaataagcatgctttggatggggtcctgctgtgatgtaaaaattcagttctcgctgtattcaaatattgcaccagtatgattgaaaccacatgacacatggacggcccttgcattcttgccgaattccaccatcataggttcaaagtaatcaacatcgtttccgtgtccctgaaaagcagtcgatggttagcacaatcagctgaaatagcaatttcagcataaatgaaagggaaaaggtccatataccacctaaactttggatgaagtaaagcagggatggacatatttaaattttcaaatgaaggtagaccaatcatttttactgtactaatcgattggacgaaaaatgtgaaatcaagtaagtgcacaggattaacatgacaaacaatcttgtagttgcagacttgcagtggtagcaagtaacttactaactgtccaccagaagaatggccctcttcgaaaaaagtaccgttagcacctccccagccccacgtgtaaatatctccacctgagtgtttccagatgcttcaaatatcagtaacacgtagcaactaaataaaatatgagaaactagactattatctaatatacaataatacaaacagggcagtggcaaaagtgttaaatattaagtcatgatgatggaaacttgttatcaatatataactatttgcttcaaacaacgctgtgctactaagttatactccctccgtttcatattataagacgttctagcattgcccacattcatatatatgttaatgaatctaaacacatataccgtttcatattataagacgttctagcattgcccacattcatataaatgttaatgaatctaaacacatatatatgtctagattcattaacatatatatgaatgtggacaatgctagaaagtcttataatatgaaacagaggaagtagaatccaacatactagctaagtagctaaaagacagtacaattatggtacctgaaattacagcggtgtgcttccaaccacatgatacctacataggatatatggtgagtgtccaccagaaattgtaattagaattgtccatgatagatgcaatatataaaaaaggttcgaacagatgactagatgaactaaccttagatacaggaaacttaaataaagaactcttcagaacctccggagagcgaaccatgtctgtaccactggtaaggaatttaatgtaagcaaacatcctcaattttgataaacattggtacaactgtaacaacaaaagttgaagtagcaaatttcttgacaaagtggaaaacaaatacccaagaccaaggcagccattttcatttgaaccccaagagtacaaatctccactatctgcaggacatcacaacatatatttttagaaacctacaacaatagaaacaaagctgtaattgataaattctattgtgaaaacttatcatgaaaattcaccccccccccttcccagtaatggtacgtaaaacaatagcaggcataaaccaattaaattgactgatttgaacctttttgtagtatggtccaggacaacagaaggataaggcagactaataattggaagcataacaaaggggtttctggtctgagccaggtatatacagagccacatttcaaccagcgatccaaatcactgagaaggatctacctatataaattccaatatattgtatcccctaacctgccattttaatttggagaacaatccttattctaccaggaaagtaaatgtttatgggcaagattttgatctaagtacattatggaaatacttaatgccatggtgccttctaccaagttactgtaaacaaaagtaatcagtgcacctttgtataccaagttactgtaaacaaaaagaaatcagtgcatctatgtactcacaaatgcatagaacaagaaaacgatacctgtcacaacacaagtatgataacctccgcaagcaacctcttcagaaaatggtacctcctcaacaacagttggtctaagttcatcacctgatcttccaaatccctgtaatgttgatgttaaatacaaaggaatgaagggaattcgaaaaaatagatttcaacaagggcaatgaaaatcaatgccatgcgctgtaccaccttctcagtcttctgcccgaatatgaacaatgtacctttttctgcaagttgttgtgtaagagaagtgtaagatggggaaattatgatgtgtacaatttgaagattgattctccatagtcttaccatcgatacaagctgagtgcagcattcccgcagctatccttttaatctggccaatgtacaaatacataatatgagaacggaaacactattatctggagccaacattgaatctaaaagtaccttgacaccatcaagattcttgatcaaccttggagtatattcactgcacaattaatggtacaatcatcaattttttcatccttggagtatgttcactcacaattaatgtattgcactatgcaaacacatttagaaccaccaaactatttttacagtgaagattctgatagaatgtcaagtgaggccaaaaatatgccaggcactcactccagcacatgtcaatagcttagagacgaacattagtgaagtaatttccatctaatcagtatataagtctctgattaattttgtttcttagtattcaaaatatttgctagagataggattagattacattgctaggggttaagcaaagaggttaatatctattatttccttatccccttctctcttcctccatcctgtgcatctcctacttctagcacattctctcctgccatggcaactttcaagaattagatcctcacccacctattattgcatcacccaccacaaccccattagatccaatttatccaaaccaacacatgcctgtgacaaacttgtatatataacccgcaaatgatgacatatgaatttgttgccagcttggagtagagaattttgcatctctcgtggttaagattttttttcttttatgtttgtatctttgggttaccacggaatgtagagtactggtgtataccaaactcatgcataacaaaagttatgagcgagttaaaattttcagagatagttaggctcataccttgtagttatagagaatcccagtatgctagttttatgtccatgtccaagcctgccagcaccagcagctccccagctcaagacttcaccctcctcttcagaggaaaatttcagaatcttaaaaccagtgatattcaaaaaaggttgctgtaatacaactacttgttgcactcaccggtagtagcaattgaatgctccgaccccaaagcaaccattttcactctagcgtcagccaagcagtccacctttcttggggtagaaactacttttcctgcccctaaaccaagtaataagaaaaaatactttactacgtactgattaaaagtacacaattgatcaggtgatagacttagactaccatattgccaaagtaaatcttagtaagattatccattcatagttggatactgatgcaaagacatacgaggcaaatagagcttaagtggtcatgtaaatctgcatgcgtatgaaattatcgtatagctcctagcttaaaacataaacacgttcaaaaaatttctgggaaaaagtgattttatgaaatgacagtacaaccatgtgttgccttaaggaagtaaagtaaggatatcacgttattacttttgccaagaccaagctggccacttgaatttctgccccaagcgaagagcttgccatccgctgttgggaacaaccaaacacaaaatcttagtgtaaattggtttcgacaattacacccatgcacagggtgtgcagcataaaataattttttttccaataagaagcataaaataaatttggcaaatataaataaaaagtatcaatgataagcctgtttatctcactaaatagaaaattataaagtggaattttgtattattgtgcactgcaagtagcatataatgaataatcttaaatttgtatacaatctacaaagaacaaacgagcagtaagatatttcagctaaggtatggattgcacagcttaggtctgggtagagtgcataattacagataaaattaatttttatttgaaaatggagcctattcaatatgtaacatacttccttaaatttagtctgtgtatccaccatccaatacaatagtaggaaccataactacaatcttctaaggagagtattgcagcaacatgcacaatttctgtagatttctatgtgatggttgatgccattaaggatgtcagtgggctaatcaattgttacacattgacccagcctagttcaactgaaagtagaccttttcactagcaatgaagaaaggtgcattgttagttgaaccagtgggtcataaaagggcacccatatgtcaactcactccaatccctattccctagataaacctagataacatgcacataatcatgagatctagtagtaaagtaacactaagcatcgtgaagccagaaatgatttgtttggttctattctcagatatttatggtcatttcattacaaaatggcaatgcttgaagcgacctttacgcagagaagtgtgaatgctgctgtgctacaatttacagtaacataacgggcctttaagtgtgatattatcagtatatacattcccttctcctggtcaaacaaaatcatgtcttgcactttttgctcaccagttactgcacaagaatgatggttgccagctgaaacttccacaactttctcatcaaagccagaaacttcaataggctcctgcatgcaaaagaaaagaactattttatcatgcacataactgacattgggaacaatgactacatagatgaaaataatcagatctgtagattccatagcttatcagggaaatgatctaagttgaaatcaaccaggagaaagactgaaagacaatccaaaacaatctctttatttttgacagatcaaaccaaaacaatctggagactacaaaaattttatatcaataaatgttgtaaaattgacaattggaaaatgtgtgtctgctttatttcttaagctcggggtatcaagatctgattaaaaaaaaaagtgatactgctcatacagtaagagtggtttttgcaacatgtaacaggagtcagaattgatttggtcaatccccattgcaactctgatatgtccagccagctttcgcttactgtgtaaaagtaggctggctcacaatgtagatgaaaatttcacatggaggcatgatgtacaagaagctcagtaccagggaatgagtcacggaggagcctatcccgagctgcccgaagtcgttgagacccgcggcgaacacgcgcccgctctctgagcaaaaccagcaggccaaaaatcacatactcccacattaatctcgattcaacacaatctctctctcgctcgagtaattacacaagcaggcgatttcaattcaggagtaccggtgaggaagagggtgtgggcgccgccgcaggcgagggaggcgggcgggtcgtcgtcgtcgtcgccggggcggccggtgaggaagaaggggcacgccgtggggctccaccgcgactccagcgcccccatccccagccgcccgtagtccccgttcccccacagcgccgccaccctccgccgccccgccgctggctcacccgacgagagcatcctcgccgcgcgccgctgcgaccgccacggccacggccaccgcctcgcccgccacatcggcggtggttgctgctctcgcctctcgcgctctcgcgctctcggctcgcggcgtcgggtgagtccacgtcggcgacgagaggctgctcctgctcgcgttcgcgcggcggaggcggagcccaaggtaggtggactggtgatggatgggcttggtgggccgtggagtgagagagaagaaactgggctggtccgttacgggctgggctggctgttgctcggtcggcctatcaaattggaaaaagtatactttgactcccttaactatggcacaagtatgattcatgatctccaaccacaaaaccgggtatatcgactcctccaactatcaaaactggtgcaaaatatatcccaggtggttttataagcggttttagcttacgtggtgcttacgtggcagtgttgacccggtctccgtcatacgtgtcgttgacatgtcacttatgtggcattttagcatcaaaacaaaaacaaaaatacgtgagaccaacatgtaattcacactaaaaaaaatagtgggacccaccgacatgtgtgccccacatgtcatcatcttcatcctttctccttcctctctcctcttctctctccttttccccttcctcttcctctttctgtggcctcctcgctcccctcgcgctcctttctctcggcccaagagcgccgccgcccatctgctgcgccgcaccggtttatgcctgaccgccgagctccggagctgcccgccttacctcctatccatgacgccgccgaaaaccacttcggtcctgacgccgccgcctgtcctggagcaccgccccgcacagggttcgacttcccactgtcgtcgcatccgggaccccaccggtaacgacccctcccaaatctcagcttgaggaggaagatgctaaccgtccaaccaccttaagaacaaacgattaaacaaaaacagattaatttagagccttgtgatgatgtgcaagcaaacggtaaaaaaatttgcagggataagaaaattcccaggagccgaatcagaaggggagggaagaacacggactgaacagatggaagaacatgtatacttggcagggtaaaccaatgaaaaaaagcaacagatgtgcccagaaagccaataaaagagagagaaacacacttttaataaaaggaaatgcttgcttaattgttctgaaccaaaaaatcaaaggaacaaagaagaagaggaagaaggacacaccaagatcagcatgaaaagaaggggagggggccgccgttgtctgccgcctcctcctggagccggtgccgccgagcttcttactcgccaccgcctcagccatggccatggccgtcaaggccaacacaaccggcgtcgtctctttctcgctcgtccttaagccgtcgcggggcgacttcgtcgtgcgcaagtggtttgactccgccggcggcggagacgactcggcggtgacgacatgtgaccgacatcggagcaccatcccgacactggaggcagcgacaagcaggggcggatccaggaacaaaaatttggggggctcaattacacagtttcttcaacctctagccatctagggacctttagtttatcattcatggtgaaaaaaatgaaggggtgctccggagggtatccatgtatcttgtgggtgtaggggggactcgagtcctccctgcacccacgttggatccgcccctggcgacaaacactgccatggcacaagaggaggaaggaggaacaggaagttgaacggggaagaggaaggagagagaagaggggagaggaaggaggaggaaggggatgacatgtgtggcccacatgtcggtgggtcccactattttttatgtgaatgacatgtcagtcccacatatttttgttttttgtttttattctaaaatgccacgtaagtgacacgtcaacgccacgtgggacgaagaccaggtcaacactgccacgtaggcgccacgtcagccaaaaccgcttccaaaaccacttagggatatattttgcaccggtttcgatagctgaaggagtcgatatacccggttttgtggttagaggttatgaatcatactcgggccatagttaagcgagtcaaagtatactttttcctaccaaattcggggagtgtattaaattttggcaagttatcttttgaaattttttgctatgatccattcattggctctttgcagctgagttcgatgcggttaactgtcaagcgtcaacaagagagcacattttttacatatgaatatgttgtgtcacattgtctttcgttatcggtttgatcaaatatagcgtggcaaccatatatctcttctgaggtttaaaaatatgaaacatgtttgttttatgtcgataaatctttgttccatgtaaaaacagggttctaacctactaaattagtgcttaatagagaaaatcttaggttgggcctgatatttttatcaaagtttcaactttttttaagataatgatcaaagttttactttagaatatttcatattcggtgtagctctagctctaggtgactaaagtagatattgagtatggggtcttgctaacgtcatcaatatcctcatgtactcatggaataggagtacgaggcagtgtgctagcggttttttcccaattctcaacattgggatcaaaaggcaggtgaatgcttggggcaacagaggtagtcgagcttcatgtgcagctgaggcaaatcttaagcttaaaagagatggcgagctagcaatggttgtagtggtggggaaccagaggtggagaagagagatataataaggtggtttaaatccaaaaaagataaaagtacccgactagtaaagatattgatattggatagtctattggatatagccctggtttgaagtgagaaaaagttatgtataaacataatttattttataatgtgagacggttatatggttttttgtgttcagctcacccttcttcttcgtcttcgatggccccctcaccatgaaaaagtaccacataccttccccatagcccttgtatttctatatgcatgcatattgtgttatcacaaatcaattggttcatagatatacataacttcaaagcgatcaatcaactaaagaagattaaattaccaatcatttcagaatcatgacgcatgatattgacctcattgatgaggtagagaggcggtttgcgtctcttgatcttaccgcggaggtggaagtccacgagctccttgtccgtcggcacaaagtggaagctaggacttaactgtagccgtgacaccagctcatgcttccagctcaccactagcaccgccgacccatcaccgtcgttgccgccattttccattatcggataatgtacttatgtggcttctaagttcttatggcaatcaaattgaaaaaaaaagaaaaaatatagtggggcattgctataataaactagtatttatatacgctaaaactaattgtagttattaactttttttggtaggttcttgtaaatgtttggtgtttccaagaagggaaaaagaaccaaaaagaatacttcctccatattttaatgaatgacactgttgactttttgacaaacgtttgacttttcgtcttattcaaaaaatttatgtaattataatttattttcttgtgacttgatttatcatcaaatgttctttaagtatgacataagtattttttatatttacataaaaattttgaataagacgagtggttaaacggtggttataaagtcaacggcgtcgtacacgggagtacagaggagttgaacccgaccgaggcaggaggttacgggttacctggttcgagcgacggaccgagaaaacaccgacccgagcctagggtttggccttccccatccccctccgccgcgccgcacgtgtccaccacactcccaaagccaaaggagataccccctccctcccttctcttcctctcctcctcaccgcagctatcggggagcgccgccgccgccgccaccgccgccaccgctaggctttccttccccttcccccaccagaagcttctcgccggagaaggaaaggaggaggagagatggcggagcggctgacgcgtatcgcgatcgtcagcgaggacaagtgcaagcccaagaagtgccgccaggagtgcaagaagagctgccccgtcgtcaagaccggtaatcccttccccttcccctccacaccctcacgcggtggggcaactcgaggaggcgagtggtctccccgtgccgacgcaatcgaggcgtagatcgatccccgggagaggcttcgccatttttgcgcggggtcagatccggggagatagggcgcggttgaggtttagggtggtaccctgtaagttttgcagcttctggggttgtgccacagctgtttgttttagagactagattggaattcttcatacatacacagtgctagtattagtttaattttgtgtgtgctgcgatatcatgtaaagttccagcttccaaacgagcacgcaagctgcggttcctagttgtttcataatcttgccgcttgatatgccgtgcgctaaggctggcgatatgagtttcctgttttgagattgtatatgtggtatggcgattttacagggaagctttgcatcgaagtaactccggcgtcgaagcttgcgttcatttctgaagagctgtgtattggttgtggtatttgcgttaaggtatgtttgctgctattatacatacgcatggaactaggatatgtctttgttctgtaatgtatgtttctcacttccgctatgatctttgttgcagaaatgcccgtttgatgccattgagattatcaaccttcctaaggatttggaaaaagatactactcatcgctatggtccaaacaccttcaaattgcacaggtattgatgtttgatttgaggagctgtgttgatatgaacttttgcatttttttaatccaagtattactgtaatttaggtgaaaccatatctttggatagttactgatttagcacttgcaggttgcccgttccaagacctggtcaagttttaggccttgttgggacaaatggaattggaaagtcgacagcactcaaagtgttagctggcaagctcaagcctaatttgggacgatttaaagtatatatttttacctcgtgcccaatttctctgttgctgactgttaaattatgtgttctcatagaaagttgacttccttcctttccttttatactgatacaagtaatgggaatccacctatatttgttgcagaatccaccagactggcaggaaattctgacatacttccgtgggtctgaactccaaaactattttacacgcatattggaggataaccttaaggtattgcattgccacttctttttatccattgtgtttgtccttcttttaggcttttttagcatgtactctgcgacagtaataaatatcttaatttgtcgtttaccatcactatgtgtgggctctgagtacaatagcatcagtgaggtatttgtttcagtcttatttttggttctatagcatcatacatttttctggtaaacttttgtatgcatgcaaacagtaacaacacatagcgtcagcaagatactattgatcttccacttatgcaacctgcattaaattatgcactcaaatattgtccgaatctcaggtattaaatattgctttgatttattacatgtcaaaaaacccttagtagccaaaaaacagatattctggcattggaatagactgtcgctatgtttgatattatcagtattgattgcttcatacttctattaacttacatgcatgctgacatgctctatttctctttcctaggcaatcatcaagcctcagtatgtggatcacattccaaaagctgtccagggaaatgttgggcaagtacttgaccagaaagacgagagaggcgtgaaagctgagctttgtgtcgaccttgaattgaaccaagttattgatcgaaatgtaggagatctttctggtggtgagctccagagatttgcgatagcagttgttgctgtgcagaatgcggaaattttcatgtttgatgagccatcaagttaccttgatgttaagcagaggcttaaggctgcacaagtcgttcggtctttgcttagacccaacaggtaacatattcgttatgttattactatgattatgtaaatttaaactttgacgaatgcaatatcaagttctatcctatgtattttcagctatgtgattgttgtggagcatgatttgagtgtcctggattacttgtccgactttatttgctgcttgtatgggaagccaggtgcttatggtgtagttactttgccgttttcggtccgagaaggtatcaatattttcttggccggatttgttccaacagaaaatctacggtttcgagatgaatctcttacttttaaggtaacctgtgccttttcagatttagatttttggctatgtgatgaaacattgtttttatgtatgttctgtcctttcagattgcggagactcaggaaagtgctgaggagattgagacataccagcgatataagtaccctactatgagtaaaacacagggcaatttcaagctcactgttgttgagggtgagttcactgattcacagattgttgtgatgcttggtgagaatgggacagggaaaactacattcatcagaatgctggtacgccacccttcctccgtaactaccctaatcttcagttcaaaatcaatcaactaaatctgcagttatctttctgatttgttatgaatggataggctgggttgttgaagccagacactgtggaaggaactgagattgaaattcctgaatttaatgtgtcctacaagcctcagaagattagcccgaaattccagcattctgtgaggcacttgcttcatcagaaaatacgggattcatatactcatcctcagtttgtgtctgatgtcatgaagccactgcaaatagagcaactcatggaccaggaagttatcaatttatcaggtggtgagctacaaagggtggcaatatgcctttgccttggaaaggtaaatagatgtttcttctgacaaatataatacaccatttttgtgccttttaaaagttttaagacttcatgacctgtctagttatatatatatatatatatatatatatatatatatatatatatatatatatatatatatatatatatatatatgtcacatactatatgctcat

SEQ ID NO: 60937 - DNA, 25732 bp, Oryza sativa
ttgctagatgacattggagttagatatttgtattgttgtatgttttacttaagcatagaatgactcaagaaataattatttttcctgtgggcctactgtcatggggtagatcataagaggagggagataaatcaatctgaaatttgtaacactgattagacaatggtcttgaatttggagacttgtagtgctacagatctcagtcgcggtgtgcttttctcataaaataacaatcaaagaatatgtcttgtattatttacttttgtttgcacttttgaagcctctgaataatggctatgaacaatccaattgatgatccacctaacatatccgtagtactttcatgtggctaagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagggctaagcacctaaatgctgtattgcctatataaatattgacttgattgtcagcttattgatacttgcaatgtggtatatgttcagcctgcagatatctatctgattgatgaaccaagtgcctatcttgattcggagcagcgcattgttgcttcgaaggttatcaaaagattcatccttcatgcaaagaaaactgcatttattgtggagcatgatttcatcatggctacctacttagctgacaaggtcattgtttatgaggggcggccttctatcgactgtactgccaatgcaccacagtctttggtatctgggatgaataagttcttatcggtaagttctgaatattaaatattgagaagagatccacaagtttgttgtaataccatctcgcatccttgtctttggttcagttgtaggcaacttcctcaaaagattaatttttcagtagagtttgacattctatatctgtttttagttgtcgaaagatgtcccacttctgtttatttttcagagtatttcatttatgttttcacatgctaatgctttctattgtttttccttttgtgcatgatagcatcttgacattacttttagaagagacccaaccaactataggccaagaataaacaaactggactccacaaaagacagggaacaaaagtctgcaggatcctactactaccttgatgactaatttgaaggcgtacaggttcctacagctctcatttatgctggagtagtttcatatcattttttaattcttattttcacttattaagtaatttcgtttttcttttgccttgctgtgcagaatcttcttgtggagcttcccgcccataatttgcccaggccttcgatgtcctacgcattacttgttcagaaggttactttgaagctaccacagcttgaagcatgctaaataacttggctgcaggagtgaagtggtatcatcatcagttataaggctgagcatgtgatgctgacacttgagttcttttgctggtttgatatatatgatgatgggaaagagagatgttactgttaaactgagcaactttgtcaggatcggaagattgtgaatttttgtgtatttttgcattattgtatcgtggatttaccaactggcacccttaaatcgttggttttataggcataaagtttttgagctgttactcatgttaccaatgttatcaaagttctctgagttattactgttaattcactttatcgagataataacgtagtttgtctttttttttattcagatttttaaaaatctgtagtagacaaaaccgaggtttttctttgttttgatcggatgccagattcatttgcttgtgtttagttttgttgtgtcaacgagaatgattgagttgcgttacatgcagattcatgttgtttgtttctccacaacttacagtcgtggaaaatttaaggttgcaatgtaagtgaaacttaataaatctattatttgcaagaagccaatattagaaaacaaactatgataagaaacctcaaaattaacgctaaaattaagttttggaatttaaattttgtttgtgaccattcttccaagtagaaaacgatagctccatcaaacaccataaaagttattgctcatttaatttcttgtcaaaattaaccttaccaaaattgatattaccaaattaattttggtattaataaaatttgggagcttttgttgcatttggtttgaccccttactaaaaattggaaaagtttttttggataggaaacttttagaattaccaatatttggtatggtagcaaatgataaagttacatttagtttgttaacatattaaaatttgataatgtcaaaacttgataaggttaaaaatggtactctatccgtcccaaaatacaagagattttggtaggatatgacatatcacagtattttaaatccatagtgataggaatgtgtttcatccaaccaaaatcacgtctattttaatatacttaaatggtaggatacgatatatcacagtcttttaaatccatagtaataggaatatgttctatccaaccaaaatctcgtatattttaatatacttaaaatgaacatgctctcggtgcataatacaaaggccttgttccagaggtgaaatgttttggcgtgtcacatcggatatatggacacatatttgaagtattaaacgtagtctaataacaaaacaaattatagattccgcctgtaaactgcgagatgaatttattaagcctaattaatccgtcattagtaaatgtttactgtagtaccgtattgtcaaatcatggtgcaattaggcttaaaagattcgtctcgcaatttatacgcaatatgtgtaattagtttttttttctatatttaatacctcatgcatgtgtcgaaacattcgatgtgagtaggatggacaggaagcttgtggcttgttagctcacttggctcggcggcaaggcccaagcccaagacaacagctgaacaacaaaaccctaggcacacgcaccgcatctctctttgtctcgcgaatcctcgtctcctcgatccccttcggcccttccgttattcgcatgttccgtatccgcagtgcgccgtcgctagccgctagggccgccgccgccatcgccggacttcccctcctcggctcctcctctaccagctacaaacctgcgtttacgatggaggaagaacgagaggtgcaagagcaagtgcctcaggttgcaagcgtggaatcccagagcaaacacatgagcgtgtcttgttggtttggctcgcgaatctaatgagctagctctagctttcaaacgagccgagccgagctgggtttctagctcgttaggataacgagttgagccgagccagctcgttatcctaacgagctagaccgagccgagctgagctggctcgctatccacccctagatgtgacagggttaaaagtttttgcgtgggaactaaaccgggccaaaatcttctcatggtcatgtaagttgggtacgtacgtattccacttttaaaacaacaaggtggctgggacaacatgatattactagtacgagtaattttctttcaacgtatatatttttataaccagttgattagaccaaaagatatcttgagatgagcttcctttcgctctctacttcacacttgttcaatacggtacggacagattttaaccaccggctgcctgcaagtagtaccggtgtgtccgtgtctgctcgactgctctccctctcctccccgtcttcctccctctcccggtctccccttcggttgccgcgtcaccaccaccaccaccgggtcactgccacgtgggccccacacccccacctccgcgacctcgcggccggtgagccgcactgcgcctcccctccgctgggtacaaaccgagtgaccgatctaccacctccacccaccgcaatcccccccaatcccccccacacgccgcgagatctcccgcctcctcctccacccgccatggatctcctccgcgaccgccgcctcggcgcgctgctggtggtggtgctggtgctggtgagcggcgcggcggtggaggcgtcgatccacacctacgacagggagccgttccgggaggtggggaacgcgttcctcctctccgggggcagcgagggcgtcgtcgccgacggggccgacctcgccgcccccgcctcctccttcatcaagtaaagtttcccatcccccccgcaccacacctccgcgtctcggtggttggaaactagtatagtagtaggttctcgaagccgctgccaagggtgagaggcatgtgctgctggctgctcggtcttgaatcgcctggggattaggcgtcgccggcgctgggaatgggaaatggggggcgaggcgtcaccgctggaggatcccgcccgcgcgcacggttttgctgagtgcttgcttgattagtggcaatttaacttttgggatttttcattttggcaagacattagtgctcagtttgtgatttatgaccaaatttataattgtgttgccgatgaagtaaaattcgggttgcttagatacacctaacattgaaaatgataaaatctgcaagttgtgacccacacattgaactcggtgctcaccatgtagttgtttgcagtgttttgtgtcaatattgttcactgcagttcattttagttttatagacttttagttcagctttgaacttcttgtgctgataagcagggctgtgctaccgccgtattaaaccgatgcaggttccactatgatcattttgagtaacatttgccatggattaggagaattacatagctagttagctactgccaatgtgaattacggagcatgttgacaagctgatatgtgggctcagaaaatcatttggttgatgctgtccttgtgcttactagctgtttctatctgttttattgcgtccatcaggctttattttttgtaggaatatgtatgggtttaatcttttctgggatctgtatgtgttagtttaccgatggaaagaactatgctccattcataacaattgtataatttagtattaaccagatgctgggttttcttactgtcaggttcacgaatgttactttctggagaactccggaatcagctgaatcacatgcaaaaatggcacacagtacaggtctggtacaggccattttatttgaagcagctgacagggataacattgggggatctgcctatggtggacagaggtccatatgttgtacccctgaccttgctaaactagagggctgcaaacaaggggaagtaatcaggagaccatcctctgatgatcctgattggccttatgtgctagatacacacttcagtggtagtcacctttctgtgaagttagaagatgaggtagttcgcattaccaagacaggcatgtacaacttgttcttcatttcctgtgatccaaaactgagaggccttagtatgagtgggaagacagtctggaggaatcctggcggctacctaccagggcggatggcacctttgatgaaattttacgtttttatgtcactggcttatctattggtcatggttgtctggtcgagtcagtatataagattctggagggacatcatgccaatccagaattggatcacactaattattgcacttggcctttttgagatgacactatggtactttgaatacttaaacttcaacagtagtggtgtacggccaattggaatcacaacttgggtggttactgttggagccatcagaaaaacgatttctcgcctattgatcctttctatctcaatgggatatggtgttgtccgcccaaccctgggaggactgacctctaaggtgttgctccttgggctgacatatttcctggcttctgaattgctggatattgcagaaaacgttggaacaattaatgacatttctgggaaagcaaggcttttcctagttcttcctgatgcctttttggatgctttcctcatactttggattttcacttctctctcccgcacacttgagaagttacaggtaagctatatttgatgtaatttttcttgtctgcttttataatgatgattactccctccgtcccaaaatataacaacttctacaccaacattctcttctcaaccaatcacaaccctccaccattcaattttctcacctacctccacttctcatccaatcacaacccaaacctatttaattctatctactttcttagtaactgtatccaactctaaaaatgcttatattctgggatggagggagtagcattttatccatgttttctcttttcaataaagtcataacatctgatgttttggtggtggaggaaataagtgcttgcaattcttttctgatgcgtaactaactgtgatctggtggagttactagtgtatgaagaacctatgatagtgatgttaatatcaaaattctaatggtgttatgtgtgctcacaaagaggacaagtgctttaaacagtgtttataatttcataaccaagtctgttgaaccatgccaaaatagaagtatgtattgtgttgcttcttaatcatcacctttttttattgctcatcaggctaggaggagctcagtaaagctggatatatacagaaaatttactaatgcattggcggtatctgtaatagcttcagttgcctggattggttatgaggtatgcaaatttgactttgttaatcaatagtgcatattggctcactgacctatgttcctggattggttaatcagtaatgtggtgcgtattagtctcttaagttcctgtaagctttatgaacatccaagtacgtcattatcacatggcattccaaaattgtgccctctgaaaacaacaaagtcttctttataatcaaaatttatctgctatttttagaggacacctctatcagaatgtcttctttgcactttagtgcttcactatttttatgatgtcctgataaagcacccatggaaaatttggatgattcattttttttcataatacttgggttctaagcctgatcataaacttcttctctgcatgagtgtgaaaaagaatcatggaagacattactcacttcatgttctgcaattttcttcatgctgatatgagagatggtttcattcatctgcagattttttttcagggaatcatctgttttatagcattatagctgtgataaataacctgctctgctcaacaagggcttcattttgcaggtctatttaaagcgacagatccctttagtgagaggtggcagagcgcatggatcataactgcattctgggacgttcttgcatttgttttgcttcttgtgatttgttatctatgggcgccatcccagagctcacaaaggttaaatctttgcctcttcaatgactggaaatgccatagtgaaagtagtagtgtagcttgaaatgacttgaaagtatctgtgttgctacttgtaataaccagcttatctactcaaaatgccgatagctcgcctggctgcctgccatcactagaaagtagtaatgtgtttttatacggcacaagaaggttatctttgaaagcgctctaaaattgacatgtcaaaccttgtccagatacgcatattcaggcgaagctgccgacgacgatgatgaagaatctcaatctctgacgaaggggaccgacggtgatgtagggatggtaaaggttgacaaggacagaagtggtggtgtcagtagtgctttcagcttggaagacgaggctgaggaggacaaaagagagtgacctgctggagcaagaatgctccaaggttcctgagctttcttcttctttttggtggtgatttgatcttctcttttgtaccttctcagttacacaggtcatgtagaagcgcaccattttatccattcctgcgaggatagtatgttcgtggtgttccatgtggagtttcacataggccaggatggtgcacattatttaaatgactacacattcacaacagtgtacatatctgtttttgttaccggttgtgcattgcctgatgtatcatggtatcatgtatgaaactggtgaacgcagtgtttgacagatctgtttgcctaattgactggaagttgcagatgaaaaatagccaaagtttttaatccaaaactccagttctcctgcactagcactaaccatccaattacttcaatgcttttggttccaagacctggcatcaaggtatttaagccataacagttcaatctttctattgttaaagcatcagcagattctcgtgagaagatttttcaatagcggattctatgcacgggatagataaaatcgtaataaaacactgttcgttgtcgtgagaagattttttgatagctggattgtatacatgagataggtaaaggcaatccagatcctctgcaggcagtattgctcactgacatgtggatcctacatatccttaggcccacatgttagtgaagagtactgcactgcagaggaccttgagggcctgtttgggggagctttagattctgagaagcagctgtttggtagccagcttctgaaaatctagaaaagctctgaaactcagcttctccagcttctgacttcttagttcatttttcagaatatgtaactacagattctcagaagctatggactgtttgggacagcttctagcacccaaaagctgcacctgggacaagcttgtttgagtcactcaggtaagagaaacaatccattttttttcagattttaagaaattgtagttataaattcagaaaataaactagaaaccagaagctagaaaatctagcttctaccgtatcctcaaaatgtagctaccaaccagttatttctcggaatcttaagctctccgaacaagccctttatcataataaaacactgttgtactctctagctgaagctgtgcgtgcagccttgagtccttgacagctgacgttaaacattccaacggcagatggcatcatggcaaacaggcaaagagccaaagatgcaggctgagcatataaaacccttgctggtcaagccgcggcatgactgacaattgcacaaacatgcgtcaaagaagtacaaggccaaggaaagatgattacaagtcactggttaactcgagaattgatggctgtgacaccgttcttgatctaggcacaagattcttcacttcagccaagcaattttctcatcaagaacgaaagagtacaaggatggcatgacaaactctggattcttacagagtaaaggctttgtctgattcttcctccctctgtagaacggtttgttctatgttgtgagttatgacatgctttcataaactcctccctatttacacaaatgaaatcaggtgagctccccttctaacttgggttcaaaatgagaacactgtaagcggtttgaacaacacaactaggcatctacaagccttaccttctgcaattctgaactagagtctagaggtcatgagttgacatgcttgtctaggaaagcgtttgccagatttctgaagctggtattagcatctccagccacggcatactctcttactgccttaagtacttctggtttcagaatatctttctttgtcgaagggttacacagataatataaagccccaagtgcatagttcacctgtgaaatcattggaatggaattattcgtataggagaaactacagaaaagtgaggaatcaataagaaaatctattttttcaaaagaacaaaacattcatttcagtaattggatagtgttgaagttatggtttcagaaatactaaccgtattcttcactgggctagataagcattgtatgaccaacggaattccaccgcaatgagtaatgactgaagcatttgctggatctgcatgtatacaaatagaccaataagattttaaaaaaaatctatgtttgctggaaacacaattaaaaagtgggaacattaaaagggaaaattgggagcttgaagtattgcattgctcaccggcacaagagttacagattccaccgatgccaaattcgataagcctttcgtttggctccgtaatgcagtccaagaacaattctaggatatttagctgagaaagcaaaacagatagacaagttactgaacatgatcgctaattcaagtcaatccttatagcacatgaaatctgcacaaactgttcctaaagaacaagtgtgcgagataacaacctggcgcataaaggtgtagttataaggatcatatgcgaaattcgccaaatttgcaacaattctctccttggactctgcgataacaaaaataaaatagaatcaatgaacaatgtttaataagcatccaatgccatgtaaactctggcgtccatgaaccgatgaacttattctactcgacagtataatcccgaattatattttcatttttaaaaaatgaactagcttatgctggcttttatcaataggagaaaaatgcagaaacaattcggctgctatggacaacctaacgacggacggtcatctcatcatgaattgggtttgcaagacgagaaatggaactagctgaccttcatccgtggcctcctggaactgggtgacgagatcctgacgaggcggacgcaaatcaaacggagaaaaaaaaatcagctgatcagcgcgaggattttgcaggataaaccagtcgaatcttttccatgagccaaaaagcaaagcaaaagtgagccaacctggaggtgctggtctctcggggtgccgtggcgtccggtccgctcgacctgccgctgcgcgttcgtgaacatcgatccccctccgacccggcagagagagagagagagagagagagagagagagagagagagagagattcccgatctgctcaccgcgccgccgtggttgggggggagaaacgctgctggtggtggtggcggagccgatgcccgcgggaattgggggcggtggtctcgacgagctccccacgcacggagagcctcggctcgcccagcggaagcgagggggcacctctcgccggagtgatgccgccgccgccgtgtttcgtcgagaggggtctcgccggaggggggatttgccgccgccgtgtttcgtggaggagagagagaggggagagcggggaacagctcaatccgggccgtacgacatcgatctaacggtttcggatggggacacgtcatgcattgaaacacagtttcgggctcttttttggaacgaaggattttcatgggaaatttatagggtttatactgctatatacgtactgtacagctcatatacggttagatatatacaaccataccatagatcaatataagagaagagcatgttcatatgtattgcagctgtttaccaccattgatcaaattcagttatacgtgagtcggatagttgggtcatatgcatagtaattttcgatgtaactatggaattattttatatttttccaatgaagctctttggttgaaagatctggctacaaaatttttattggaatcctttctttcctccaccttttaacttttttaggatttcaaacaggagctcaaacctcttggttttgatttcctttgaaaagtccaattcaccgtgtctcttcatctctcttctcaactctatcttaataatacgagtatctaaattccccatgaatttcttatgaagtatctaaatttccttcgaattccctgtgaagtatctaaacaaccgttagatatattcatgtgtcataggtagtgggccgaggggtcgaggccctagggataaggatagagtcggttggataggattagattggatcctccctccatctatataaggatggtttgtatcgttattctagtcaagcaatgaatcaagattagtctctcccaacctaagtccccttctcatccctagcagccgtcgccgcccggctatcctcccggcggtgtttacccccctatgaatcctaatccataacatcatgtgttttcaattcccgactttctatttctgcgtttttactatttatgtgtttttttcaatttctgcgttccaaaggagccctagcagcttagcaactctgatctttccaacgttgaagtatcagtgcatcttgtaatggattttgctcttcctttttttttactaacttcttacaaaatctactcttccttgcaatggaggacaaaacaatatttactgcaaaatcaaggcaacgagtagcatagtaaagctctcgtgtggttgcagcagtcacactttacaaaccattgtagtattgaactggtaacctagagctggcaaaatttgggaaaagaaatacagctgatgcagttgtacgtgagagacttctgagcacagctggggcaaacagattcagatgttagcttttgagcaaaccaaatactgttaggttcaagaactcagggtcttcttgttggtgtcttctcaatctgtgacgcggagtggctgttcattcttcacaatcaactcaacttgattctggtcagcccatacagctgcatccagatacccaagctcatataatttgtctagaacctcgtcttcggcgggttccagagcccagttaaacagctgtaattgatttgagaattgagacagtgtcaaagtgaatcaaggtgagtggtaaaaattgtgcatttcgaaagtgactgacctgtcgggggctagctctgttctccggattgcagtctggactaataccaatcccttgcaatcctagtcgactggctgggaaagcacaaattcgaacctgcaattgtaggcatagtgtcaagaataagcattgcaaaacaggcagcatggcacattgtcctgttgtatgcatcaaagatgtgtacacaaagtagtacaacgcaactggttctgctaatggatatcgtggggggcctccctcactgtttccggtaaaaaaaaaactcagagtagaatatttttggagacagagaagccctcaactcacaagtgtgatgcatcctgcatgagacaggccaacttgcacacgcccattcagaagaagcggtttcagaattgcacattcaaatttcagtacagttttttaaaacagattgctcagttatggaaaaggaaaagaaagaagataccccaaattcaggttatacagttatcttcactgtaaagtataaagagagcaacagaaaatgtattaaatttgagaagaaaaacacattattatgtactcagcttatgatcattttagtacatgaacacatcacagtgcttgcacctactacagaacaaaacatgtctgaggtgtccctatgttgcattgttcaaaatcatagtctaaccaagacagacatgtcatacggttttcaattgtaaaatcaacaatcagtgggggaaatgcttttcatacatgtgcagaaaactcaatagttctagtgatcagaataattttgcagaaccaaaagaagttatgacatactgtttcggaagcagaagttggtggcataaacaacgtaaggcccccatcaatgcacagcctgttccggaagaaagttgcaggcctgggagctaaatatctgaaacaagcacacccaattattcttaaacttagaacacaaaatatagaagatacatacagtacgagtgaggaaaagttaacatgaatcttacccaggaataaaagaggatgtaataactgcactgattacatcatcttttgagtcaaattggtcaaccagtaagcccctaggcctccaggacagctgagtaatagcaactgatgagaagaagttaagtgttcttaattattaaatccagttacttgtcagaaaataatgtagcagaaaatacacacagcaaatatgaataagcaatggttgaacagtatgaagcttaccacggatccttccgttgcacctaatgtgcacatcatctgggagaaacctgtctagaacatccttgagtacagcctgctcaagtgcacaagattacaaggttaaaaacatatcattcaatcagccagcacatgaactatttagtgacttgagtgccatatatgtctgtcgccttcagcgtattttttaaaggatacaccaggttactcatcacagttttctcgaattattacagtctaaacaccaaggtattgcaaagttgaaacatagttggcaaattggtcataaataaaccaatgatctatcacacatatagttgggtataatttacacaggaagcaaactcacatgttggccgcaagtataattaaaagtaaacaataaatggaaacagaaaacttaccccaaggcgaaaggctgtcccattgctccgacagttatcagctagatccttggtcacttgcaaagcatctcgcatcgtgttcccagatgcaatcactgcacagattatggcaccagctgatgaaccagctaacggagttctttcctaatgtaagtcccagataaagaaaccactataagaaaacttgctaaaaaaaaaagcagcagcatacatacaaaatgtatcacacgtaagtcctaaaatcacaagcataggaatgcagaatttccatgcataaaaatagcaggcaatgttaccacctagacagtacagtagcataaaaattgagagctctagccagccatggcaccaacaagctactcctactactcctactaagctaaagagaccaacacggaaattcgactgttgttagccacaatttcatctcgaaagtaacccgctcattggctaaagagaccaatgtgaattggattgttgttagccataatttcatctcaaagaaacaagccccaatagctaagcagacaaacgtaaattggattgttgttggccacaatttcatctcgagagagaaacaatctccactatcgtaggcacacggatctcacaattcatctgagcagaagctcctgtctcctactgcaaaaatcaagtacgcgttcgcgtagaagaggtaagagagatggggggtggacgcgcaccgtgaggtagcccctgtcgatgaggcactgcgcgacgccgatgtggtaggggaagagcagcccggcggcggagaagctgaacccggggccggtcagctcccgccgccgccgctccgcctccacgtcctcgggccgctgctcccacaccaccccgtccttcgcctccacctcctccaccgccgcccccccgcccctccccgcgcgcaccagcagcgccgccagccccaggaacacctcccccgtcctcaccgcgagcgacctcttctcggtcccctcgggcagcggcggcggctccgggtcgcggcccgcggcggcgcgggcgagcatgaagcgacggaagccccgcggccgcgcggaggcggaggagggaggggtggaggaaggtggctgcggcttgggagggaggccggaggcggcggaggagaggagggaggaggccatgggggctcgccggcggccgccgacgacgacacgtgtgcacgcgcggcgaagcatctgctacgtcgttaattcgtttaggtgcgtggaaaaaataattaaaaaatcgatgtagttttcttgtttctgtccttttgttttcgattttattttccgtgggcaaacgaaacgacacgtgtcgctgcccaagtcgatgtacgtcgtagctttggatagtagaactccgtatgcaggaatttttcgtgtcgtggcattggtatggctctgatcggaagtagtatttagtttcggtatcacctatatatttttcgacaaattttctcctaaatatttgacagatataattatagtataatcgtaatataatcggcacaggtgataaccagaggagacgtggtgcgcgttcaagaagctggatcgatttgtgtcgcgactccgtccaaatcgttgtttatcataaccttttgaaagatcgggaaccctagtgcacatcacaccctaattcgatgatgaagctgttgccctccacgctcaagctgtcattgtcctcaacgtcaaagggctggtgcggtctcttcctcgtcgtcttcggcaagtacgcgctcacggatcacgtcctcgctgacaactctcacctcaaccacgtggattgggcacagatggactgcgtcgtcctcggctagctataaggcacgatctccgccgacttgcttcaggaagtcatgttggccacggctacggctcgctctgtttggtgtgatctcgcccatcaattcctcggcaaccaagaatgttgcaccatcaatgtcaacgccgagttccgcaacttctctcaaggcgagctctccgtcaccgactactgtcgttgcctcaagtccatggctgacacgcttagcgacctcggcaaacccgtctccgatggtgcactcgttctccagctaatcaccgggcttagtccccgttttggcaacatgcattcacttttgtccatgtagaaaccattcccatcgttcatggatgcacgctctcagctcccgcttgaagatatcatgaagggctctcaaccggcagaaactgcttccgtgttcgtcgcagacaccgtcagcggcgcctctcgtcccgctagcagcaacaacggttctggtggcgttccccagaactcgaccaacggctccgtctccggcaaaaacaactcgcgaaaccacggctgtggccacagcaactccgatggctccggcggaaacaacggaggtggctagggcaacaccacctacgcaaacaaccaaggccggcccaccacctcccccatgaagcaggccgctgttccggcccagcaccaggcccagtggccgtccccttacaattcctaggccgggacaattcagatgtggcctgccctggtcggtgaggactttgatctgtgctctttgtctagctcttgttgatcttctcataaaaagggtaaaagatgaccaataaactaaatagtgaactttcgatccaccgccgcaggacgcctgacatgatgaaattgacggaattgctcgatagggcaacggaaagagattttagatgctaataaagtgaatgatgaactttcaatgctataaagccaaaaacgaaaacttttgttactataaatacaattttgccttaaaactttattgtacgtactttctatatctaaagtaatgaaagaaacaatctttctcgaaagcacattgggccacgtagtgttaaaaataatggccatcgaatgaatgcatcgagaatggatggccatccgatcattaacgacatacatgcggtagaaaaaaaaaacatgccgtatgcacttccctcccgagccttatagtgtctcctggcaagaataaaaagaccactgtatgtgaaagacaataagttatactagtttatgatgactataaccatcctgttattaatggtgtggatgaaatcttatctataatgtttagaatttgagtattagtttgtgcaaaaaatagaaatgctaatcaataacagaaaattttaaacagtttgctattgtaagatatacttgcaaggatgattttgtaggcagtggcatagtagaaccctttgtgtcattgaaatgaccatatgtgttattttgagcaaaggcatgatttaatgttgtcattgttcttacttttctttttaattcctacaatatgcatgtgtacagccctctggaaattctgcaacccaaaagccagaaccatgtcaaatgctccctcctgtgctcactcagacgatcttttaatccttgagttgcatgatcttcatgataacaactgaagttaacttacttttatgaagtaatttgttaatgtatataatattgtacgacttagtattataaattgcattttatcttattttttgttaaataaaaacacattatatgaaattacattcttgatgagtgcttttttttttcttctagcagctgaacttccagccgaaggcacgtgaaccttcttgattcatcctttttttttttcttttcatgcaaccattcctcccttcactttcaatcctatgtgccactgtgccagcttcattcaccatatcaatccaacagtttatatatttttcatgatgtggctcattctggagcgacaatacattttcattcgctagcggcctgccaacgacataaagattgctatgtacacgatccaatcgtccaacacgcatatgactaagtttaatcaatggttaccatgatttgaacctctaccctttgattaatttatggttatacggcttcagtcagtcttatgtggatagcacaacttgatcgaatgcatagtgagactctcgatacaaacacacgaagaagcaaaagatttttctttgtgaaagatcaccaatcttaatttggagccctcttggtcgacttgtgtaaactcattcagcatttggtattcgttcaagaaaaaatttaattcgttcaccatttggccaccatcccagaggtctcactttggagaccaatccccatcgggatcgtcgccaaattgctacaggtcccaagtcaattctctctcgaggattggcctggatccgatcaagattaggcttcctatgacagcgtttctccagcttccaggtaaataaatggacgtgcctcattcccctaggacgtcaacttgatcagccactgttgtcggttcagtgcccttaaaacttaaaaaaagaaccgatcatttcattagattaaaccctccatcaacattggttaactaatgcaagtactagtattagtatacaataatatctctcacattttgtcggcaagaaaattgcaactggagaattggagggttttgttcctctaactacaggattgtcagtgtcaggacactaaacacacggtcgtggccttttctggaaaaccggaatttcgctggattttggtagtacggattttacgccaaacagcgcaatttgttcctaaaaaaatgttaatttcatttcttgaagtcactcgtcagtacagcatgttgtcttaggcagtacagcatgctgtcagttcagagctccaaaccttaaaacacactagtatttctttaagcaccttgtcagtacagcactgcactacaacatcttctcagttcagccacatactccgtaaagcctaaactgactggctgttttaagtttaaaaaccattgcaatatttgaaataaatgttaagcatctcgagatctgcaattcgattgatctttaatcttttgtcagcagagcaatttgtggcttgatccgggatcgggtgttttgtagtaattcttctcgaagctggaggtgttttgtagtaattcttctggaagctcccgtgatccgaagctggaggcattagaaacagtttagccctgtttagttcacaaaacaaaaatttttacactatcatattaaatgtttggacggaatattaaatatagaaaaaaactaattacacatgattgcgtgtaaattgcgagacgaatcttttaagcctaattgcatcataatttaacaatgtggtgctacagtaaacatttactaatgatggattaattaggcttaaaaaatttgtctcgtaattttttgacgaaatctgtaatttgttttgttattagactatatttaatattgtaaatgtgtgaccgtatatccgaaaaatttcccctgctaaacaatgccttattttctaatgagcaccgactcaccgacaattctgatcaaacaagtctctgaaatgagatcagaatcaaaagcattggcaatgcaacagtcatgtttcccactctcaataacaagaagcaactgaagtttatttatttttatttgtttttgctttgaactgaagatttcattcgaatccaactatagttttgatgatcatatatacttcacaaaaagaagtaaacaaaggtacaaaagcaagatcaaaagcagggtagatttgacttgaaaagatgcaaatttgggccgaatttatctgtccctgctattaccagcactgataatttcattttcttttcttttttactgtaacgaacgagagagaacgaaagagctaggcgcgcgtccaggccaaggccggcggcggcggcgccgccgccgccgcgtcaccgggcggctgggtagtcgaacggcagcggccgcacctcgtcggagagcgggtccttgtggcggtacccgtagttccggagcacctggtcgtcggcgaagttgagcgcgcggttcatcccgtcggcgcagctcttcttggagtagatcttgttcggctcgccgccgcacggctggcacccggtgaagtgcgtcacgaacggccgccgccacccgctctgcccgccgccggcggggcccgggacggcgcccctcaccgccgcgttcctcgccgccgcgtaccgctcgtgctcccgctccgcgtgccgccggcggagatgcgccgccgccgccgagggccgccgctccgccgcctcgtacctcgccgcgatgtcgtcgagccggtcgacgacctccacccagtacccctggaagaagtagcccttctcgaggtaggtcttggccccccatttctcctcgtgctcggagaggaggtagacgagcgccgactggtcgtcggactccttgtcggacttcccccggagcgtgtcgtggagcacgctcccccacctggcgtactccggcgaggcggggcccatgcgcgcccacgcgtccatgaagtcgagcgaccactggcagttgcggatgaggaacacgccggcgttgagcccgacccacgagcgctcgccgtacacctccttgttccagccatagacgacgaggttgtgatccttgtacttgtggagcgggagggagaagtccatgtcggtgaagacggcgtcggcgtcgacccaccagacccactcggcgtcggggtgggcgagcatggcggcgcgcacggcggggatcttggcccagtaggcgagcatcctgggctggagcagcgcgttgttgtagaggagctcgacgccgtggaggcggcagtagtcgaccttgttcttgaggaaccggaagaggaggtggtcgccgccctcgccgcggcagggcggcgcctgcgagccggacaccatcaccacccgctccctccccgccgccgtcgcgttgagcccgcgcgggtaccgcagtcgcatccacgccgcccgcctcgcgtcccacccggtgatccccccacgccgcccgacctccacggcgtacgacaccctcgagtcgtcgtagaacgtcctccccgccgcgcccggcccgccgcgtacgccgacatcggcgtcgatcgccgcggaggcggcggacgtggaggcgaccgacaccgggagggagcggaacgcgacgaggttcgtgacgggcatgggcgacaggaacgacgccgtggccagcagcacgagcaccgccgccaccgcgcccgccgcgaagacgagcgcgtcgtgcacccgccccgccaccgccagttgcccgtgctgcgccctcgcccccgccaccccgccgccgcccttggatgccgccgagacgccgaacggcgcggtctccgatgccgccatggccggtctcgcctcgccgaaccgaactcccactctactcgcgagcggcgcgctcgcggtgtgtgtgtcactgtgtggtgttttaaagcggaaaaggccaaaggcgtctctctcttttgtagtatagcggaggcagcggaaagcggaagcggttgtggacttgtgctgctgcgcggggtgcggggttggttgttgttttgggtgtttttgctggggtttttgggcgttttcgcggtgattgcgtgcgggtgaggacgcggctcgcggaggcacggcggcgaggcgatggatctggctgtgtgtgtcggccgtggccgcgcgcgtgggcacgtgacggtgtcgcggggtgtgccgtgcgcctctaaccccccggccgagtcacctcactcgttttttcgcacacacgctttttcaaactgctaaacggtgtattttttaaaaaatatttatatacaaatatcttctatctattatatactaaaagtccattaaacttcttataaacgctctcaagccgccacgtggtctcctataaacgcttctaagtcgtcatatggcgttctaataaattagagaaattcctagaaattctaagaaaaaagcaaaacatctgtccatccgttttcacttaaattggtggacccattatttcaagccgtcagattagtttaaaaaaaatctttccacatccacctccctcctcccacacgtaaccctctctccccttttgtacatactctgtcacgtaccatgtcaaaaaaaaatctaaaatcttcagatacgtacgtgcagcccacatatatctccttttctctcaacaccctattggcctattttatagctagcaattcaacataaacatggtgagttaaatggtcacaatttaatttagattgggagtaactgataacttaagatcaataaaaatccaaaatattctgaaaaaaataaaagttaaacattgaaccattgatttacgcatatacaggtgaactattattttcaatcattagattagatcatactaaagtaattaatttctctctcctaatctcatgcgtatttgcaagagagaaaaataaatatatactattctcccggagaaaatatacgtatgtttatatgcatgtacaggagactattatttgcaaaaaaaaaacatgaatatgtacgtacataaaaaaaatattaaccatgtccttctaacccttaaattagaaagtttatacatgatcagtctaccctctgctgtggctcctttcgatctctccagtttatttcctagggtcgttgttgactaggctatatcttatatcttatatttgtgacagttaatttattattaggagccaacgtatctgagatcgttgatatgcttacccagtccaaaatgaaaatattggttaaagggtagtctaaaataaaacattcataataaaatatggcccaaagtaaaatttgtgacatatatatagcaaattctgattaaaaagttatcatatggaacaatattctagccaatttttatatctttcttatccaaataatctcaacaattactccatgttttttaataactgattgtggatattatattcatttacaacccactttttctatagaaaaattataaatatgttaactatcttttgaatgaaaaatattacatggaaccacattctatcacttttcatattattatacatagcattaacaattagcacaaataaacttgataacatatattgttccatcatatattaccccacgaacatgcatagatgaattagatcaataatacgaagaaaagaaaaatatcaaaactcatattacctcgtatgttcatgaattattactactcaagcagatatttttccacgtgtttctcaccattgaagctattagattatttgaagtagtatcgaatgatcaactctgcttattttcagaagagaaaattatatctgtaccactaaaatttagtagaccaattaacaccataaacaaatgtcaactctattccataaatggactcaaaacttttaaaaaaaatgtatcactttcatcttatctatgtgtcattccctgaagggcaccaagcattgataacatagtttgctacactactatacgtatggtgggggtatgcatatgactaagttgaggtgacccagtgagaggctactattcgcaataaagttcaaatggcttacttaccgatgtgattctttaactgatagtgaattaggtattaaaattgtgctccacactaatcttgaggagaacaactatgtcgatacgggacacatgtttcaaagtataagagaagaaagccttcgtggctacagtcgacttcacccattagaggggcatttagatcaaatttaatggttttatcccatgaattggtaggagtaatatttcaaaatatttatgcatatatttaaacacaagcgagacatgaacaatttggtatgaagtagagatgatctttttgttgtgtctagacatttatttttatataattataggtgatctatggtccttataattaattaatatggtgagataggatttctttagcattatttttataaataataaataaacgtttcttataattaatatggtgaagtatgacttcttttagcaatcttttataaataagttggccgcgcatttgcgcgggcttccttcctagttatatactaaaagtccattaaccttcctacaaacgctcttaagccgccacttggcgctcctataaatactcctagatcgccatggcactgtttaatctcaccgtcgattttcacttaaattggtgaacccggtattttagaccattagattagatgtattattttaaaagtaatacttttcctcctgtcggtgacatggggccgagggtatcgtgactagaggtttgggtagccgcggtcacccacgtggcctgaccccctcgggggggtcgggcccgaggatgatgtggccacccctccctctgtctccccgaggggtcgggccacccctgtttcggcccgaggctagggcgccccgaccccctgtgattttggcgccacatgtatgggttaggtga

SEQ ID NO: 60938 - DNA, 1398 bp, Oryza sativa
gatcgcctccaaggagccccagaccaccgcggagctttttcagctcgcggaccgtgtggctcgcaaggaggaggcctggacctggaactcctccggtaccggtgtggcagctccggccgcccccgggtccgccgctcggtcagggcggtgggacaggaggaggaagaagaggtcggcccattccgacgacgagggtcacgtcctcgctgtcgagggcgcttcgcgggccacccgaaaggggaggcctgcgagcgacaaaaagaaggaggctggcgctcccagcagggagcgcccgaccggcaagtggtgttccgtgcacaacacctccctccacgacctcgcggactgccgtgtggtcaaaagtttggctaagcggacgaggaagtgggaggaggagaggaggcaggagcgccgtgtgggcaaggccccggcgactcccgccggcaaccggcgaggtgaggccaagcagaaggccaccgccgaggacgtcgacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggtgggcgcggtggtcggaggttaccctcaccttcgaccagaccgaccacccgccgtgcatttcccggggaggacagatcgcgatggtggtttcccccaccgtttgcaatgtgaagttggggcgtgtcctcatagacgggggagcagccctcaacatcctttcccccgcagcctttgacgccatcaaggccccggggatggtgctccggccgtcccagccgatcatcggtgtgacgccggggcacacttggccgctaggtcatatcgacctcccagtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgacgatgccgggccccggtggccccatcaccatccatggcgacctcaaagtcgcgcttgcttgtatggagcagcgcgcggaccacctcgccgcggcgtccaagcccgcgggtggtgacgagaggctcagcacctccgtccctgccgccccgaggcagcggatgatcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcctggagaccggcagacatgcccggggtccccagggaggt

SEQ ID NO: 60939 - DNA, 5452 bp, Oryza sativa
tgcgacaaagctaatagacaaatgcatgttctctatgcttgaattgctgttattctactatcatttttcatttatacgagttgttcaactgtatcatatttgcatcaagctaacagtgacataacttgacagagggcctagagaagcttctcacattactctgttgactcaaacttgtttcagccgattcttacaattccgggatccacgtgcccaaagacgacatccgcttgttgatcccatggttgtttcagagatccggcgatgcttgaatgagggaattgagttccaaggtgagctattgaattttcggaaggacggtgctccactgtacaacaggctaaggctcattccaatgcatggggatgatggttttgtgactcacgtcattggaatccagttgttctctgaagctaacattgatcttagcaatgtatcatatccagtgtataaacaacagtccaaccacagacccaacattcaagagatcaaccctgcttctcatgaacatattcctaagattcaaagttccgagtactgctgcatcctccagctctcagatgaagttctggcgcacaacatattgtctcgcttatcgccaagagatgttgcatccatcggatcagtctgcactagaatgcatgagttgaccaagaatgatcacctgagaaagatggtatgtcaaaacgcgtggggaagagacgtcactgtgaggcttgagatgagcaccaagatgttaggatggggtcgtcttgcaagagagcttacaacccttgaggcagcttcatggaggaagtttacagttggaggtcgtgttgagccttcccgttgcaacttcagtgcctgtgctgttggtaatcgccttgtcctgtttggaggtgaaggagtcaacatgcagccaatggatgatacctttgtgctcaacctggaatctgcaaagcctgaatggcgccgtgtcaaagtttcagcttctccacccggccggtgggggcacactctctcatggctgaatggctcatggctagtggtctttggaggctgtggacagcaaggtttgctcaatgatgtctttgtccttgaccttgatgccaagcagcccacctggagggaggttgcaagcgagggcccaccattgccgaggtcatggcacagttcatgtaccctggatggatcaaagcttgttgtctcaggggggtgcactgaatccggtgtgctcctcagtgacacattcctgcttgacctcaccaaggaaaaaccagcatggaaggagatcccaacatcctggtcaccaccatcccgcctcggccacaccttgtccgtctttggtaagaccaaactcttcatgtttggtgggttggcaaagagcggctctctccggctacgctcctgtgatgcctacactatggacgctggtgaagacagcccacaatggaggcaactggcgacaaccgggttcccgagcatcggtccacctccgaggctcgatcatgtcgcggtcagcctcccctgtggacggataatcatattcggtggctccatcgctgggctgcactcgccctcacagctgttcctcctcgacccagcggaggagaagccgacatggaggattttgaacgtccctggccagccacccaagttcgcctggggtcatagcacatgcgtggttggcggcaccagggttcttgtcctgggtggccacactggggaggagtggattctcaatgagctccatgagctgtgcctcgcgagcaggcccgacgaagatgagtgattcccaactccattgcttgttcttatttatttagatcctatgattattactgatatctgttgttgtcacaaccctatgtaatagtagtaaaaaagaaacaaaaagaggattactggtagttttcatccttagaagttaggaaaaagatctgaaaaaaaagttatgaaataaaggtttgttctagtttttttttttgttttcttcagtttgcgcatatctctgctccatatgttctgatgcaatttgtgtcaatgcatgtactacccattagtacatgttccattgttccaaagcacacatattcttggacggttatagataaaaataatctctcttcaagtacaagttagcgaggacttttgtaggacaaaacctgcttggagatatgccacacgtgtggtaatcttgttcttataaatcttaaggtttgtgtacactctgtgctgctacctgtagtaattaaacatctataccagcatctctgggcgcttgtcgaggcggcccgaaaagcaggtaccaaaggagaaggcagaggtatgaggtatccgatgtgcagattatatatttgcggcgtttgctatctcggtctccgattcaaatgcagcgaatcacggacaccagcgtgcggcgagcgaggtgccgcccccagattgtgggcatcagattctactgctaaacagaaggctgcatatgtgtgctgctttcaatggagagggacatctttttttgaccacaccccaccgacgtccagcttcatcagatcctgtgattctctctgagcaagaagaaaagaggagaaaatcagatcatgttatctcaagtctctgaaagaagaaaaagaagagagaatcggtgattcggtgcacaacgcgccccgagctttcctccgggtcatgatgctctttggtgttcaagggcttaacgatttgtaaatgttgttagggacaaaatcgaaagaattaactactataatttataaagttgataatcagatttaaaacagtatttaaaaatattatatataaagttcacgaaacgtgtcaacctgttcatccgttcatcagaaagctggcagacagcccagaactgggatcaccaccagaattcagaaagagtaggaaagattttgctacaaacaattccaggcttgtcaccatcgaaacaagctggcagatagcccactggtcaaattaacagaagcagcaatgtcatgagattacggtgaactcaagcatgtcaccatacagacaatatttttttgttctctaaaacgagttaagcaagccaggtgaataatgtcttggaccaaagaccctgagacaggttcaaccaaacacttccaagacggtcatacaaacatactgaaaatgtcttgtcaaacatggttaatataacagcattctaacagtgcagaatagtagggtttttcctgtggctggcatcgtggaacaagaaaaccaggatccagccatcatttatcaactgaacaaaagcgtgacccagaactacttaagtaatttaagaacatcatcgtctcctccgcgatggtgcgacgacagttcgtgtactagaagatagctactgaaagccgaagacatcaatgtccattgccccaacaacaacagatggtgcatcagactggcgtccgaattcatctcactgatccccaggctcttttggagctgcggcttccttgatttcgtcaccaccatcatcctgcagaaaagagaaaacaaaaaaactgatatcagaaccacgaagataggacagaaacgatcaaatggctcaggaaactcacattggcatctgaagtccacagagtcaagttgtcacgcaggagctgcatgatcaaagtgctgtccttgtaggattcttcaccaaggctgtccagttctgatatggcctcatcaaacgcctacaagaaacatggattcattcaaatcatatgttccgtgttctgatttttaagtgaatgtcaaataaaatatgatcacactattacttaagaacagaaacaaccttcgcatcttatatagctaattctacttatttgaagcaactagaaatgtatcagcacttagaacgagttagtcacaagaattctatcagcacacagaaatggcataattctcacttctttaccgttccaagctccaaaacaaaggtacactactttaaccatttggtttaagattgtgaaggttcaacatgatgcaaagtctaaatggaacatgcgaaatttctgtcaaaattataacatgggtatatggcaaatgaaaattatatagacacaaattacaagaaggaacatcaggagaatcaagaaaataaaaatatcaaccatttgatcaacatcaccttgaaagtttacagtcaaaatgtaacatataagttatacatcattcataaactgtatctcgtcatgaaaatcagccaaaaaatgcatccaacaggtgccaagggatttgaatagtacgttttgggatttcagctacagaaacaacctgattgcagcttaagtttctagtataaattaatttatcattcatgcactcacaaagtagcatatatcttcagaatgagcaacatggatgccttttcgataaaaagaaatgcaagtacaacttccactagaaaaagtcagctttcatgcttatcaaaagcaaagaaaaaaagctccattcatccaccatgatatctccagtataaccagtattccagtagaaagcaggtccttaatggtacaaaatcaatagtggataaatacttggcatgaaaatatatcatacaaagaaatgtacattgaagatgcatgatgcaactaacagaatagaaaattaaaggggaaaatggaagtggatgtagaagtagagtaagcagacctgcttcgcgaggttgcaggcacggtcaggggagttcaagatctcatagtagaacactgaaaagttgagtgcaagcccaagccttatggggtgggtcggagccaaatctgcgagagcaatgtcctgccaacacacgcaaaacaaaaaactaaattcaaaccacaagactaaccaattaaccattgcatccacatgtacaaaaaaaaaacatattatcacaaatccaacctgagcagccttgtatgcattcatggtgctctccgcagcctgcttcctctcgtcgccagacttaaactccgcaaggtaccttcacaaatcgtcaccaagagaaatcatacatccatcaagatgaaaaattttcacacctttaatcggtaccaaactcctaggcagcgccaagatccccaagaatatgaagaaaactagcattcaaccgctccattaacagacatcacatctaattctgactttttcaccgccaagaggaaatgttaacatcatatataaagaccacgacttaaacatagacctgtacagtaacaagggatctcatacacctatcaacccataaaaaaaactaccattagatcttaaatttggacctgcacaactcaaatcaaatcctaccgtacaaccttaattaacccagagaccaatcatataataaacaaaggaaaaaagaatatcctagaagttaatcacacccccaataactccctacatgttaccttcaccgacctaacaaatcctcctatctcgaattcttggtcgattcgccgcgcgcacatactagatcaag

SEQ ID NO: 60940 - DNA, 12949 bp, Oryza sativa
gctttggtggggagggggagtggggattcatttgaggaggaggaggaagggcgtgggtggagggtggggcccgcatgtcagtggggggacacgtggcggtcaaggggagcgggccgtgccgcgaggggagcgggtgcgggcgtgtggctgggggggaggtgggttgggttcgggggggacacgtggaggggttttagtgggtgggaatggtgtttgctgtgtgtggacggtgtgggtatgataaagataggtttaggttttttttttttttgcgctctttggtgatttggggtttttgctatctctctttttttaaaaaaaagataatattgtagttctggttagctggaagtctgtttttagattttcatttagtgcaaatgtatatgtatattttttaaaaagttgttttataacactacaattataacaacttttatgttggtggagttgtaatttatgttgtgattgtcttaaaacgccattgcaatattggccataaactttatattatgtatagtaggatgttttcttcatgcgtgcttgtaatatactccatccgtttcacaatgtaaggctttctagcattgcccatatacatataggtgttaatgaatctagacacatacatgtgtctaaatgaatgtgagcaatgctagaaagtcttacattgtgaaatggaggaagtagtaaggctctcctattatttttgctccttttatcgttagattggcttatggcttcttccttgcttgttaattttccataacctcaagtagactgggttatttatttatatctaccactaagaggaggaggcagggcgaggagaaagatgtgttggccgtaaggaagagggagtaaaaggtgaagtagtctatcgtccttggaggcagtgccgtggacagcgtgatgacgataagatgaggcggtttgcagcttttttgttttcacaacaggggcgtgggagagtaggagcccaggcctatttgtgaaagaaggtttgcaacatctccataaaaatggaatggctcatgcatatttgtttcatgacgtgacacgataattttgcaagaaactttagtgattcagtgttctagataagatagctaaaactaagccaactattgttttatagcgtccgtgtaaaacaatcttctcacctctaaaatcagatatccaacacccctaagctattcaaactattcaatttaccccatgtttaaagtagctgtgtttgcctatatatcattgacgtggtgaaaaagtctaccacatcggctaacatcaatgtttggcgatgccacaaacaaagttatgagatagtaagaagtaaagaatgtcatatttgaaaacaaaaatgaaagaatatgctatatggaccgcaccataaaaacacagttctgagtttgtactcttcatatatcttttactaaaggacacaagctgacttttataacagaatttttactaggatgaatgagccaaagtggacacaagatcttgcctgccatccacatgaaaaacaaaactattcctcttcttcttcttggattaaaagatgatggatgggcccaggaaagaaacctggcctagaaagggccggccgggaccggagcatccgatctcctgtcaaaaccgacgcccatcatgatccatgaacaatgctaccctaatcaatcaacatgcatatgcaagcatggctaatggtcccacggagagatcgatcaccaacccgaccggctgaccccacatccatgcatgcaatgatgcaaatcagcatatacatgaatacatccgtccatgcggttgagctaacaaaatgatgaaacgagatgatcgccagattaatccattgtttacatgcagccaaagtacaatgacagttgacaaccttcaatctgcaggcaataatttacacttttcttttaaataaaccttttttttcctcttagaaattaaaccgaagctgtgagcaagagcacatcatggtcagttcttggaagtcttttgtttgacacacacttgaattgctcccattttttcccaaccaatttgccacctaccatgcctatctgcacgcacccgtcgcgcggtttattagcctcttttctcctgcgaatcacggcgagctgatcagcgattaggcgaagcaaacgtaccaaattataatgggtgacgcccagcggcggcagcttctcctcgtcgccctcatgctcgccgccgccgcagaccactcgctggccggcttcttcggcggcgcgccgccggcgtctggtcccgccgccgccgccgccgacaacgacgaggtacgttagagagacatagtatcgttaattactggaaaggttaaagccggcgatttcgttggtcgatcgttctggctaattctgatgttcttttcttgtttcttttggctgatcgatgatgcagaagtgcagccggacgtgcgagtcggagcactgcctgggcacgtatgcacgtacgtacgtatatatataccactctccctggccgatcgataattataatttgtcagtttctcttgctgtaatttgtgttgtgagcaagtgttaattgttgtgaaatttgcgtgttgcgtgtgcagaggcgccgttgatgcggtacggcaagtactgcggcgtgtcgtacaccgggtgccccggcgaggccccctgcgacgccctcgacgcctgctgcatgctccacgacgcatgtgtccaggccaccgacagtacgtatccacaccaggtttaatgtttggtgtgctcgtttgtatcggggtggccgaaatactgaaattttgaaaattttggttcgaaattttatgaatttttgaataaaatttgacaaattttgaacataatattatcaaattcaaaaataaaaataaaaatttcggccgaaataatatcgtatcaggggttccgatagaaccgaaattttgaaccctgaattccacaccaatctttttcacttatcattttgatcattttgaacatctacacattgggacaaattcaaatccaatataagattagagagagggagcttgtctcctcctttctccctcagcttcctattgtttctccctccctcttttcttctatcaacggtgatccaatagaatagagccggaaaactcgatcgagttctcctgcactcatgttggatccgcacctatcgacatacggtgtaggggtgaaaacggtcacggaaattcccgatcgaccgggcgccgtttccgtttaaggggtaccgtttctaaccgtatcgtttttgactattttttaattttgttttttctaatttcttttcgcatcgtattaatatcgatactaagtagtttaaatgataaatatggtcaattaccggctgatcgagcatcgtttcagaagagatgctaccgattccgaccgtttccgatcgttttcacaccctaatacggtgtacactgataacgggatgtgtctgtcgaaattaatgcatgtgtgcagatgactacctcaacatgctgtgcaaccagagcctgctggactgcgtggcggcggtgaggtcgccggcggcgaggatcaggacgttcgaggggaaccagtgcaacgtgacggacgtcgccgacgagatcacgtcgctcgtcgaggccgccgtcttcgccaagaggatcctgcataggccgtagctttaattagctagcttgtagccgccacatgtaattaattgttgtttttgctaattaagctgctactgtgcatgttgtctggcatcatagatcgatgcacattgattaattaattccagtcgtctccggatgctacaaaaatcgaagctagagagtacacgtaagtgtagttggagttggtgatctccctacacgtgtctagtttgcgtaagcaaggcttttttgttttctcttctttttttttttgtcatatcctcgatcgtcaacttgttcatgcacatcaatctcagatgtgctcgcagttagcacgtgcgtccgaatcatgattctgctcggaattcatttttgtgaaggcccatgagaacggtatttacaagctagtatattttcaaataaaccttttgtctttcgtgtttacaccaagctagcttgcgtgtaaacaagcgtagcatagcaccatgcgtacgtttgattcgaaaaagaagccaaaagtaaaaatggttaattaaatccatataattatagatttgctcgttttgaaaaaataatattactagtcatctatttgaaataatgccatatattacaatcttatatatattcaagatatatcccctcttgcgaagtgagtatacctcaactgattaggttattgtggtgaaaccagcccactcaagtttaaatcagtcgcacctaacggtgcttgtgctagatccgtcaagcccagggcaagttggtcatgctcaacagtaacaccgttgctgctagatcctcaagaacatgcctcgttggttggattattgcgtggtcgtggaatcgttgtcgattgccagcagtgggagatagagaggagagaggggcatggaagaaataagaataaggtaatttcattaaaaaaatttttgataaacacatcaaaaggataataagtagtgacatataactaataggtgtgaaatcatgacgaaatggctccaaatagataaagaataataatatattttttttaaatgtaggaaacttataatgacacttctccaatgaatgtaggaaattttatgttctccatccttggaacaatgtaatagtcaaatgtaatcaacccatgtctgaatcacaaccaagcaaacaaaaaccatctcaaatctgacatatataaatcgatggatatagtgatatggttcaacatctatgctgattaatattatagggataaagtaacatttggtagattattatgtaagttacaatctgcacatcaaactctttaaaccaaaactacatcgaatcaagcattaaattaccataattgtatattaatttattccatccactcctaaggaatactacttcctccatcccttaaaaaaccaacctaggataagatggaatgtttcccatctgaagttagcttttttttttttgacgaagtattgactagtagaaaattataacccattggactatgcaagtcaaaatcaaatcagaatccattggatttctataaatcaaagatcaaatcatacatggttacaagtattaactactgcaataacattcatatcaaaacttcactttgtagcatcaatgcgaaggcattcaaatccaagtcaaaaattaataggggtgtataaccccctgaaaacagtggtagaggtaggaggacgaccagtagcctcgtctcctccaacagttcctttttttatataatcctctaattaattagataattaacctaagcaatgatatattaagctttatctaagacttttaacaaagtattatccatcaaatccttctcaatcctagctccgcctccgcctaaaacgagaactatagcaacatctaaaaacactgtagcaagtactcgtactatagcatccttaataactgacaacgaaccctctgcaacttgcacgtctcagctctcaaccggacaacccccgatccatcaagtacaccgacgaatgcctacgtgcgcagcacggggaaacagtccggttgaacgtgcatgagtgcatcacctcgccccataggtagggcccgtttagttcctgaaaagaaaagtttttttttttgtcacatcggacgtttgaccggatgtcggaaggggttttcggacacgaataaaaaaactaatttcataactcgtatgaaaaccgtgagacgaatcttttaagcctaattaatccgtcattagcaaatgtgggttattgtagcacttatggctaatcatagactaattagactcaaaagattcgtctcacgatttcccctctaactgtgcaattagttttttaatttatctatatttaatactccatacatacgtccaaagattcgatgtgatatttttggcaaaaagtttttgggaaataaatagggccgtagtaggccgggtgaaaacagtcgtgaaaatttccgatcgaccgagagccgtttttaataggaggtaccgttctcaaccatatcatttttagctattgataaattttatgttttttaattttctttttcatcgtattaatattgatgtagattagtttaaatgatatatataatcaattaccaaccgatcaaacatcgttttcgaagagattgtaccgattccgaaccgttttcacccagccgcatcactgcatccgcagttcaccggccaaacccaaccggctgtgttcgttcagtggagttggtaacacattctctccacacgaaaaacagagcgacgtattttcttatgattaattaagtattattattttttaaaaaagataaattaatatgatttttaaagcaactaggaaggtagcccgcgcatatgcgcgggcatgtgcgtgaaatttactgtgaatgttcatgtgtgggtggtttctataaaaaatattcttttgctttatcataaactaaaaatgaacttatttaacatgctttgagcactggtagtttttaaattgtgaactaaaattactttaaaccgtgtagtttttaatttatgagtgggacatcgaaaaaattagtaattagctgttcaatatctgtgatattattttataatatcaaaaggaattggacagaaaaacaatcacaaaagtatgatttttcccctccctaccaagtctgcctcacattcacctccaacgctgccaccgcacccgcagccggtgaggtggctctctgggggcggggtatcgaggagggcccgtgcgcctaggcccatgggtccgtattgttcccaaactcgtcgccgctgcagcgcgaaggccatgccggcgccgatgctccgccacacaccgcagttaaggggagcacaacgtgggccaccgcctggttcatgttgagcagggcgccgcagagcacatgctattgcagtcggtctcgcagtggcgtgctgtgctaccgtaccctccgctgccgatgtcgtggcgtcgacggcgtcagagctatatgcgagccgcacatggcagaaaggggcaaaatcatactttcgcaattgtttctatctccttttcctttggataacaaaataatatcgtgggtatacaggcagcttattaccattttttgcagtgtcttgtggcagatatacattcttgtagtgtctcccagctaatcacacgtttttttaatgtcccgtagaaatttttgcctttattaagtggaggcctcaatatgcatgtgggtccataatgtaattttttgttagcaattaaatatagtcaatatgggtattaagttattgatttgacttaaaaaaaaaagttggctagacctaataggtggagatttgtttgtggtcttttctttgcccataaaaataattttaattttaattatcatagagataggaaaaacaaagaaaagtaaggaaaaatagagagggtttggatgttttctttattaaaaaaagagtgatctgatgacctaaaataatgtgttaatgtttaagtaaaaaaaaccgatggttggaatttttttttaatttaagtgagacaagtaacagcttagcaaaacgttcatgtactttaatgcccatagggatgagaggaagggaatatggtttgggatgatttttttttaaaaaaagatcgaataacgatgtaaaataatgtgtctattgatttaagtgaaaaccaatggatgaatgtttctctaatttaagagtgtcacacaatagtttagaaatgtttataagatgtttaaaggactttaatgcctatttgtgatttttttccataaagacaattttaattttaattgtgatagggatataaaaagagaaaggaacagaaggagcgtacaaattgatcagtatgtgcgtggtgcacgatatgcggacgtgggaggtttttgtttttaagatatatctaacgatctagatccaccgatttaaataaaaatcgaatgtaagatttttttttattttattagggttccatgtggcgacttgggattacttgtattttggggggtgtttttacgagcaatacttacgagaatgggagattaaaagaagggagttttttaaatagatataatctaccagttgaaaataacgggtatgtgaaaatcaagactacatgttttgcttttatcttagaatttataggaatttcttttatttattatagtgccacatgacggcttaatagtatttgtagaaagtttaattaacttttagtatataatagataatatatagattttatatacaagatatagtttaactgcatatatttatagagtactatattttatttttaaatagtagaaaatcctattttaaagcccatcgattttttttcaatgacactacgatgtatgctttttgtttctttactttatcgcttttatcgtataagtccgtacataggtttttcttgaacgtattattcatcgtttttcctttagatgtatgtagaacagttttttttcctaattccggcccacaggaggtgacggagcgtggggctcctcaccgggagaccgcccaggccccctttgccggttcggccgggggcgctaagtgaggttcttcaccctcgatctgtggaatgttcgcgagagagcaaatgcacaagacacgggcgatgtagacaggttcgggccgctgagaagcgtaataccctactcctgtattctggtggatctgtgtgtgaaggagttacagagagccggagagcaagagagttcaggctctagaacccctcttcctctttctctcctctatgagctcaggtattctccgagtcgtcccccctttctcttctccgtcctttacttcggtgggcaaggtcctccttttatatctcaaggggataccacatgcaccacttctacctactcttcttttgggtggggactcaccctatcttgacccaaacttggctcgcgccttcgcctggaagctaaatcacagctagtccttgagtaaggcccagtgccgtcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgcctatgacgtgaccggcgtcagaccagtcacagaccggtcactcttgtccaccgcgcgtcagtttagcatgccgcacgtctgcctttcttcatacaatgacttccttgctatggttgcgatgaagcctggaacgaatctggccgggactgacataccaactccaggagttagcacgccggctccggctagggacgagtgcctggaggctctcatcaatccgacgggacggggcgaggcgtgtgacaggccgcctgttgccacctaacccgcgatctgaccggtctgtgaccggtcacacactgcgaccggtcacggaccggataagcgtgcgctacgcggcattaaatgcggcgtggcgcgctcgtccaacccgcaataaatgcggttaggtgagcccctctgtgctcacctaacccatacacgtggcgccaaaatcacagggggtcggggcgccctagccctcggggccgaaacaggggcggcccgacccctcggggagacagagggaggggtggccacatcatcctcgggcccgacccccccgagggggtcaggccacgtgggtgaccgcggctacccaaacctctagtcacgataccctcggccccatgtcaccgacaatagcccccggcgttacgccagggcgattgcccccttcgagggaagcgctcgggcgtgacgccactccttaggcccggtgacaggtggggccggtccctacaggcaggcaggaacccatcggtcgcaagtcgcgcgcatcggcaagggaaaaccgaccgacaataatgagcggcctctttaagaccgctacatcactcgagcagcgcgcgaatcgggacgagccggttcgtttcgcctggagacgtgatgatggcgcttttcgcgtttggcgagcgtggttaatgcgcgcacgatctgtcccatctcaactgctacggccgcacatctgcctcgtgcgccgcaaacgagcgagttgggttagtggaggcgtgggcgcgagaaacgagggggcgaggtagtgggcgcgggaaacgaggagccgggaatagcgttggcaagggtataaagacgccgaggaagagattcgtttccttcctctcgccattcttccccttgccttctccacttgagctctaactcttcgtttcctgtgccctacccttgccgcactcactcgctctcaagctcctcctccgccggcatcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggacgcccgacgccacactacctggggcggtccgtcttcttcctctctttcgcaatggcagggctggtcccgccattctcttcttttttcatggatattctggagttttatgatctccagatggcgcacctcacccccaacgcggtaatgacgttggccatcttcgcgcacctgtgcgagatgttcatcggggtgcgcccatctctctggctgttccggtggttcttcaccgtacagccggtgtcgccgccgtcggtagttggtggctgctacttccagccgcgggggcaggtgctgcaccgctacattccctgcgtcctccgcaagaagtgggacgactggaagagcgattggttctacacccccctcgccgacgaagcgcgcctccgacttccgagccagcccccggcgcaggcctccagctggcgggcgacggtagatctgggaaacggctacgacgccgttcttgaccgcctggcgggtctgcgatcccaggggcttacggggccatggtgttcggcgactaccttcgtcgccggatcgcgccgctccaacggcgcgcccggggcgcctgggagtacaccgggcccgaggactccatgaggacccaccaggggcgcacatgggactgggaccctgaggacttcaggatggtggtccaacgggtgctgaatctcagctccgtggaggcatccctcatcccccaaggagtcctccccctctgctgcgatccagagcgcgccaacatcctgaccatcatgctggcggtcggggcgtcgggggagcgggccctccgaggccacgatggcgcgggcgggagccgcaggggggaacaatctaccccgggagggggtcgtgcttctgggccccgcgacgggggcccggggggcagctgccctgccgacgcccgggggaagaggaagcaggagtgtaccccttccccatctcctccctgagggggcggggcggtgcgtgccagcagcaggcgcccggagggtgccgtgccgacgtcgcagcccgagggggagcgaaagaagaaacggctccgcaagatgggggggaccgagccatgccgggggaacctcatctcgcccccgaggtggtcgtttagccgacctcctcgcaggttcgtccctgcacccaccgcggccgtattcattctcccatctcccaaggcgagttttcactcacccgtttctttttgtcttctggttttttttttctgcctcagcgagatcccgtcgcgccccctccgccattcccagtccggccggtctgaggccgaggagacggcgaccgcagaggcccggaggcgggaagctgaccggcgagaagccgcggaccgcctccgggaagccgaggaagccgcccaggaggccgtccaggttcgccaggctgaggaagccgctcgggaggaggccagactccgccgggccgaggagtcagtccgggaggcggaggcggcgcacgcacgccaggcggcctgccaagcccccgacccgactccgcccgaggcgacgacgacttccgaggccacccacgacgaggccgcgggcgcaccgctcgggcccgacccctcgggcgacgctcaggacgagccagcttcgggggacgcccccgagtccggcacgtcgatcggcgggccgagccgtgcggcaccctcaccgaggcggccctcccctctgccttccgctaccccaccgagcgcggagcccctcctgcaggccttggccgccgcaaacaccacggtgttggacgggttaagtgcccagatggaggtcctgcaggcggagcgggcggagctcgacgcggcgtgggcacgcgtcgaagaggggcggcgctcggtggaggccatggtggaggcgggccgcaaggcacaccgccggcacgcctcagagctcgaggcccgtcgtagggacctggcggagatcgccagggaggtggaggagcgggagactgccctcatcgtcaccgccgtgctcaacgaggcgcgggacgacctccgcctccaatacggaagccgggcggcggagctagagaagaagctcgacgccgcccggggagtccttgatgctgccgctacccgggaacggcgggcggcggagatcgaggcggcctcccggcagcgcgaagaggcccttgaggctcgcgccacggtgctggaggagcgcgcccgcgcgaaggagagggacctggcggaccgcgaggccaccgtcgccatccgggaggcaacactggcggcgcacgaggccgcctgcgctgaagaggagtccgcactccgcctccgcgaggacgcgctcaccgagcgggaacgagctctcgaggaggccgaggc

SEQ ID NO: 60941 - DNA, 12441 bp, Oryza sativa
ttcgggacgcctctcccgtctagaccgcgccgggcggcaggcgggcctctggggcgggcggaccgcgaaatacgccgccaaccaggggggcctcgcccagcgcctctcagagatggccgggaccctccagcggctccccgaggagctcgaggagacgatcaagtcatcctcgagggaccttgcccgaggggcggtggagctcgtactggcaagctaccaggccagggaccctgacttctccccgtgggcagcgctggacgagttccctcccggaaccgaggacggcgcgcgcgcgcaggtccgggacgccgccgaccacatcgtccacagcttcgagggtacggcccctcggctcgcgttcgccctcgactccgacgaggagggcggtgacgacggtgcggacgacaacgacgacgaggctggcgacccgggcgcgtcggagtgagcccccaggccccctccaatcttaatagcttttccttcttcttccgaggccttcgggcccccttcttgtatagactaatttaatctgcaatcaaataaagaggaaatttctgcgtcaattctgtttgttgtgtgcatgagacgaggatggtctgtgccgcggtccttctgtgtcttggcttgaacaagggctcgtgcccaggtctcagcctcaaatggcgcgggtcggggctagtgcctggggagatccacgtgtcgagactggccaggccgggagcgtggtgaccgagggttatggatgacccgattgtgggcctttgccgattcccccccggagttcactacgccccggggcacggctcggttctgggccccttttggcgattttagccggcccgggccaccgagggcaggatcgagcacgagcgtgctaattcaagccaagattcttcaaaaggaaacaatggcacagacacagtccttaggaaatcgaaaatgcttttattgaaatacggaagagaaaaaagataagtatatgcatgtggtagcccccggccaaccctgcacgcccggggggtggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcactgctcggagggccacgcgccgccttcgctcttccaagtagtcgaggtcgtctctgcgaagctgatcttgatcagcctcgcaatacatggtggcccgaggggacctcagggtgagctcagatgggaggaccgcctccgcgccgtagacgaggaagaaaggcgtttccccggttgctcggcttagcatggttcggttcgcccagagcaccgctggcagctcctcgatccacgagtcgccgtgcttcttgaggatgttgaaggtcttcgttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctaaacggacccaggatatcgagcccccagacagcaaacggccacgaaagaggtatggtctgcaaggcctgggccggttgatgggtttgcctggcgtggaactggcacgccctgcaccgccagaccaggtcgaccgcatcgttgagagccgttggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcggaggccgttcaggcgcgtccgtctcccctagggggtcgggtcgcgccgacggctgggcaagcctttcttcaaaggcgcccggtgggatctgggctcgcgaggaagcgagccttgagagttcgtcggcgaccgcgttatcccgtctaggcacgtgccgaagctctatcccgtcgaaatggcgctccatacgccgcacctggcgcacgtaagcgtccatctgcgggtcagagcaccggtactccttacagacctggttaacgaccagctaggagacgcctaacaccaggaggcggcggatccccagtccagctgccaccctgagtcccgcaaggagtccctcgtactccgccatattattggtcgcccgaaagtcgaggcgaaccaggtatctgaggacgtctccgctcggcgaggtcaacgtgacccccgcaccggcgccctgaagagacagggagccgtcgaactgcatcacccaataggcggtgtgaggcagctgcgaggggcccgagctggcctcggggacggagacgggctcgggagctggggtccactctgccacaaagtcggcgagggcctggctcttgatcgcgtggcgtggttcaaagtgcaaatcgaactcagagagttcgattgcccatttcaccacccgtccagtaccctctcggttatgcaagattggccgagggggtaagacgtaaccaccgtgacccgatgcgcctggaaataatggcgcaacttcctcgaagccatcagaatagcgtaaagcatcttctgggcctgagggtttcgggtcttggcgtcccggagggcctcgctaacaaagtagatgggccgctgcacctttcggcggggccgatcctctccgccaggggccgcatctccagggcgctcttcatccgagaggccacgcggggcgccctcggcttctgcgccgacaacctcggggtcagagggcgacaggcgcggccttcccgcagtggccccggggccatcctgggggtcgggggcgcctggcaccgtcggacaagcaggcggagggccagctccggccgtcgggggccttgggccaccgttcggttcgggggcctctcctccctgctctctcccgggtcgagtcgacacagggtggggatgcgcggagtgagggttgtcctcatcgcgctccacgaccaacgccgagctgaccacctgcggggttgccgccaggtagagtagcaacggctcatctggctccggggcgaccaggactgggggagaactgaggtacgccttcaattgaatgaaggcccgctcagcctcctccgtccaggtaaacggcccggagcgtttgaggagcttaaataggggtagcgccttctctcccagcctcgatatgaaccgacttagggcggccatgcagccagtgacgcattgcacatccctaagcttgctgggggggcgcatccgctctatagctcgtatcttctcggggttggcctcgatgcctcgggcagagaccaagaacccgagaagcttgcccgcaggcacgccgaacacgcacttgtcggggttcagctttatgcgggcggagcggagactttcgaaagtttccgctagatccgagagtaaggtctcttggttgcgcgtcttcacaaccaagtcgtcaacataggcctcaacattacgtcctatttggctacccaaagaaattcgagtagtacgttgaaaagtaggacctgcattctttaacccgaaaggcattgtcgtataacaataagttcatatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatctgaagcttgccgttcgccttgggaacgacgaccgggtttgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcatggacgggccgtcgcccagggcgacctccttgaccgggacctcgtcgcacgtgatcatccgctgcctcggggcggctgggacggaggtgctgagcctctcgtcgccacccgcggacttggacgccgcggcgaggtggtccgcgcgctgctccatacaagcaagcgcgactttgaggtcgccatggacggtgatggggccaccggggcccgacatcttcatctggagataggcgtagtggaccgccgccatgaacttcaccaacgcgggcctccccaggaccgcgttgtagggcagactgaggtccgccacatcgaagttcacccgctccgtgcggaagttggcggaaccaccgaaggtgaccgggaggtcgatatgacctagcggccaagtgtgccccggcgtcacaccgataatcggctgggacggccggagcaccatccccggggccttgatggcgtcaaaggccgcgggggaaaggatgttgagggctgcacccccgtctatgaggacacgccccaacttcacattgcaaacggtgggggaaaccaccatcgcgatctgtcctccccgggcaatgcacggcgggtggtcggtctggtcgatggtgagggcaacctacgaccaccgcgcccgccgcgtcgcctcatgggtaggggccgcggccagaagctctcgcttcatggccttgaggctccggcgagaagtgtgagcgcacgctcccccatcgacggtggcgatggtggcctcaggctcctggaaccccaggtcatcgtcgccatcatcgatgtcatcggcgggggccttctgcttggcctcacttcgccggttgccggcgggagccgccggggccttgccctcacggcgctcctgcctcctctcctcctcccacttcctcgtccgctcagccaaacttttgactgcgcggcagtccgcgaggtcgtggagggaggtgttgtgcacggaacaccacttgccggtcgggcgctccctgctgggagcgccggcctccttctttttgtcgctcgcaggcctcccctttcgggtggcccgcgaaccgccctcgacggcgaggacgtgaccctcgtcgtcagaatgggccgacctcttcttcctcctcctgtcccaccgccctgaccgagcggcagacccgggggcggccaaagctgccacaccggaaccggaggagttccaggtccaggcctcctccttgcgaaccacacggtccgcgagctgaaaaagctccgcggtggtctggggctccttggaggcgatcttctcgagcatgcggttgtgccgcacgcccccccctgaacgcgtagatcaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatgtgccctggaagttcatggtgaactgctggcacaaatcctcccaagagtggaccgacgcgggtggcaagttcattagccaaccccgcgcctgacctctcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgtcctccgttgcgtgggcagcacgacgaccattgcgccggcgctcgatattgaggcgggcatccggccccccacgcacatcttcttgggtcggaggcgttgacgagggaatggcggacgaacggcgggtaacggccgccgctcgccgcgccctccgcctcgacgacacggagccggcggtagcagcgctagaggccttggtggcggaggaccgcccgccggcacctaggcgctgctgcgccgtcatgaccaagttggtcatgtcgtctagccaacgttgggctggagtctctggatcggggacgacgggcgggtgacgcaggagcgcgcccgcagcctagagcgcgccctggggcgtgctgccatcgccgtagacgaggaggcgacgttccccgtctcgccgtccttctccatcacccgcgggcggcgaagtcgcggatctttcgacctcctcgagcgcctcctcccgcccaagacttcggcgagagggggacggtggagtacgagctcggcggcgcgggttctgctccccgtcgtcaccgctagcgctcggagagaggttgtgcgccactgcccgttcggccattgggctgagcgggagaagcttggcgcacacgaaagaggacgagggcttagaaagacacacgcgccccctacctggcgcgccagatgacggagcgtggggctcctcaccgggagaccgcgcaggtccccctttgccggttcggccgggggcgctaagtgaggttcttcaccctcaatgtgtggaatgttcgcgagagagcaaatgcacaagacacgggcgatgtagacaggttcgggccgctgagaagcgtaataccctactcctgtgttctggtggatctgtgtgtgaaggagttacagagagccggagagcaagagagttcaaactctagaacccctcttcctctttctctcctctacgagctcaggtattctcaaagtcgtctcccagtcctcttttttttctctcagtccccttacttcggtgggcaaggtcctccttttatatctcaaggggataccacatgcaccacttctacctactcttcttgtgggtggagacccaccctatcttgaccaaaacttggctcgcgccttcgcctggaagctaaatcacagcttgtccttgagtgaggcccagcgccgtcactcgcctgacacaggggatacccctgtcattccttcattaatggatgaagatttgcaatagccgctgtccgaataaccctccgatgggatgggtcatacctacctccactccgccggaagcagatgcaacgtgggagcacggttgtctgccgatgacgtgaccggcgtcagaccagtcacagaccggtcattcttgtccaccacgcgtcagtttagcatgccgcacatctgcccttcttcatacaatgacttccttgccatggttgcgatgaagcttggaatgaatatggccgggactgacataccaactccaggagttagcacgccggctccggctagggacgagtgcctggagactctcatcattccgacgggacggggcgaggcgtgtgacaggccgcctgttgccacctaacccgcgatctgaccggtctgtgaccggtcacacactgcgaccggtcacggaccggataagcgtgcgctgcgccgcattaaatgcggcgtggcgcgctcgtccaacccgctataaatgcggttaggtgggcgccgctgtgcttacctaacccacacacgtggcgccaaaaccacagggggtcgaggcgccccagccctcggggccgaaacgggagcggcccgaccccttggggagacagagggaggggaggccacgtcaccctcgggcccgacccccccgagggggtcaggccacgtgggtgaccgcggctacccaagcctctagtcacgataccctcggccccatgtcaccgacacgaagaatacaagaaacgcaagtctaaccatcaatgaaattcttcccgaggcgcacctcgccctcgctacggtcaacccatgcaataccaccagtcggtcactcaggctaactgccagccaggctacgcccctcgtcctcagatgaaccgtccggcacctcggccacagcagcgtgcccctagtggcactactgcgccaaacagtgttacctctttcaagtcaccgcagggaccgtcagcagttcagtgtttccggtgcaaccagatgggtcactatgccagagagtgccctcagaatcctaccaacaccaactccgggcatgctaatggcagcactgccagaactcctactccagcggcagctcagtctcgtcctagctctcaggcaagtggacaaggttctcgtgcttccaacagctttggtcgaggccgagtgaaccacattcaagctgagaccgctcaggatgctccagacattgtgatgggtatgttctctgtcaactccatacccgcaatagttctatttgattcaggagcttctcattctttcatatcacaagcttttgtgaaaagaaatggttggaaaacccaaaatttacgtgtacctatgatagtacattcccctgggaggaatataagggcaactcaaatatgcccggaagttaaccttagaactgaggaagttgacttcctagccaaaccgatagtcctagactcgcaaaacttggacatcatcctagggatggattggttagctaagcacaaaggacagatagattgtgccgaaaagtccatcaccttgcaaggacctggaggaaagcaagtccgctttacctctaacacccctaccgcaagtcggtctatcctaacctgtttacaagtcacctccttggagtcggtgcccgtagtctgtgaatatcccgacgtattcccagaagaattaacgagtatgccaccagaccgagagattgagttcgcgatagaactggcaccaggcaccgcaccaattgcaaaaagaccctaccaaatggcagctaatgagttagcagaggtcaaaagacaaatcgaagaattggagagtaaaggttatgtgcgacctagctcatccccttggggagccccagtgcttctggttaaaaagaaggatggctctgagagaatggtaatcgactgtagagccctgaatgaagtaactataaataacaagtacccattgccacggattgacgatttgttcgatcaactaaaaggagcaagagttttctccaaaattgacttgagattaggttaccaccaactggaaatcagatctgaagatatcccgaagaccactttctcaacgcgttatggtctatatgagttcacagtgatgtccttcggactcaccaatgctccagcattcttcatgaacttaatgaacaaaatcttcatggaatacctggaccaatttgtcgtggtgttcatcgatgacatcctgatatactccaagaatgaggaagaacatgctgaacacctgaggctgataatggaaaagctcagggatcatcaactactcgctaaattctcaaaatgcgaattctggttagaccgagtagcatttcttggacacatgatctcctccaacggtgtcgaagtagatcccagcaaggttaaggctgtacttgcttggaacccgcccaagaatgtgtcagagatccgcagcttccttggcttagctggatattatcgaagattcattgaaggattctctaagctagccagacctatgaccgagctattaaagaaggaaaagaaatttcaatggtctgcagcatgtgaaggcagctttcaagaaatgaagaaaaggttgaccactgccccagttctcaccttgccagatatccgaaaagattttgagatcttctgtgatgcatcaagacaaggcttaggatgtgtcctaatgcaagaacgaaaggttgtggcctatgcatccaggcagctcaggcctcatgaagtcaactatcccacccatgatctcgagttggcagccgtggttcatgctcttaagatctggaggcactatttaatcgggaacagatgtgaagtatacaccgatcacaaaagtcttaagtacatcttcactcagactgagttaaatatgaggcagagaagatggttggaactaatcaaggattacgatcttggaattcattatcaccccggtaaagccaacgtggtcgctgatgcgctaagtcgcaaggcctattgcaatgtagctcaaatacggcctgaccaagatcgcctgtgcagagaattggagaagttgaggctgaccgtggtacagtcaggtgtccctgccagcttgacagtacagcctaccctagagtcgcaaatccgggaagctcagaaagacgacgaagggataaaagagttaataaaaagaatacaggagaagaaagacaccaatttctccatagacgatcaaggcacagtttggtgcggtccacgcatctgtgtaccggccaagaaggaattaagagatctcatcctaaaggaagctcatgagtccgcctactccattcatccaggaagtacgaagatgtaccaagatatcaaggcatacttctggtgggctggaatgaagcgagatgtcacagaatacgtagccttgtgtgacatttgccaaagagtcaaggcagagcatcagaggccagctggtctgctacagcccctaccaattcccgagtggaaatgggaagaaatcggaatggatctcatcaccggtttgccaagaacccctagcgggtacgactccatctgggtaatcgtggatcgactcacgaaatcagctcatttcgtggcagtgaaaactacctttgatggaaagaaactagcagaactctacatgacccatgtcgtatgtagattcggctgtcccaagaagatcgtgtcagaccgaggcactcagttcacctcaaggttctggaaacagttgcatgaagctctcggaaccgatctaaattttagtacagcttaccatccgcagaccgatggtcagacagaaagagtaaaccaaatcctagaagacatgctacgtgcgtgtgccctggatttcgaaggcacttgggatcgttgtttgccgtatgctgagttctcatacaacaacagttaccaggccagtattcagatgtcgccgaatgaggcaatgttcggaagaaagtgccacacccccttgtgctggaatgaggtaggcgaagcgctggtattcggtcctgacatactcaaggcagcaaaagaacaagttaagctgatccgagaacgtttaaagacagcacagaaccgccaaaagaattacgctgacaatcggaggcgtgaccttgagttcggaaaaggagatcatgtgtacctgcgggtatcacctctccgtggtatgaggaggtttgggatgtccggcaagttagcaccccgctacatcggcccctacctcataaccgccagacgtggcgaagtggcttatcagcttgagttacctgaaggtctcgcagatgtgcacaccgtgttccacgtgtcttagttgaaaaaatgtcttcgagttccagaagagcaagtttccctgggtaatatcgagctggaaaagaatctgacctacaaggaaagactgatcaaggttcttgaagaggcagaacgtcagactcgaaggaagaccatcaagttctacaaagtccaatggagcaaccattctgaagatgaggcaacctgggagcgagaagatcttctccgcgccgagttcccggagctgctcccttaggtgctaaatctgggggtcgagattcttgttaggggggttggtctgtagcgcccgttccgtcgtggcgcctagcgggaaaactatctcttaaaaaccctaattgcgaaatttatttcttcgcttgttgtctagtgtccgtgccatctcagatctcaaatccccgatctattgtcgagttcaatcccgaatccaaatccttcccaaatcaattcctccgcaaaagtctaatttgcctcccccgggttcgatgggccgaatctctctcgg

SEQ ID NO: 60942 - DNA, 5486 bp, Oryza sativa
tgccgccgcccccgtgctctgttcgtcgtcaccgttcgtcgttgcgcgtgtcagaggagccggcacgagcaaagacgcagaaggggactccgggcgcgccctctccttcctcttccccagcccgaggccggagagattactcccgcgccgtcggcctctcgtcactgcgcccgccagcacggtagagcatctccccgttctccctcctcgctccatctcctccccttagactcgggtagtagcacgagtagcctccccgtagctagccggcgccgccctggccgttgccgtcgctcgccgtgtgctcgccgccgtcgccgcccgagctcggaagcaccgctcgtcgccggccttgctcggcatagctccgcccaatccgacgctagcaatggattcctatagccacgtagatgctctcgccgccgggaattggcccctcgtgacctcgtcgccgtttcccccttccctcgccgccggttgccaccgccgcaatccgccgccgacgcactccctccggcgaatccgagccgttggctcgtctccccttgtcctgtgcaaccacctggtgtgctcgctctcgcctgtatcgccgtggtttgctccgtcgctcgccgctgtcgtccgccgtccgttccggccggcgtcgtcgtctacctcccgccggcccgcgtggcagccacgtaggcgccacgtaggcaccacgtcagcgccagctcggccaaggccgggtcgagccgaccccggtcagcccctccccgtgcgcgcgttccaccgcgagccgtgaggctgcgcgtgggcccgccgcatccgcatccaccgcgaaccgcgcgcgtgcaccgcgtccctcccccaccctagcgccgcgccgcgtgctccctccgcacggtgagccgagccgctgacaagcgggtcccacccgggaccacgcgtggtgagcccggtccaccggccctctctctcctcccctcccgcgcgcgcgcttgggccgccttaggccggccggcccatttagctcggccggaccgctccgtttctctcgggccgcgccctagccgcccgaggaaaagtctatattccctccctcttttcttttcttttcttttcttttccaaaaaggatttaattaaatcctttttcctttagaccaaaaatccaataatcttagaaattcaatatcttcccaaccgtaaatccgtttgactccgttcaacttccaaaattcctcgaatctcgagatctatctaatggcacgcttagaggtcattaatagggctttattattcgccgtttgttgagttgtcccgtttcgcgtgtagtttcggagcccgaagacccacagtgcgaggatttcgaggatcaagctccagatctcgagcaaggcaagccacctttgaacatcttgagcctatatttgaacttaattatattgcttgcaaaatatcatgcattgataggattgcacgtaatatgtttgccccgtctgcgaggcagattagtgggcatacctaacttgttgcatttgatccttcctttgttaatcgttacaccatgttcccttgtaaccacccagttgcgccttggtattcgtgcactctgtgcgagtatcgatggtcgccttcaaacttaaaatatgataaacatcttgggtaaaacttgggttttacaaaagacttggaaaacccgacacctgggtcggtgcttgcgaactaaatgaatttccaaaaccgcggaccggggaacgtaccgggtgtacagtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggtgatccgggttagtaatgtcgtgagggtaaagtgtaccccctctgcagaggttaacaaactgttcgaacagtcgtgcccacggtcatgggcggatgtgaggtgatttctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgttgaaaagttgttggccgggtgccaaccttgtttcaattctaaagactgatgcattgcacatactccgaccggacgagatgcactgtctcatccgtgtcgtttgagaagcactcacttagtcgtttttagaaaagagttcaaataaaatcaattgcaaaaacaacagcctttccttgaagcctgcattaaacacttatttcccatggcttgctgagtactcccgtactcacccttgctctatataaataatcccccccagttgctgaagaagataaagcggatcctgctgatgaggagttcttccaggagcaagccggctacgatgagttttagggtttcggcctagttcccaagtcgcgcctgtgttgtttggtccaagtcttggcttccgcttcccttttgtaatgcagttgtgagctcgggatctgtccgcagcccaacatgactgtacctctactctataataaagagacctctgttgctgtgataatccgtcttcctgtgataccagcactgtttcctgggactggtatcgattaacaggttaatttggagcgtcacgggctagttccggtcggtactagttcgggacgtgacaataaacatactaattctagtctagaaaattaaaaaaataagcaaactaaaaattaagttgtacttaggtagtttctatattgtataagtttagtatatagctcgtgcaagattaggtgactgatgatggataagatacaaaactaggcaactgataaatagaaaagttattttgagtttgtgttgtaatagcatccacaatgtatgttttacagggattaagagttttttttttcctttcaactagcactgtacactgtgcattggtcttcaggtctccactggcactatcctgatacagcaacatgaaccccttccagtgcttaactgatcggtggtgtttagggttttagtgttatcagaagcgaattgagcgtcctctctcctctgatttcccttatatatatagcactgtggggctcgggagcttttctccaattaggattcaaaatggagttttaccgaacacaaaaccaatctatctcttattttgttttcttgttagaatcgggctgtgggatttatccttttctaacttaccggacttagccaataaatcaaccaacattctccccttaattaagactaactgacaaatatactaagtaaacatagctccccaaaacaatctatcacaacaacattaagccttattgagacgacaagatttatagtttactgtagtacttaaataaacttaactttacttaatgggtgttgattgatgcttatcctctctatttctaggatattaatcaaaggcagtgacttaatcctatgccgactacatgttatttgaataagttgggaggtaaggcccggtttagtgtccaattttttttcccaaagatatcacatcgaatctttggatacatgcatagagcattaaatatagataaaaataaaaactaattgcataattagaggggaatcgcgagataaatcttttgagcctaattagtccatgattagccataagtgctgcagtaacccacatgtgctaatgacgggtttattaggctaaaaagattcgtctcgcggtttctaggcgagttatgaaattagttttttcattcgtatccgaaaaccccttccgacatccggttaaacatccgatgtgacactcaaaaattttcttttcgcgaactaaacaaggcctaagtctttggttaatggatccacgagcattaatttagtactaatgtactcaactttattttttttatcctggactctatctttcacaacatgaaatttaatgccaatgtgtttaaccgcttcacttgacttcaacctcattattgtagtatattactaattgtttggttatgctatcaaccactcttaatttcaggataaaattcttaagccatacagcttgccctgttgcatgattgcatgacacaaattccgtttgcattgttgacgatgcaatgagcatcggttttgagcttttccatgaaataactccctccacgagagtgaaaatataacccaaagtggatttcttagtgtctaagcaccctgcaaagtcagcgtctgaataacctacgacctcaagtttatctgaccttttatatatgtgagcatgtaatgcttagttccttgcaaataacgtaatactttcataattactttctagtggtccatacctagattagatagaaatataccaagcatcccaataacaaataccaaatttgattgcgtgaagacttgtgcatacattaagccctccctgcgcagccatcgccctccggcgccacctccgtagatccggtcccctcttcctctccctctctgtcggccagatctagggagggggtggtcggggtggtgggttggcggcgacgtgcggtggctttggccaatggaggcggcaggtggcctccgcacgggcgaccttttcctctccctctccgtcggcctccaaccggtggcgcgcaaatccggtcggggtgagttggcggcggtggccaagggaggcagcggcgggcggccaagggtttccggcggcgacatcaccgataagttcgtgcacggattgttcctactcgtgtagttcttgatggattgtttattcctgatggatctatgatggattgttgttgttgacctgtgattggtctacgttgatttgtgattgttgttgaccacggaatgggttgaatgggttggctcgaaagcatcggctcgacttggagacggcttctctttttttttagcacaacaccaatgacaaattggtgccggctggaaaaccggcacaacgggatccatagctcctgcccgattttcacgaggtcagggttggagatgttgctcacggcggcgatctcctggtaggtcaccaagttatcaaactgcacggtgatagaagtcatgttgtcatttggttgaatgatgtgtaagggctggctctctagccggttggcaccggtgacgtaggagcagtggaacaggatggtgacgatgacggtgtcggtgatggccgtgtgggacggggtgctcaacggaaggccgttggcatcgaagaggtcgggaaggagctcctctaacttaaagttagagg

SEQ ID NO: 60943 - DNA, 9739 bp, Oryza sativa
tcgtggagggtggtgttctcgaagctggtgaggggctcgatgtagccggtgccgccgggggggggggtgtgcagaggatgcggattggcacgtggccggcccgatgtaggtgaagttagtggctgatgcgaacgacgcgaggaagaacaagaggaggatagccgcggaggagaatgatggcaccatgataacaatagctataggctatagatagccacgttgtgtttgagaggtgaggttgggaactcacctcacgcgcacgtaaaacgaagtatttacttatgattaattaagtatttacttttataaaaatgattaatatgattttttaaagtaactttcgtatattttttttcaaaaacatatcatttagaagtttgaaaagtgtgtatatgaaaaaggaaaactcacctccgtgcacgtaaaacggagtgacgtattttcttatgattaattaagtttttttaaaaaaatagattaatatgattttttaaagtaacttttatatttttgcaaaaaaaaaggtatcgtttatcagtttaaaagcgtgcacgtgaaaaacgagaggtgtttcgagaacacgctgaaaaaagaacacagcagaagtgtttgagatggccggagctagcgtacgtacgaacgtgtgcagaggtgagctagcacttcatgagagatgtttggttcttcaccggggacaccgcaacacgtcaaagtactactcctatagcgcaactgtacatgcgagtggggtggttgcggatggccagcaatagtgacgtgacggtgtcaaacaacacgtacgagtgctcagcggttgcacgatctgagctcagcctcagaagtcagaaaaatcgaggaaatttgtgatttgtacgatttttccgtcctctggtcgagtccactctgcgaagtctccgtccactagaggataatccttcgacctgacggatttccgaaaaattgtttcccagagtcactggtcaaactagctagtgtagcatggcaggaaattgaactgcctaggtgtgtttatagttatttgggtgtaaaatttttgaagtaaacatatacatatttaaagtattaaatatagactaataacaaaacaaattacagattccgtctgtaaactgtgagacaaatttattaagtctaattaatccattattagcaaatatttaatgtagtatcacattgtcaaatcatagcgtaattagtctcaaaagattcgtctcgcaatttacatgcaaactgtataattggtttttctttcaatatttaatgccccatacatgtgtctaaatatttgatataatatttttggctaaatttttttggaatctaaacaaggcttacaatatccattcatatgttggctagctattagttcactttggactctttttgagttgggtctatctatctgtcaagtggctgcagagcatcaccgcaaaggtgacgtactaccactgaaaatctagaaaattttaatgcaatgctgtgtattctagtgttttgaagtgagatttcaatgccacataagctcataatatctttcagatagcgtactttttttttctcgatcaggtccaactccaaattagaatgtcttctattatctttagtacatatggccataaggcccgaggcccgacgacccgacccatgcttggcacagtacgactggtttcgggcacgtgccggcctagcccgatagttgggtcgtgctaggccaatgccttggcacggtgagtcggcctcgcacgccatgatcaaaggaaaatagttgagggacccaaaatagacttgaatcggctatataaggcacggctcaaagagaacagggaagcaaaatagatttactccagccatatatgacatagcacaaagagatgagggaggataagtagacttattctatggagaagaacaaggaatatgtttactttagatccctcaatttgtcgtccaatctgaaattcgtccctgaaccacaataccagatatgatatatctctcaacttctaaaaccagcgcaaataaggtcccaagacggtttgggcagtagtttcggctgacgtggcgcctacgtgacattgacatagcacttaaagtcccgaaaaaggaataattaattatttttcattcttacgagtggtgctaaatgatttaccattggacccacacgtcatagacacatgagagcccatatatcataggcagcaagtggcaaataattaattgccacatcttaaaagtggctaaaagttaaatgtcctaaagaaaaaccatgaaaaccatatgtcagtgagtatccgattaaaataaaaaatacgcagtgggtcccacattctttccttctctttttctttctctttgctgcttcttctctttcccggcatccagcggccggccgccgccaggctagcgtccttctccgtgccaatgagccatggggtggtggagaggaggggaccttggtccgacgggagacgccgctgccgggaccttggccgctgatgctagggacctcggcggcgcagcagggttcactatatcgatttagggcttttgatcggaggtcaccgaaatcccgaaatttcgaaaatttcggtctaaaattttgaacaaaatttagttgaatttgaacaaatattaccaaatttatgaaaagattgaaaaattgaaaaattttgacagaagtaatatcatatcggaggggaccgaaatttccgaaattcctgcggcgcagtagctaccgtcgacggagacggactagctggcagtggacgcagtggtgccgggtgcgggcgtcgctgtcctgcgaggaccgcccggacatcgcccggacatttgctgcgcttcagctccacgcgcgccgggccgagatcaccacgctctttggccacgcctggagcgtgctcctcatcatcgccgacgagcagcagcgcaacgtacgacgacgtccaggcctcgtccatgccatcttcttcgctggatgcatgattggtcagtgctgtaattctcgtgcaaaataccttcgtttcctacagaaaattccatcgtgttaactcagacaaagtgacaaactaccgcaatgccatgatagtaggattatgataacaaccatgccttaggccttgtttctttcagcttgggattattataattagtttattataatctggagtccaacatattataatctgataagctcatttaggtaagctttttccagattattggatgaaaaattacccaccatgccaccccactccttttttagacatgcaaacccaataatctaggctctaataatctagaaaagaaacaactaaccacttattctaatacagattataacaatctagtttatagtaatctgactcaataatctgaattataataatcccaagctgaaagaaacagggccttaattatggcatcgacatgtagaattcggacctgagagagatagaggggggcagtacgtagtacgagactaatctctgtaacaaaatactccctccttccttaaatgtttgacaccgttgattttttaaaacatgtttgaccgttcgtcttattcaaaaactttagtgaaatatgtaaaattatatgcatacataaaagtatatttaacaataaatcaaatgataggaaaaaaattaataattacttaaattttttaaataagacataaggtcaaagatttttaaaaaaaagtcaacggcgttaaatattttgggatagagggagtagcattttcatattagatggacgatgcattgagaccggtgcgtcgaggttctactacgacagcagccggaagcgcctgaggccggcgcgccagaggcggcgagaggaagagaaggagaggatgaagaagatgataaatgcctctagcaaccacgccgaggagaccagcacaaagcgcccgcagctgccaccgcccgaacttcccacgcgtgccatgcactcgtgcctccgccctccggtgagacgtcacgcactcaccattgttgtagttgtcatcttgtcgatgcttttgcctgacggcggcgatgcccgatgcatcccatgaagaagatggcttggacgtcgtcttcgtgctgctgcttgtcggcggtgatgaggatcatgctccggatgcggcggccgatcgagcatggtgatctcggcccgacgcgcgcgaagccagagcgcggcgagcgctcgggcgatgtcctctcatccgggcggtcctcgcagcacagcgatgcccgcacaagagcatcccttccgcatccaccgccgtgtctactgccagttgtccgcctccatcggcagcagctgctacgcagccgaggtcccggcagtggcggctcccgtcggaccgaggtcccctcccctcccccaccccgtggctcgtcggacaccggcctagcggctggccgccggatgcctagaaggaggagaagcaaaaaagagaaggaaagaaggaaggtgggacccactacatattttttatttttaacttgataccgacttacatttgggtcccacagtttttccttgaatataagtaccacgtagatgttacgttagcttaaaccatcatccaaatcattttgggaccttatttatactggttttagaagtggttttagaagttgagggacgcatcatatgaaattttacactttacgacaatttgagggacttggagtgaacttattcctttttcgtgtggccttgttctgtcgaccagttggttgggttttaagcccactacatgaagctgacaaaagtttatttaacaacgccacgtcacaagcctcaaacctgaggccattgttttccaatttccaagacgcgagatcgagtgatcaaccgactggtctgtgcgctttttcatttttttttaattacacagtagacccacacctatacataatatcatactcataaacatgtcccataaaacatgctataagagataaaaaccaactgtaaatctctaatctcactaaaattatattgagagtttgtatatgcgtaatatttgtggacaccaaaattcatacacctaagaccactggttgttttgctttgcaccttttttttttgcgttagtaacaaaaatcagtgtgtatatgtatcgtatcttgcttctttctttgctgactatgtttggctacttttttcaatgtgctttcaggcacccacccattgttgcgcaagttcttgtcaaataaatttggaggctaaatattgttgttttgattttcaatgcaaccttctcagagttttgagtctctggaatcaagataggcaagtttttggggtttgagtactttttctttttcataatttaacgacaattctcaatgccgcaggaaaacgcatacagtaaagttatcgagggttctttgtaacatatgattcttaaaacataaaaatagtaaagttgtagggtttagggtaacccctgttaaaacgcaagaatcctagacctgctaaaccaaggaatgtaacccctgttttaatcattaataaagctctctctttcatgtaaaaaaaaaagaatgtctgaatcctaatgaacgaaaaatagtaggaaaaccgtttgaatggagtaatttcaaagaatcaaagggatctaatccttcgatccaaataatctcatatattcttttttattcttatgcgatctaaatccttagggcattcacaatgcgtcccaattttattctgtttctcgtgtgccacgtagacaaagaacctcataagcttctcaccacagtgcaagttaccttgtaatgggtctcactagtacctactttatcactttagcattttctttcctttcctctccctcctcttttcctttccccaacgcagagaaatcgccggagatggcgatggcgctgggccgagcggcgaaatctccggcggagcagcggcggggtgccggcgctcgccagcgcagcatcggcgaggtcggcggtgcgggagcggcggacgggcggcgacggcggtagggcggccagatccgcctccttcgagctccccccaagcggcgccggcgtcagcggtgtaggagcggcagacgggcggcgatgaccatgggacggccagatccaccctctccttcgagcggcggggcggcccgacggcgatggcggcgggcggcagggcgccacaaacgccgacggagctgggcagggggcgcgccacgagcaccgacggcagcaagcgacagggcggcggtgctgcccgacggcgacggcctctggcggcgggagcgagggagtgcgagctcggcggtcggcgcggaagcgggggacggcgggcggcgcggatcgacctgccccgtgacggctggttctctccccgcgtcggtggctctcgcctctcccttctccggcgcctcctctctccgacagcgttgggtggaggaagccggcgagattctccagccccatcgctttccccatcgacccgacgagcgtccggcagccctcctcccctggcggtccgacggcgacggcctctcggcggcgtggagcgcatagatggtcaagtgtggtctctctcctccctctccatgatagcgccgagcaggagtatgggccctggcgcctgcaaacttgacgaggaacgcgtagctcaaattggctccgcggacctgaggttgttgcgcggattgaggacgtgtcgtcgaatattcgttttctgggagcgaggctgaatgccacgtcctcccactgtgaatgcccttaaaagttctccggtttttctaccaaaggggcctgatcggcgaacggcgagcgcgagtgatgacgtggcgacgccgcagatcttttctcgcgcgccgcaagcccgcaactgaacagcgcgtgtgcgcgtggaggaggacggcagcggcgcacgatattattgttccccgtcacagcgcgtggactgatttgcccctgggttaggcgtcttatttacggacccctgccatcctggatattttgctgcctaaccagtacccactggcctttggaaggttctggtcactcgtccttctctttttctttttttttctttttttttcttttttttttttgcgtttcaggggtttggtgttgggcagcagacagctgcagccacgtgagatgccttttattagcaaaggttggcaggttgatggtacatgataataggaatagtttttgataattgatactttatgtgatgcttttcaaaagctacgtgaagaaattgttaggaattactatggatacattttggttccgtgtgatgtctaacatgtgttttttttgctatttttcttactataagatttgccgcggcgtgaaacttcgatatagttggaagtggtaaccagccaaatgttgtgttaatatctgttacattgccggaaaagttgttttatcaagcagccgcagaacagacggccgaacaggcccaatctagcaaagaatgaaatcttatacctagctttgggataattaactaggtgcataacctagcaaaagggagaaaattgtgaataaattttgatttgagcaggtgacaagctatgttgatatggagataccatgttttgctatgagctactactattctacaagactacaataaaggacaataaaagactatgaaagtgacgtagaatacattcttattagattagttgttaccgagagacaaatcacattgtactaggaagatattagatttatattcatgacgtgtgatatagcatataggtttatcatgtttgctaaggttttttaatattttgaattgcttacgacattgacttattaattaattttgttcatgttacttattttccttattatcagattatgacaagactctgcacctaacttgtatgttaagcatttttatatgatgcttgatatttatattactcaattgacaaacaacattacagtctaattataatacactgtattacctttaataactttacgcgatatatagtgatcacaacgacaacaacaaaaaaaaactttttaattaaaatttaaggtagccatccacatgtacataagatctggggtttggctgacctctcgttaggcgtttaggtgcacaagtggacgccacagaatgaatgatatataaatgatttctcccaacagtgactccgatgtagacttggaaatctaattgggaaaaaagagagagaggatattttggttgctgacaagactagcgctattggtacatgatattttccaaagtttggatgagtagctttcagattggatggctgagatattctgcattagttctggctggaatgcgtacagatgtatctgcatggaatcaggatcaaaatgttccatcttaaaagaaacatccacacaataaacttatattcgatgaatcaaactacgaaaataagtgtgcatgttataaacttaatatttaggtattgtgttgtattttcgatgctgaattagtcgtgtccaataaacgtcaatgagaatacttcttttatcacattttctctgcatgtgtaaaaaacataattgagattcaatcaagtggcatataaccgctagctacttctggaatctttggcttaaaccgttcaaattttcacttagattctaaaaatttgtagatattaaatcataagctaataaatctattttttaattctaactattagttatccaccatttgcttcgaaattgcttcccagaatttcgagcttcccaaacaaaccctaagtcttttatttagcgtacgcaattattagattctactatttttttgaggggtaattaaatgctctatgcagtactctagtacaagaagaaaccaaattttcactaatccctctagagcaagttcaatagtagactataaaccaactatatacttatgtaaaggagagagaacaagggaaacgatgagtcccagctcttatgcaagagataactatacacattctcgtaaacaaataaattaattacatatagagaggagaagaacataagatacaacctggtaactaacggtcccgtcatcgtttggcttttccactaataagccaaaacagtttattagagaataaaaataaatctgtagacaaaatttttatatatatgttttttctgacttaaaagccaatgctgaaaaagaaactacattgaaaatatctcaaaattaaatttaaaaatttaaattttgactttttcttgactaattaggccatccgatgggagcctaatatattatatatatgttaactcttagattaatttatagatagtggtttgctctacttttaggctccgttcggtagtataagttcccaactcctcctcgttttccacccgcacgcttttcaaactgctaaacggtgtatttttttgtagaaagtttttatacaaaagttgcttaaaaatcatattaatctatttttttaaaaaaaatagctaaaacttaattaatcacgcactaaaacgctgcttcgttcccaaccctcgcttccgatcagagcctaaacttgctcttagatttttacacccctaatatctggtcttttcctataaaaaaaagagagaggtggagagggaaagaacaaaaaaaataattacgctagtgaagctgacaatctgaagatactctcccttccactccacgtctccacctctctcacgagtggaaaaagcaaaacaaggtgcgccgttggatgcttccc

SEQ ID NO: 60944 - DNA, 1923 bp, Oryza sativa
aggaggaggaggggatggaggtggatgaggaggaggaggaggtggggtgggtgtggaggccgccgggggggctagcgggggaggatgaggcggcggcgtgggaggggagggcggcggcgatcgtggtgtcggacgcggtggaggtggatttcccggtcatctacgtcaacgccgccttcgaggccgccacggggtaccgcgccgacgaggtcctcggccgcaactggtgagccctcgtgcgcgccctgctcttagctgttccccgatcgatgccgctctgctctgatctggtgtggttggatggggatggcgaaatgctgcttgttttttttttttggtgctctcgattcgattccagctcgatatgttggcgagattgatggtggttgtggatggctgtgttgttgaatttaatgagcttttgccgtgcagtcaaaccttgagattttaatgcgcatttgttagaattagggggttcctgtacaggcgtacggtgcagagtgcgcaccactctgtctctgccttaatgcttgcaattgcggcgatgatgcgtgattcctgactagttgctgtaaattttagcattttatcctcacttttgattggttgttttttttttttttgaaatttatagatgggtatcatgccagtatgagatttagccagaatttgaagtgtactgtttctgttagaccatctgtattttagagccaatctctgagtaatggtgacattgttgatttttaatctacacattaagcacagcacgagcaagccaacaatcgaagtaaattgtagataatgttgttcaagtacagtaaaagcctgaaaggtgcttacgcgatctagtttggatatattcatgttattgctaaatttatgaaatggcttttgaaacaaattttgtgtatggaagttctatatcgcatatttgcattggaccttagaggcgaacaacgaaatgttcatatattctttctggctctgggtcatttttgttttctggtgggaagaggctgggcaagcaagggtgatggctacccgttagatattttcccctgatatatcttctcttctcttgctctactaaagtagccacttgcacatagaaaaagggatgatggaagaataaactgtagcatatattgtgaatataaaatgagatgggtaggccattaattggaatatagcacagttgtctgtagcatgtgggtacaaaaatttacaacagggagcatcacggttttagccaggcctttttattttttaccaccgggctaccaattaatacttagtaactttagtcttccattggcatatatcatatttagtggtcgcctgctagtgctctaggaggatatattatactggattagtaagactttttcctcctctcttggatggtactggaaaataattaactatgaatgtattcacatgacaaattaacattgaatttggacaccaactgtgaaatttgatccgtattaacaatatggaaagctattattggtgacaaccttataagtgtactacagtactacacctgcaagggttttcagttgacaagtagctgattatggtcagtttcagaattcggaactcaattttgagcataaatggaagttctggatgtaatatgaagataaactttgagaaatttgacttgggttgtaaatgtttgaacttgattttcgtgctgtactgcttaaggctgtcttcaggaggcaaggtttacctcctgacacggaaaacaatgtaagcgattagagcgagattagttaagtactagcctaaaaaaaattaaaaaatggattaatatgattttttttaaagcaactttcctataggaaaattttgcaaagaacacaccgtttagcagtttgaaaagcgtgcgcgcataaaactagagatgtgagttgg

SEQ ID NO: 60945 - DNA, 759 bp, Oryza sativa
gacccatcccatcggagggtcattcggacagcggccattgcaaatctccacccattaatgaaggaatgacagggttatcccctgtgtcaggcgagtgacggcactgggcctcactcaaggacaagctgtgatttagcttccaggcgaaggtgcgagccaagtttgggtcaagatagggtgagtccccacccaaaagaagagtaggtagaagtggtgcatgtggtatccccttgagatataaaaggaggaccttgcccaccgaagtaaaggacggagaagagaaaggggggacgactcggagaatacctgagctcatagaggagagaaagaggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaagggggacctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcagaacccgcgccgccgagctcgtac

SEQ ID NO: 60946 - DNA, 12626 bp, Oryza sativa
  unsure (1)..(12626): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcagccgcccatggcgacacggccgtcgccgcggtcgcgagacagcgcgcggccgaaaagcacaagcgggaggcctccgtcgagcccgcgaagctccgacaccacccgccgctcctccttcaccgccgcctcgtcgtccgacaagccggtgccgtccttcctccgccccaccgtgagctcgtccctgcacagctcgtcttcgtcatcgccgtcgtcgtcgtcgttgttgtcgtcgtctccctcctccaagggcaccggcaccacgccgaggaggtccgcggacaaggccccgtctgcgtctgcagcttcgtcgcggccgatcacgcccaaggacaaggcccccgctgtagcgacgtcgcggccgatcacgcccaaagacaaggccaaggcggcggcggcgtcgacgtcgcgatggtccgcggtgtcgccgaggcagctgatgcagaaggcgtccaatgcctttacaagaggcagcagcagcaagtcgcgcgctgccaagaaagacaaggaggcggccaccccggcggcgacctcggccgccgccaaggacgcggccactccggcgtcgacctcggccgtccgcaagaaggccgccacaccggcgacctcggcggctggaaaggcggtggccggtgcttcgcccgggccgacgagagcccagcccacggaggagcaccaccagcaacccactgaagcgccgccggccgaaccgtcacctgccgccgccgcggtgcaagaagaggcggtgacttcgagagcccagctcacggaggagcaccaccagcaaccacctgaagcgcccgccgagccgtcacctgccgccgtcgccgtgcaagaagaagcagcggctgcggagaccgaagcagagcaagaaaaacaaccggatgagacgccgcaagaagtcgtcgcggcagtggaggagaaagttcaagacgagcaggttagcacggaagcagcggaggaagccatcgccgtcgaggaggatgccgccgccgtgaagaccgatgcgccggagccggaagagacgcagacgcaaaccggtgccattgcagagtcggaaacagagtttcagaggagttcagaggatgagccggcatccgacgccattgtcgaagaagcggcgatcgaatctgcaacgcagaatgagccagatgaaccagaatccaccacggttgaagagatggccgtcgaggaggagatcaagaccgatgagagccaacaagaagagacgccaaaaccagaagagagaatggagaactctgaaacaagcgtgatctctgaagatccaaaagaaatggatgcaatctctgaagaccaaaaggtggaagaacccgtggttgctgaagaacaagaggaactctccgaggttgtaaaaatggctgtcgagccgagcatctcgtcagagccagcaacgccgctggaggaagaagatcgcgacgacgtggagacggagcaagcgaactcgtcggagcccgcaacgacggtggaggaagaagaagatcgcgacgacgtggagacggagcaagcgagctcgtcagaccccgcaacgccgttgaacgaagaagctatcaacgaggagggcacgtcgacggagacggggaagacgaagaaggtggcgttcaaggggagcaaggtgaagacggcgatggagaggcggccggagggggagcagccgaggaagaaggacgtggcgcggagcaacgacgtgatcgaggagaccaagaggacgctgatgatgaagaggaagagcaaggtgaaggcgctggttggggcgttcgagacggtcatggacacccccagcccgggaaaatcgagctgattttgatttggatttttttttctttttttttggagggaaagcttcagcggtgatgcacgtattgagtggtttgaattgaactgcgaggtgtgctttgtggtgtgatgtttcggtttcttgttctctttgttgcattgatcgttgattgattcttctgataactgaaacaaatggaaatgttattgtcgatttgtttgtttgttgatcattcgatctagtgttgtttactaggcttagttgtatgtaactaaaaagggaaatagctgtgtgttcttgagagctgagactggtgtggttgtcaacttgtgctacattgctgagttttgagatttatgcttgtaaacaattattgatgacatgcaatccattttgtacgttttttacatgttcatggatatggatttctttatagtacatgccctcatttcatacatgaaatttgaatatttattgaaaataactaaagaaatgatgatatcatctaccctctctgctccaaaatataaacactagttgaaataccaaaaatataataacttccaatactattgatctcatcaatcacctttcatttaattctttttctgatcttacctctaaccattccgataacaaagtatttttcttgttaggtttactctcagttaatttttttttaataatggaatagaacatcatcctcaacaagctacaaccaattattacatccaaacactcaaagtgagtgtagtctctgttaaataacctagagattattatattttgaaatgaaaggaagtaccattgtatcgtactccctccgtcctacaatataagggattttgagtttttgcagcgtttgaccactcgtcatattcaaaaattttttgcaaatataaaaaacgaaaaagttgtgcttaaagtactgtggataataaaataagtcacaaataataatttaaaatttttttgaataagacaagtggtcaaacgttgcaagcaaaaacttaaaatcccttataatctgggacggagggagtaccaaatttcattttagtagtgtaccaatattacaggcaaaaatacaatgtcggagcctcggaggccactagggtttagataaaagaatatttaccaaaatgcattttatggccagtagggttgagatcatctcaccacaaaatttccgacatagtatacaggcataatctcaacttctcaagattacaggtacacatccgaatcacacaaacggaagaagcgtcatacagaggaggaggagatcgtcgtgccagtcttcagctgagctcgaggaagcgccgtgccatggggtgcttggcctcggacagctccgacggcgggagcacctcgacgacctcgccggcgacgaggaggcagaccaggtcggcgatccgctggatctgcttcacgctgtgcgacaccatcaccgtggtgagccccctcgtcttcttcagccgcacgatcgcctcctcgatgttctgcgtcgagatgggatccaacgcgctcgtcggctcatccagcagaagcacctgcacacacactccaacatcagaatccgatcctgaatccgaaacaccaagatgcgtcgcgttgcaatcagcgaaaaggctgaataatccaacatgcctccggatcgttggcgagggtgcgagccaatgcgacgcgctgcgcctggccgacggagagctcggaggcgggcttggagcagagagcagggtccaggtcggcgaggctcagtaggctctgcacctcggcgtccgtcagcttcttgccctgcagctgtggcccgtatcgcacgttgtcagccacggttcctggcacaagtgtcagaccacttcagtttttttgcatgagaaatatcaaatactcctgtcaaatctgtgtttggtgcattgagcttttgcatctggggggatatatacttgagccatgtgcctcaaatgagaaaaataggactcaatggggaaatggagtgtgccagagtagatcggatctgttgaatcaattttaacttggaataaaaaattaaaattatagctttggaaaacctggcatattaagggtgtgttcttaactacaatttttaagctgttccaatttttactctcttttttacgtgcacgtttcctaaactgcgaaacgatatgtttttttgtaaaaaaaaattctatggaaaggttgctttggaaaattgcgttaatttattattcaatttctttagttaatacttaattaattaggtgctaatgagtcattttgttgtgtgtgctatagaggaagtgtttccaaaatgcaccttcaaacacaaccttagggagcttcgggtagttgtagtttctcccacaataaaaatacttttcaaaatagtttttatcttcaaattaaaatgagttgtagttgtagaatgaaaaaataaactagagcagaagctaggtttttccaaatttctacatattctcaccagccgaatccttacctgttgcttcttagaatttaagctcccctaaacaatcccacggagtcttatgaaatttgactttttaaaacttctttttgtcatgaatcatatgaaatttgaccgttttttactttttttttctagataatatattgaacgccctctgttattttgcttagaataagtccccctgtcgcattgaaacgtcagccacgagcttggaagattctagttactgtaggttactcatcgccacgttggtagaggcgtaccaattgacatgcatgtcccactcaactgacgttagcaagcagtgacatcttctaagaaaaaaaatatttgaagcaagattccacttacgttggtagacaaattaagcatccattttatcaagtacattgcactagctttagaccttgtttaagcctctaataatcagttgacgagtagcgagtagataagaatttggaaaagttaagtttcacaacttctagtttctagtattttttaaaaatattttgtatctactacctccgtctcagaatgtaacaaactaagatggatttaatctcatactagaaatacgaatgttcagattcacagtcgtctcatcctaggttgaaatattctggcaaactgaggagtatcaattatcagaatttaggttagaatctgaactatttaagggagctataaagtctagaagaagttacaactagcaaaagctctcatgtatttggccttagcgtaaaaactctttcaactaaaagtacccgtcctctagtgtaaaagttcactgcaagttgaaaattgatgcggtttcttaggtagaaaaaaacttatcacccatttctaggaaacaagacgagggcaaaaaagtgctcaacttggttttatctgtttatcaaatgctataactcggctttcatttgttaggttttgactgcgacattggtacattttatcattatttcccccttattataacttattattgacacaactaggctaatcaatcgtaagagtggcgaatagttaattattcatatgaaaaatgccaaacctagttgtctgttgatcgtctaaaacttactcgttactgtttttttttttggacaggatcttggtaatctcaaatcaagttcttgtttatttttgaaggaaaagcatctttttgcagagaagaacatttaaatttggaaaaggtaccgcattcatggaatccatgtacagtttcttccaggatcggatcaccgtgcgtatgtgcagtgtgtgtggacagcggcgggcgtacgtacttaccgtcgaacatggcggggagctggaagagcatgccgaccttccggcggagcgcgaggacctcgatgccgcagatgtcgacgccgtcgaggagcacggcgcccggcgcgggctcccagaggcggttgagcgcgcggagcagcgtggacttgccgctgccgctggggccgatgacgccgacgaccaccccgcgcggcacgtccaggtcgacgccccgcaggatctcctcgcctctcgcctccgaccgccgcgtcagcccccgcacccgtatcttcggccccgccgccgccgccgccccttcttccccgacgccgtccacgtccagcaggtgctccctgacatcatgctcttcaaattcgatcgttgatcacacgcacatgtcgtcagcacgtacactggaacacgaagctgacgcacaagagacgacgaggtgtactcgctcacctgaagctgagcccatcggagagacagcggagaggtcgagaggaagacgaaggtgaggggggatcgaagtgggaatccgggcaatgcgcatcgtcttttttattggctttttgccaacttttcccggctccaactgaggtgggcggcttttggagcacgcgtgaacggtgccattcggtggcggccgctggttgcaagcaagggcagcgaagcttggactcgtgtcgtggtgaagggaaagtcccagacgacgcatggcttatcgccgtggtcggtttggacccttgtcgatctacacagtgatcaccaacaatagatgcaatacactgatacagtatcaagtactcgcagcaatgttgctgacagttgccgtggatctgtgtgggaaatacaagattcggttgctagctcttaccccagaaaacaccaggaccagataagcacatcggcaacttggtgttggtgatgaaaagtttggagaggttatatcgcgagcggtgtccgtggttatcaccggtacgacggaaacgtacgcaggattttccgcgtggaccgtgtgcgcggtcatggatagctacgccaccaggcgacgcccgcaccgagacgcacatgcaggttcctctcgtcgtgacaccaagcgtgtgggacgtccgctatctccatatgggcttctgtcaattcgtgtcccatgtaaggcccgcaaagagaactccaattgaacgtttctatgggctgtaccggacggggccttctgtccattccttctctttcacatatcttgacagatcaggccttcaggcccagttctatcccttctccatggcccaaaagctaactgctaatctgatgcccttgctggtcccctgtcattagctttggctccacataccacagcacacatgcgcaaccctagaaactggcagctttgtgttccggaaaaatacaaatggtttacgctggattgattatccaagtcactatctctaactaggaaaaaggaagcgggattatcattatccagatgctatcttgtcagcatcacaccgctatccaacatggcaccattattgaacggaatcagttgttagtaggttgagtcacgattggatggtcaatgccgtaattgctatagctagctagtcctactccagctcgctagttgagctggcgtctttcttggcactgcagtttgatgcaatgttgcacgatggctcaacagtgaaactaatcagcagccactagtatagttctctcccatctcatcaatcattgaaccgtgcaaacagtttcacagcacaacgttacatatagaaacagacggcttgcatgcatgatttcagtccatagctagcttagttatagctactacgagtagtagtactactattgctaccatccggtcctcctagcaagcttgatcggctgagaacatcgtcgtcggtggtcctccaagtctctatcagagaaacccttacaactatcacatcgccagattgacgacgggagacgtgcatgttcaccatcgggtagtagtagcagccgatcgttgaaaggaacagtgcacgtgatgtgatggtctctagctgaactctgaagattaggcagatatactgtagtacatagggtgtcagggaatgctttgcccgttttaaattcagatgaaaacggcaaatgtcagtaacaaccaatagtaagttgtttaaccacaaaggattatgaggaggagtgtccttgacagtggcaacgggtagtacgctgctttcatccgaggcagggtgaataaaaaagcgagagagaactcaagtgcagagaagaacacgatgtacaatcatccagtcggagagccattgattgttcgtcacgagaaacatgtcggctgtacaacaacctctgaggcagtgaacgcagcgttccctgtctaccaccccagaaaaaaaagagagagatactagtacttgaatgcttctgcttcgtgcacaccatacaaaaagtgcatcctctggcaccggataccgtatcgatccagtgatcatcactggatgtcacgaggagacgaactgtgccgaatcatgatcaatgtttttttcgtacgttaccaacacacttcatcaatttttcagatggagaacacgagtagcagtagtacgtgcaaaattctggttcacttccatgtgctcacgggccgtgatcacagggcgcggtgctgatgcgaatcagatcgctgctgccgtgttttgctcgcgctcgcatacgaggtacagcggccatcgcccgcctagtagtgacaaaaagagaaggcgactgccacgcccatacacctccgttgcagacgcaccgctgtgccgctgtgtgctcgcctgcccgagaaacgtacttaaaaaaacggcacgaaaaaccagccgagtacgatggaatcagggagcattcagccatgtcaggaaaccgatttcgtcacggccaaataaacgggatggatgaaaaaacactcgagtaaacacacgaagcgaaatgaacacgggtttacctacggcaccaatgataatgttggtagaaactttctttttacagtggagtgagctcgagtgatgagagagcaaacaagaagaaatggacgcgtggtaacctagccgttgaggcgtgggagtagtggtaggttggggagaagcatacgggccaggagagcacgaggccacgacggtgttgctttcaatgccgcaacatgacgggcaagtacgaggcaagtgtgcggccgccgattgctcctcccacatgtgccactgatagtactactgccactacgctagaatgcaaaacggaaccgagtctagcaacacgacgcaacaaaaaaaccaagaggatagtagatgagaaatgcgagatgggctttagctgctttactaactgagccattgcccgggagatgctttgcaacaggttacaccaaaaagttgcagcgcttttcctcttacacagacaagaattttacacgcatacgaccagctttttttttctttttctctcttgtgtagcatgggctggttgcctggttccctcgtcccccgacccggccgacgcgacgcgccaaaagcccttgtcagcgcacggcgccgcagaagatccacggcgcattgggctacgacgccttcgccggcgccatatgcgggccgtagccgatcgatccaggccgcccgaattcaggaagaaaccagcacctttgcctcgagatccccgcggaaagcaacataccatcaccaccaccatcttatctctctctagcggcgcggctcccgaggcgggcatggcatggactcatcttgcagtcttgtgccccagctgcgtgtaattaccatggtgcccatcacgtgagccacgggttcgggcatagggtgccgtggtttacgtggaagtggcgggggcagtatggggagagaaaaaattgggagcctttttccgggctgcgaagtgggccccgcggaacagcggcctaggtgctagggccgttaagggcgggcgggccccgggcccaccagctcgagcccggccaccgacgcgcgccggctcgtggctcgccgctggcgcggatgggagggagccggctcacgccggcgagctccgataggctcctcgcgctgattacgctcctgccgttgccggagtggacggcggcggagcaggagtaccggccggcctccgtcaccagcatctccgaccggacgaacatcagatcggatggtcgcacctcgctccaccgctgcttcgccgccggtgccgtctcgtcctcgcagccaccggcggtgctcaccaggatgcggtgcccgaaccgccggtcgtaggcttccgggtcaggctccgccaccgcggccgccggctccatcaacagcaccctgtccttgcgaaccttggcggcctcgaagcatcccaccaccgcaccgccgtcgcctccgacgagatcggccgaccggcgtgaggcagggccaaccctccctggcgcccgtaccgaccccgtcgagtgccggccggagaagaagcctctaaacgctggagacggagcaggagcagcaggagctaagctcgcctccttgtccttggccgtagcagccgccgccgccgccgccaccttcgtctccggcggatcagggggccccgtggtggacggctttggcggctccgggaggagcaggacgtcctcggggtcgacgcgggagcggcacagcgggcacgtcgagtgcgcgtccagccacgtatccacgcactcgacgtggaacccatggcggcatttcggcagcagccggagcgcctccgtcggctcgaaccggccgaggcacaccgcgcactcgagcccagccttctgcccacggagcgcgccgaaccggaacaccggcagcgactccaccacggcgcggtcgacgccggagttccgccgctcgcccgccccgcccccaccggacgacccgaacgcgccgccgctcccgtacgggcccgacgactccgcggcgttccgcttgcagtgcttcgcgtacagcagcagcaggaacgtgatggagaacacgctcgtcaggatgcccacgaccaccgcgacgcccggcctgaacggcgtggccgacgacggcggcggcgacggcagcggcgacacgatcgcgccgtcgtagtcggacagcagcagccgccgcgacggctccatcggcggcaagcttagcagcgacaagacgagggattttagatgtactccacctccactacacgagacaaccacgagtgtgatttgtaaccaagcggtagggggtaataatagcggtggagactagcgctctgcggtggtgaccggatcttccgggcggtggggcccagtggcagtggcagcgggagaagggtggggccactcgccgctgcgctgctccgccggtgaggataaccagttcgacgccgtgcgggttgtcgcggagtggcagtacactacgggtggcactgagccactgacagtttagttgtggggatgtgggcccatgtgtcagtagatgaatggagtattttttttcccttttttcccgaaagaaaagggcaaagggagcagcatgggctggggagcagagacccctgtttcgagctagtaatgcgcatttaagaacgttaggacgcgagattactgttttgtccgtcattaaatagcctactaatgctgacagctcaagggcaatatcgggaatttttcaaataaaaataaaattcgtgcgcgcgttgcgagggaatgaatgctcgtgggaggaggaggaaaaaaaaaaggatgagcgcacagacgcacacgcgaggtgattaccagttcagtcgctgacatggctgtcatgacacggcgtgggtcccacatggcagtgaggaattactgttccggatggggtaggtggcacgtcgatgctttgcgaggcagcacggaaagaggtgggggctctggactggatcatccaagttcgggacacgtgaggctctggctagtgatctcagcgaaatttgaatgtttgctcctgaaaatttttaattttccggaggttgcccgtgcggcattcaggctcatcagcaggcagcaggaccagtacttcattcgcgagttatttctgtggaattttatggcgtaaattaatccaagttcattatctacgtaagtacagtacactgctccagatcgagttcgattaatactacagcatccaccatatacttgcccgccccattcataatttcagaatctgaaactccgaaacgcacatcagcgaattgctcactgtgaaatgcttttactgttaccgcgtagtacagcttccatggccattcgtactgtacaggtgaacctgcgttaaaactgagagaggaaataagaagaacagtacgaatttatatgctactgctcgggacatcgcccacgttgcatctccgtggatctggacgcggcggcactgtgcaagtacactccaatgatagctgcgccatggcaacttgctcccggtgaagccatcgacgcatcaccatggcccatagaggctgcaaacctgtcgacctgccatgccaagccaaccgatacgacgacgttcgtatacatgtacgccccttgaaacttctacgcacgcccgcatgtacgtacgctcgcccctcgaatccccctgtacaattcaccggtgtcgccgtgcgcctgcgtcctagtagcaatgttgagcaatagttggcgtcgctgcagcgcaacaattttgctggcgattttcggcccatctcccgcgcggcgccggggatttttacgcttttttcagccggtcccccgcggcaacgcgcgacaggccgtgcgctgcaggcgacataaggctgtttgagccgcctgcg

SEQ ID NO: 60947 - DNA, 2365 bp, Oryza sativa
atctctgcagtggattgcgcaggtgttcatggcgtcacagtggtggatcgagcgagcggcttgtcgtctacgtctactccctccgtctcataaaatcaacctaacaccaccaaatataacacaacataatactataaatttagatttatattcatcgtactagaatatgtcatatatccgatcctactccgtacatgggagtacgatggcatgcacgagccgattgatcgtcgtaagcgcacgcacgcgtgacgactgacgcgtgcatgggaggaatatgacatgacacgatcaaaacgaggattgatttatcgtgttactccctctgtcccaaaaaaagtcaaaccctagatttccgtgccaacgttttactgtccgtcttatataattttttttataattagtatttttattattgttagataataaaaaatgattaatactttatgcgtgacttatctttttaattttttttatattttttttaaataagacagacggtcaaacgttggacacggaaatcagggtttgtttttttttgggacggagggagtacactgttagctctggcagccagttggggcgcctgaatgacggtactgttaagaatggaaggtatcacatcaatggagctgacaagagctagcgtgccattcatctgccgacgctgttcttgtacccaaaacggcactgtttaattcagccttttcgtcggcttgctccgattcagtagctcatacaataatgtagggatttccggtgtattgggaaacatccttcaatagttcaatttcactgttttaatccattttctaaaaaaaaagggttcaatttcacagcatgacgtcttctatatcgaaaatgttgttccgtatactctctgtgagtctgtgtgcaaggtacgggcaaaagccgcatgtctatgctccttataagcttattgtgttatttttccggcccaaagcatcgagcccaaaatagataacagggccatattctgggtattctgccggcccacatgaattcttcttattgaaaccaaaaggaataagttcactttaggtcccttaatttgtcgcccagttcgattttcgtcctcagtccacaaaaccggatacaacgcatcccccaacttaccaaaaccgtgcagacgagatccctcggcagtattgtgcccggttttggatgacgtggcgcctacgtagctggtttgactaagtctccgtcctacgtggcattggcgtggcgcttacgtggcaattgatcccaaaaataatagaaaactgtaggacccacgtgtcaattacacataaaataataaaaaaggtggggccatgttgcggcggtcgcctccagtagctggctgggcgcgaagcgagttgcggcggcgttcccaccgcagctcctcggccttccgcggctgctgcggcgtcggcgacaaggaggaggaggcaacccgtcagttagtagcacaccccgagagttcaatctaagcggccgtggcatggagaagggcacattgatgcagcacacattaccttggagtggcgatagggcacgccggaggaggaagcggggccggaggtggaggaggaggagacgtggagcgcgacgacgagcagcgttgcatcggcggtgatggtggcgcctatcgcggcgagcgagagcagccaccaccgcaccgccgcccaccgccccgctgcagcggcgcccctcacctttcgccgcagtggcaatggcgtcgcatccgccctgtcatggctaccacacgggaggtaggaaggtcgatccaggcacgggggtcgctccgtgtctcaccgatggggatcgatcctcgccggcctcgtcgtcacggctgtctacgccatctccaccgtgtgatctcgctccggcttgacgatgacgaccccggcaagcctatcactgtcacgcggtgccgcacagtagtaggaggacgatgcccacgaccagcttcgtctccaagtctgaattttctcctttccttttcttcaactgaagaaactgttgatgtttgattaatctgcagcttgaatggagaatgcatgcgtgcataggccgggtatttgtagccattgattcgggcaatttcgcttggaagcaaaggctccgaaagtgagaacattgagtgtttgacgaatcatgcgaggaggaatgggaagatgcggtgcatgaaaacccccttcttcgccaacggcgcctttggcggtgacgcggggtcgggctttcaggcggcggccatcgcggcgggtgcggacgggaaggtcgcggtcgacgggcggcggcgaggcgactgcttctgcgagcctaaaatctcccccccaaccacgccgctggtctcctccaa

SEQ ID NO: 60948 - DNA, 20812 bp, Oryza sativa
ccgatcgatgtacgcatgacatcggcttgaaataaatgatatgtcatcggcatctagtcgatcggctatcatttataggattaattgcggtttctttgttctatctcttgttgattgcaggatcaaatcaactggcacgctcatacatctgaaggcgagctttggacctgcactggagttaagcagatctcccaggcctcgtgttttctgtcaacacacttttggcacgcccggtgggacccattaggagtcagaaattaatcttcctcatggccgagaagctgccaccgtcgccatcctcggctagcccaggtactgttaaagagaaaatccaaatactaggtttgagcgaagttaatgaagggaatattgtggctattgatccggaaaagctcacacctgaccagaagaaggatttcgaagcaatgatgcaacaagagaacagttcttcaagtcattcacacagactcgcaaggcaacattgttcaaaagtacaaggtaaaggtggttcccgatgagcctgagaccagtacctctaaggagagagaagaaaaaagagttttagatggctcagctcaagagaatcagggtgacggctctcagggggtacatgcagttcaaggtgatggtgctcatgagccacaaagaggaaatcttaatcagaatggtgagacaacacaagattttttcaacaatttccaagatcgagtggactacgccgtacacaatgctctgatcaatcaatctagagtgttagtcaacaccttgtctaacatgatgaagacgatagccgatggatcaatagtcgagcatcaagctgcaggcccggtctacttgcagggaggtgttttcccgaattatcaacctctgatcactgatgttcagccgcctactcaagcagttcttccgagtgcaccatcggctcagccgatggcaccgccattgacttctttgcctgctccatcagcgtcgacactaggccagccgaataatcctcggctattgatgagggagcagccacagcatagcgggcagacggtaaatcggccaacacaggatcaggtgactgctatgtttctacccctccaatctactgtcaattcgattcagcaggcgccgccaaggcaacaggttgtgcagccgattcaacagactccaccaaggcagcaggttgtgcagccagttcagccaacacctccagaacaacaaactgtacagccgattctgcagcaggctttgatgaatcaatcggctgggcaatcggctgggcacgtcctgaatcaggttgttccagaacatttggttcaccatatacagccagatggtacggtgatgcctcagattatgccggagcatttggtgcaaagtatgccggaacatttggtgtaaagtattcagccaaattaccagaattgccaagggggcaatataaattatcaatatcagcctccttcccctcaagttcagtatcagcagggagggctaacccaacctcagtttgcttctcaatataatcagtttgaaccaatacagcaacagtcgcaaggagtagctcaacaacgaccatgggccgatgtaattgccgatgtaatgagagaacaatttgggcttaagccgagagatactggaaaattgtatcggcaaccttaccctgagtggtttgagaaagtccctcttcccaaccgatttaaaatcccagacttctccaaattttcgggacaagatggtgtgtcaacttataaacacattagccgatttttagctcagtgcggcgaagcatcggctgtagacgctctcagagttagattatttcagttgtccttgtctggattggcttttacatggttttcttctttgccgtatggatcagtcaatagttgggccgatttggagaagcagtttcatagctatttctacagtggagttcatgagatgaaattatccgacttgacggcaattaagcaaaggcatgatgaacctgttcatgagtatattcagaggttcagggagatgaggaacaagtgctttagcttaagtttgactgatgcccagttagccgatttggcttttcaaggcatgattcctctgattagggagaaattctcatctgaagattttgatagcctgtcgcatctcgtgcagaaggtaacattgcatgaacaaaggtttgcagaggccaggagaagctctaagagggttaatcatgtctgcccttacgtgtatggatcggatgatgacgacgatgactccgaaatagctgcagccgaatgggtaaggagtaaaaaggttataccttgtcagtgggtaaagaattctggaaaagaggagaaatatgattttgatattaccaaagctgacaagatttttgatctgctactccgggagaagcaaattcaactccccgctggtcatgtaattccatcggccaaggaactaggcaaaaggaggtattgcaaatggcataattctggatctcattctactaatgattgcaaggtttttagacagcagattcaagtggccattgaaggagggaagattaagtttgatgattccaaaaagccgatgaaggttgatggtaatcctttccccgttaacatggtgcataccgttggtcggacagctgatgtgggacgagcgagaggttttcgcgtgaattcggctaaaattataaataagtatcagaagaaatacggcaaacaacaagagaggcattatgaagaagataatgatggtttcgatcctcattggagttgtgagttctttcggttctgctggaacgaaggtatgaggctaccatctattgaagactgtcctgggtgcagtgatattacagagagttcaagctgatcgtacaatagaggcaatcggctgaagcaggcgagaattcctgttcatcaaaggttgggcccggtaaatcaagacgattacttggaggaagacgagaacgcaaagacccagtggtatccttctggtattttttacaaagaatcagaaaagaagggttcaaaggttgaggagtagggagcgcttccaggaggtcgagcaagaaattggtcatcggctgagaaaagcaaagccaaggaaggagtggtgtgttaagaatcaagatcttggagccgatgatattgcagccgacgaagcaaagaggttggcaaatgggaaaagtgttgtgacggcgccaattaacatggtctttactttgccagccgaatttgggattgaccaggccgatgttgacgaattagaagagggatcggctaagttggttctatcaccagaacgagcagtctttgaaaagcctgaggggacagaaaatcggcatcttaaaccattgtatataaatggctatgtcaatgggaagccgatgtctaatatgatggtcgatgatggggctgcggtgaatttgatgccttatactacgttcagaaagttagctagaactactgaggatctcatcaagacgaacatggtgcttaaatactttggtgacaacccatcggaaacaaagggtgttctgaatgtagaattgacagtcggcagtaaaactatccctaccacattttttgtcatcgatgggaaaggttcttacagcttgttgctcggaagtgattggattcatgccaattgttgcattccttcgaccatgcaccaatgcttgattcaatggcaaggcgacaaggttgagattgtgccagccgacaagtcagttaatgttgccagtgccgatctagctctttgggagatggatgaccttgattgtttatccgggaagatttgggttggagattttctaaaagtgtccgattctgatatacaaccgattgaagatgaagaacccaagttattattttgagggcgtcgtggagggttcaagcgtctacgccaaggacacggtagatgatctcgatgacaagcaaggtcagggttttatgtcagccgatgatttagaagaagtggatataggtccgggtgatcgaccaaggctgacattcattagtaagaatttgtcttcagaatttagaaccaagctgatggaacttttgaaagagtttagagattgctttgcttgggagtattatgagatgccaggactcagccgatcgatcgtcgagcatcgattacctttaaaaccagggattagaccacaccagcagcctccgagaagatgtgtcacgtcccaaaacgaccctaaaatatatcctttaaattatgcctagaataattaaaatccgtgtgaaagcctccaaaaattaaaatgtgcaaagtaaaagtcaaataaggcttagaggatttttgtatatttcctaaaagcctaaaatgtataaataaattttagtggaattttcagagcacaaataataattgttaagaaataaacaaagttaaaaaggttttataaaaagaaaaacccaaaaaagtccccttccctctaatgggccggctcggcccatctccctccccctctctctcctctccccgcggcccactcggcctctccccgcgcgcgcgccgctgacgggcgggcccgcccgccaccctcgctgacgggtggggcccacctgtcatcctcgtcctcctgccgctcccgcctccccgcccgcgccaagcgccgccgccgccgccgaatccgccgcatcccgctgtccccgcgtgcaattaagtggggggaaatattccccgtgatcccctccccctgtccccccatttttccctctctctctcgcattcaaacgggcggatttgctcccgcaaatctcgccggcgccattgatggcggccggacctcccggccggtttccttcctctccaacttccaaccctatttaaaccctccccgcgcctccctcgcccgtttccgccccttgccgcaccgtctccccgccggaatcgagctcgcgccgtcgccctctctctcctccatcgccgacgacctccggccggccttctccactcgccgggacagtctcccgccccggcatcgcctcctccggcttcgccgcaccgccgtcgaccccgtccaccccctcgccgagctcgccgaccgccggaacgccgccgaccctatcgacctaagccgcgccgccgccttcctccgctccggccgcccttttcgtcgtcgccgtcgacctagggtgagccgtggaccgccgcctcttttcccccttcccttcccctctctcggccgccgctccgccgtgcctatggccgccgccggcgaccataggggagcgggcgccgcctccggccggctgcgccgtcgtggccgccttcgggcgcgtcgaatggccgccgcgtggggcccggctgacgcgtgggacccacggcgccggccggtgtgagcccgggtgcgcccggtccaccgtggaccgtgaggctgccgcgtgggccccactcccgtggacccggtccgcgcgccccctccccttggctgaagcaataaatcctttttaaattaaaatttaaatgatgaaattcgcaaatattcacttaaagagcatataaacttcaaatgttcataacttggccatttgaactcggaattggaccgttcaagtctctaatttttccttaagaagtcaagaacccatttttgtgttttgttcctgcttgttatatggagttttttagagtaaaagcctttttcctttccgttggtcgtgtagacgctggagcttcggaagatccgctctacgtggaggttgaagctgacgtttgggaaagcgagcaaggcaagtcacatcatccttgaacatattgaatcccagtttataaaattattttgatttaaattattgcattaccgctttacttaaattcccgcgttatcattgttttatttagccatgcctatttacctttgttatgaccttattattattgttattgttattattaccttgttcaccctagaataaacaaaaccccaactagtgggtactctagtgtgaacttacgtagatgcttcgctggttaattaggcaacattaggtggttttacaactctagactttgggaatattcatatcacctggacactatggaatgattggattattgtggaattggattcacacctccccctctattcaaaaccctcaaaatggttttatgctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggaaaatgaaggctacacgagctgcggcccggtagtcgatatgtcatggcacagggctggtgtcctgctgctaggggctcagtcctgcctacctgtcccggaggttccggccgtaggtggggttgggtcggtactcttgtctatggctaggatgggttggaaactatgtcatgtcttccgtccgtatgccgtggtggtatgtggcacgtggttacacgtgaggaagacatgtcttgtgggtaaagatgtacacctctgatcagagtataatctattcgaatagccgcgccctcagttatgggcaagccgagcaatgtacccaagttagtgttttaaattcttaaaacttgcttaacaactaaaatgtggaatggttggcctgggttggcttgggacgagctgggacccagggtcgggttgccagttcggtctgaatcatcgtaggccttgggttaagacaggttcgtgtgggttcacggccttgattaataatattgtatagctctaggatcgtatttacaaaatagcttgagcaactaagtgccttttaatgctgtttactgcaaaccctaaccccctatattatgactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtacctgccgtcaagcgcctgtggtcgtcaccctagtcttccgctgtttttcgtttgtcttcatgtgtgctgggccttcgccgcccatgtaataaattaattatttacgcttccgcttgttaaactctgtattgtatcaacttttggtgtaccttgcctcctgggacaaggaataatacacgcacgtaaggaacgcccgttgggttttttcggtcgtgacaagatgcaaagccgatatgcttgaacctgtcaaggctgaaatcaaacgtttgtatgatgctggttttattcgtccttgccgatatgctgaaagggtttctagtgtagttcctgttatcaagaaaaatggtaaggtgagggtttgcattgatttcagggatttgaataaagctaccctgaaggatgaatatccgatgccaatggccgatcagttggttgatgctgcttcaggacataagatactaagttttatggatgggaacgcgggatataatcaaatctttatggccgaagaagatatccataagacggccttcagatatcctggtgcaatcggcttgtttgaatgggttgtaatgactttcggctcaaagagcgctggagctacgtaccagagggctatgaattatatatatcatgatctgatcggatggttggttgaggtcaatattgatgatgtggttgttaaatccaaagaaatagaggaccacatagccgatttgagaaaggttttcgagaggactaggaaatatggtttgaagatgaatccgacaaaatgtgcttttggtgtatcggctggccagttcttgggatttcttgttcatgaaagggggattgaaatacctcagaggagtatcaatgcgatcaaaaagattaagcctccgggaaacaagacagagttgcaggagatgatcggcaaaattaattttgttcgaaggtttatttctaatttgtctggaaaactggaaccttttacaccattgttaagattgagagccgatcagcaattcacttagggggcagaacaacagaaagctttggataatattaaagaatatttaagttctcctccagtattgatccctccataaaaagggattcctttccgattatatttgtcggccggtgataagtcaatcggctcggtcttgattcaggagcttgaaggaaaagagagggttgtgttttatttaagccgtcggctcttggatgcagaaacaaggtattctcctgtggagaaattgtgtttgtgtttatatttctcttgtactaagttgaggcattacttgttgtccaatgagtgcactgtggtgtgtaaagccgatgtgattaagtacatgctatcggctccgattttaaaatggagagttggcaagtggatattttctttaatggagtttgatcttcggcatgaatcaccaaaggcgattaagggacaggctgtagccgattttattgtgggtcatcgtgatgattcaatcggcttggttgacattatgccttgggtattattctttgatgaatctgtatgcagtcatggttatggtatcggcttggttataattgcgccttgggggcaagttttgaatttgcctatgctattaaacaccgtgtgactaataatcaggctgagtatgaggcagtgttaaaagggttacagttgcttcaggaagttgcagccgatgctattgaaatcatgggtgattcgttgttggtgattagtcaattgacaggagagtatgaatgcaaggatgatacattgatggtttattacgaaaagtgccgaacgttgataagtgaatttcggctggtgactttgaagcacatatctcgagaacagaatatagaggctaatgatttggctcaaggagcgtcgggatataagctgtcggtgacatgggatcaggagtatcatgactagaggtttgaggcagacacaatcgcacacgtggcctggtacccccgagggacgtcgggcccgagggtgatgcattcgccctcctcttagtccccccgagggggtcgggccgcacccccctcggccccgagggccgaggcgccccgacccctcgtgggtttttgctccgcgtgtatgggttaggtgagcacagtggggctcacctaacacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatccaaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaaggggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtcttgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccactgccccctccacgccaaagtcctaggtgggagaaggcgctcgagagggccgaaggatccgcgacttcgacacccacaggaggtggagaagggcggcgagatggggagcatcgcctcctcgtctacggcgacggcagcacgccccagggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccatcggctccgcatcgtcaagatggagggcgcggcgagcggcagccgctgttcgccattcggccgccactccttcgtgaacgcctccgacccgggaagatctgcgtagggaaccggatgctcgcatcagtatcgagcgtcggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtccaagtccgcaacaccataccatgcatccctgcgcacgcggtgatttacgcgttcagggggggtgtgcggcacaaccgcatgcttgaaaagatcgcctccaaggagccccagactaccgcagagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggagaagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgtcgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccgaaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgattccactgcggggtgcgaccttttgtgttttctagatgcatactctggttaccatcagattcgcatggctagggaggatgaggaaaagactacgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgtgcaactaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggactgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgctttttcgacgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaattttctgagttcgatttgcactttgaaccacgccacactatcaagagctaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggagagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcagcgcgcggctaatggaatcctcctgaagtgcattcctcgggaacaaggcgttgtgcttcttgccgatatccatgaaggcgaatgcggagcccactccgcctcgcgcatcttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcgacgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgttgttttttccttttgaagaatcttgacttgaaataggtcactcgtgctcaatcctgccctcgggggctcgggtcggctaaaatcgccaaacggggcccagaaccgagccgtgccccgaggcgtggtgaactcccagggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccaccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcatggtggtggcaatgagggcagccccccgctcctcctccacttccttggcgatctccgccagcaccttcttacgagtttcaagctccgagacgtgccggcggtgagccttacggcccacctccaccatggcctccaccgagcgtcgccccttttcgacacgcgcccacgcggcgtcgagctccgcccgctctgcctgcaggacctccacctgggcacttaacccatccaacaccgtggtgtttgcggcggccaaggcctgcagaaggggctttgcgttcagtagggcgatagaaggcgtggggaagagccgccttggagaggatgccacgcggctcgggccgccgatggaagtgccggactcggggatgtccccctgacccggttggtcctgagcgtcgcccgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcagcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcaccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcacgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccaatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggtgcaagcggcgaagacaaggggaataatggcgaaaggaaggaaacagatcccttcctctgtgcctttatactcttgccaacgctgtgcccggctcctcgcttctcgcgcccactatttcgccccctcgtttctcgcgcccacgcttccactaatcccattcgcccgcttgcggcgcatgaggtgggtatgcggttgtggcagtcgagatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggacttaggagtggcgtcacgcccgaccgtttcccttaaagagggcgatcgccctggcataacgccggaggctactgtcggtgacatgggatcaggagtatcatgactagaggtttgaggcagacacaatcgcacacgtggccttgtacccccgagggacgtcgggcccgagggtgatgcgttcgccctcctcttagtccccccgagggggtcgagccgcacccccctcggccccgagggccgaggcgccccgacccctcgtgggtttttgctccgcgtgtatgggttaggtgagcacagtggggctca

SEQ ID NO: 60949 - DNA, 10435 bp, Oryza sativa
gtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggaaactatacaaatctccgtccatttatgaaaagggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcataagccaatgataaaagatatcgaaatagagattgctacaattacagccgatgattggagatatgatgtgtttcagtatttacagaatccatctcaatcggcttcgcggaaattgcgttataaagctttgaaatatactttattggatgatgacttctattatcggacgattgatggagtgttgcttaaatgtttgagtgccgatcaggcaaaagttgcaatcggcgaagtttatgaagggatatgtggtacacatcagtcggctcataaaatgaggtggttgctccgacgtgctggatatttttggccgacaatgctggaggattgtttcagatattataaaggttgtcaagattgtcagaagtttggagcgatccaaagggcgccagcatcggctatgaatcctattattaaaccgtggccttttagaggttggggaattgatatgatcggtatgattaatccacccttgtcacgaccggaaataacccaacgggcattccttacgtgcgtgcattaatccttgtcccaggaggcaaggtacaccaaaagttgatacaattcagagtttaacaagcggaagcgtaattagataacttattacatgggcaacgaaggcccagcacacacagagacaaacgagaaacagcggaagactagggcgacgaccacaggcgcttgacggcaggcacgagctagacaccgaagccttcatcctcctggaattcctcttctggggttgggaaaaattgagcaagactgagtacaaccaccgtactcaacaagacacacccacaaatgcagaataaatgcaagggagtacaaaggagttataccataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccgtcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaccatttttggggattttgaatagagggggcagtgtgaatccaattccacaatactccaacaattccacagtgtccaggtgatatgaatattcccaaagtctagagttgtaaaaccgcctaatgttacctaattaaaagcgaagcatctacctataattgtactagtggcaccatgagtagagtgtccactagttggggttttgtttaatctagggtgaacaaagaaataataacgataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacggtccacggtggaccgggtgcaagcggcttgcgccggccggcgccgtgggtcccacgcgtcagccgcacccgagggcgcaggcggctgacggccgggccccacatggcagccgcggggcgcgcccgaaggcggcctcgccggcacggccgacgggaggcggcgcgcccgcgccccgatggtcgccggcggcgacctccggcgcgacggagcggcgcccgagagaggggagggaagggggaagcgaaatggcggtcctcggctcaccccgggtcgacggcgacgatgggaacggtgaccgaagcggagagaggcggcggcgcggctcgggtcgacgaggacggcggcgttccggtggtcggcgggcgaaacgaaggggtggacgaggtcgacgaggacgcggcgaagccgaaggaggcgatgccgaagcaggaggaggtccggggcgacgacggcggcgaaccgaagctcggcggcgacggcggagagagaggacgacggcgcgagctcgattccgacggggagagcgagcggcgaacggcggaaacggaggagggaggcacggggagtgcttaaatagtgttgggagggggagagagcggccggagaggaaggaaatcggcgcggcgatctcgggctccattggtgcgccggcgaagatttcgggagggattccaaacgaatccgagggagagagagagggaaaagaggggggaaagagggagggaatcacggggagtgatttccccctctttattgcgcgcggggacggcgggatgcggcggaatccgcggcggcggcggcgctagggcacgggcgaggcggcaggcgcggcgcgaggtaggggatgacgggtgggccccacccgtcagcgagggtggcgggcgggcccgcccgtcagcggcgcgcgctcggggaggaggccgatgggccgcgggggagaggagagagagggagggagttgggccgagccggcccaagagaggaaggggggaaaaggacttttagggatttttctttttataaaacccttttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattctttgcataatttcgaggatgtattttagagtcgatttgggacgcgacaaacctaccccccttaaacggaatctcgaccctgagattcggaagaactggcgaagagatctggatgggctgccttcagctcgtcttcgcgctcccaggtagcttcttcttcggcgtggttgctccactggaccttgcaaaaacggattacccggttcctggtcctgcgctccatggtgtccaggatcttcactggcctctccacgtaggtcaagtcttcgcgaacttcaatttgctctgagtcggcctgctcggatggcactcgaaggcatttcttgagttgcgacacatggaacacatcatgcacgttgcccaaggaggcgggcagctccaattggtaagcgacttctccgcgtcgagcaacgatacggaaaggacccacataccgaggtgcgagcttcccttttgtccgaaacctgtgtacacctcgcaatggcgtgacccgaagatatacaaaatcgtccactgcgaattccaggtcacggcgacggttatctgcataacttttctgctgggactgtgccacctttagattatcccgaatggttctgactttagcttcagcttctctcaggatatcagtcccgaacacttggctttccccaacttgatcccacattagcggcgtccggcatttgcgcccatacaacgcttcataaggtgccatttgtatgctggcttgatagctgttgttgtaggagaactcggcataggggagactcttatcccaggtcttcccgaaatccaggacacatgcgcgaagcatatcttctaggatctgatttagacgctcggtctgcccatctgtctgcgggtgatatgcggtgctgaagtttaatcgggtacccagctcttcttggagcttcttccaaaagtgagaggtgaattggcttcccctatcagatatgattttcttaggaacgccatggagacttacgatcctagcgaagtagagttcggctagtttgttccctccataggtggtcttcacaggaatgaatcgagctaccttggttaatcgatccacaactacccatatagaatcatatccaccttgggtttttggaagtccggtgatgaaatccatcccaatttcatcccatttccattcaggtacttggagaggttggagaagtccggccggtcgttggtgctctgccttgacacgctggcacacatcacaaagggccacgaactctgcaatttcccgcttcatactaacccaccagtatttctccctcaagtctaagtacatcttcgtgctgccagggtggatggaataaggactttcgtgagcttcctgaagtatcaactgtttaagttctctgttatctggaacgcatactcgatttccgttccatagggttccgtgttcatcctctgtgaaaccagcggctttaccctgtttcatattcttgaggagtccatgcatgtctggatcattcttctgagcctcgcggatttgatcgagcaaggtgggcttggcttccagcgcagccaagaatccgcgactaactatgcttaggttcagggcttccatctgttgattaagttcgggtggaatgccacggacgttaagagtgttgcaatggctttttcgacttagagcgtcggcaaccacgttggccttaccaggatgatagtgaattcccacatcataatccttgatgagttctaaccatctcctttgtcgaagattcaggtccgactgagtgaagatgtatttcaaactcttatgatcagtatatatttcacagcgattccaatgagatagtgccgccagatttttagagcatgaaccaccgcggctaactccaaatcatgggtagggtagttgccttcatgaagccgtagctggcgtgaggcataggccaccacatgaccatcctgcatgagcacgcaccccaatccttggcgcgaagcatcacaatacaccatgaagtccttgtgagtatccggcaagattaacaccggcgaggaaaccagcttttctttgagagtttggaacgccttctcgcattgcgggctccacacaaatttctcttctttcttcaacaattgtgtcatgggtcgagcgattttggagaagttctcgatgaatctccggtagtatcctgccaaacctaataaactgcgaacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatgttcccgcagctttcccaataccagacggagatggtgctgatggtcttcctctgattgtgagtatatcagaatgtcatcaatgaaaaccaccacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcgcgaatacgtaattggtgatatccggaacgaagatcaatcttggagaatacagtggcacctttaagctgatcgaacagatcatcgatccggggaagagggtacttgtttttgatggtaacttcattgagagctctgtagtcaacgcacatcctcttcgtcttgtctttcttctccacaaaaatcacaggagcaccccagggggaagtactcggacgtatataccccttttctttcagctcttccaactgtttcttaacttcggccagttcatttgctgccatacggtagggtcgcttgtacagaggagcggttcctggagcaagatctatccggaactcaatctctcgcttaggcggcataccaggtagttcttccggaaacacgtctccgaactctctgacgatgggaatttctgacagttctatctgatgaagttctgaacttctgactgaggttgggggtgcaaagaaaacaaccggttgttccggccctcggtacagagtgacagtgcgtctcgcgcaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgatgagcagagggtttctaagcctttctacccccaactgatttctccccacgaatggcacagatataaacgagtgggaagctccagagtcgaacaaaatggtagcagggatggaatgaataaggaacgtaccaacgatgacgtctggagttgtcagcacgtcctcggccgtcacatggttcacacgaccccgaatgacgtccttaccaccgttgttggggcggggaggcgcttggccttgctgacgccttggcttcgggcatttatccgcaaagtgcccgggctcgaagcagttgaagcacagacgctgcggaccttgagcgtccctgcggccttgaccaggctgcacagtcggtggaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttggttgcggaaattcgccaagcggcgcttgtgcgactccagttccttgtgcttggcttccaagcggatgctcttgtccaccagacgttggaaatccggataatccccggagactagacggacggacagctcagggtccattcctgccaggaacttctcttgcttctcctcatcttcccgcacatcctccggagcgtaacgggccaggttgttgaactcgtgcaaatactccatcacggagcggtcgccttgcttcaactctcggaattcccttttcttaagggccacgactccggcgggcacatgggttcttcggaaagcggcggtgaagcgagcccatgtaataggctgtccctctggctgcgtagcctggaaatggtcccaccatagagatgcgggtccctgcagctggtgggcggcgaagatgactttctcctcatcgctgcactgcacagtgtctagctttttccccacggcatgcaaccaatccaacgcatccacggggttgttggagctagagaaggtaggtgggcggatgcggagaaactcggcgagtttagagtgttgtgggggtggtggtggagcattaagttgtggcggattttggaggtggtggaggaaagcagtcatcatgttggcctgctgggcgaggatttgggtgagaatggcgttggtgtctggtggtggtggtggaggtggaggaggaggtggaggtgggttgccctgatggttgtggttgctgccttcaggttggttgccatcaccggtgttagcacttctcctggtcatcaccatctgaaaaccccacacagaaccagcaaacagagagagctgacaattaaagctaaccacccacgactaccataattcttgaatttattactgctattaaatgggttcattaaagttcaagttgcttaggcgaataaaataaagacaggctccgacacagttacaccacacaccggcataaccgtgccccacacaacccaacaacaagacaaacgagaaagaacacacgcgcaagcctactaactgctcgtctactgctgcgacgggccaggacggaaggtgagcaactgcgcatcctccgtgctaccaacgccggaggcttccccctcctggggaaccacgggcgcgggctcggcaagaggggtctcgacgaagcaagtccacgccagggactgacgaacaagctcgggcctggaggtgctcttgcgggcggtgatcttcaggctgcggcagacgcggcgacgcttggggcggcagatctctccctgggcgatcttgagctgatgcagctgcgcctccactgcgtctaggtccttcttgagctgcaggttctcttgacgcagctccaggatcttcaggttgttctcgaccatcccacggcgcaccatctgatggaagtcgatacaagccgcgtcgtacgcctccaccatgcgcgccaggtgcacgatggtagcgtcatcctccgagctagcatcccggaaggtggcgtggtcgcgggctcctccgcgacgagggtggtagcggtagggcgagtgctgcaactcgtccgggtagcgctggtgaagagtgctgatggcgaggagagcggcgctctggcaagcggcggggaaggagtctccacccgcggtgactgtcagcgaagaccgctcgggagagccagcgaggatcactgcagtgacctcccaagcagcgtggggctctgcatcatcaccctcctgctccggaagcggcctggcctggtagtccactccgtgtggataccctagggccacgcacataccccgcagctccaagacgaaaccagtcatgtccaaaccacgacgggtgacgctgccggccatctacaaacaaaaacaaaaagaaaagcaacattttaaaggtcagattttggcgataaatgaagcagcaagacagagagagactagaggattttcacaaataagaagggattttatttttgaaaatattgctaaggcttgggatctacggctcgtcctagggtcaaaggggctctgataccaacttgtcacgaccggaaataacccaacgggcattccttacgtgcgtgcattaatccttgtcccaggaggcaaggtacaccaaaagttgatacaattcagagtttaacaagcggaagcgtaattagataacttattacatgggcaacgaaggcccagcacacacagagacaaacgagaaatagcggaagactagggcgacgaccacaggcgcttgatggcaggcacgagctagacaccgaagccttcatcctcctggaattcctcttctggggttgggaaaaattgagcaagactgagtacaaccaccgtactcaacaagacacacccacaaatgcagaataaatgcaagggagtacaaaggagttataccataaaggggttatggttgcagtaaacagcatttaaagatatttagttgctcagggctattttgtaaacacgattctagaactaaacaatattatttatcaaggccgtgggg

SEQ ID NO: 60950 - DNA, 3045 bp, Oryza sativa
  unsure (1)..(3045): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggacggcgggggcacgtcgtcgccgtcgacaaggatgtgccagctccgtcgcagcgcgtccgcgcgggaccgcggcatgcggcggaggcgaagcggcggcctccaccccgtggtgatcggctcggagtagctgatccccttcgcgatctcgccgacgggcatgagggccttgcggtcggagaggtgctcgatcatctccctctcctgctggagcagccgctcggccggggtcacctcaggggcctcgcgcttcagcttcgtggccttcacgagcaggctcgtcttgaccgcaacctcacccaccgccggcgacgaggtggagcgcggcggcggcggcggggctgcaactgcaactgcgttcgtggtcggcggtttagtggcgcggcggaggcgttcggcctccatggcccggcgcttggcgacggggacgtactcctcgtagtcctcctcatcgctgtccggtgttccgcggcggggcgagtcgccggcggcggcggcggcggcggcggcggccatggcgggatacgagttggagggaggcgattcgcccagggagaggaagtggtggcaaaagtcggtttcgcctagaagtcgctagatttgatacgcgtggaggcccagtagaaaggctttgggatgcagctgggccaagttcgcgagtcccagtagagatttgggctttgtgaaatctggagattttatgtggccgaccagtcttggatacggcctggcccattttgttggttatggtcagcccatgaatgaatggccagggattctccagtccggtctgattgttacgtgggccgtcagatggcacatggccggagaggtgacaggcgggggtgctggaattttttcacctctgaggttgaaactcttgtcagtaggaaatggaggtaaatcaaatatggagtccagtctcataaaaaatctctttacacctctcatactgagaatcatactcctacatcaacattgaaaagtgttacacggtcactgtccatgtgttgccgtaaaaatcttaattcttaacagtactgcagccactctatcaccgtacagaccgtcactccatgagtgcactgcgcagcagggtgcagatgagaagcaaatgatagtccatgtttttatcgtcattgccatgcatgcatacagctggttgccatttgcgagaacagcattcacagcagtgcaccgtacgtcctttcgcgtcgccttctgccaccccggcccaccagcctatcagaagactatcccctgtgtgtaccagtgtatcatatcgatcgccaaaacggaagtttcaataatccacgctatatttttgcctgttcaaaacacagaatggaaatttcacttcacgcaatagcactagccctgtactgtaacacttatttaggcacgtgatgcttggagcgaggtggagattaaaaaaaaaattggcgatgtcagtctaatcggcgagttacggcgcccgtgctatgaatgcccatgcatgaatgtcgcccatctgccaaattaaacgagcgcgtaaatgatgcaacaaaacaatgctttgaatcatcacggcggtggtagctagccatccaattttgaagagccccagatcgatccatcgaacttggctcgtctgaatgatgagatatcgagagatcccttccctccctgcaagctgccgccaggatgcgacgaatcctctcgtctcgtcggtgggccggacggacggacggacgaacggcgaatgcgtcagcgcacgcagcagcgcagcggataaggcaaaaacgcgcagcagccagccagcctcgcgaggacaacacgtgccagccgcgcgcaggcgctgcagctgcagcagcagcggcagcggggtcgcgcacgggggacacacggcggatgccgggctcgcgcacgcacgcgcgcacgggcgcacgggcgcacggccaccccagcgctgcgcgaaccgtacgcgtacgagccgtggcacagctggagcgcagcggtggctatggcgtcacgagatcaaccccacgtaacgtacggtggtgcagtgccgacccgaccggggaatgatggcctgacgccgggatgccgccgcgcggaggacgcggccggggaaggcggattgatctcgatctgcccatgtaaaaaggcgaagaaatcatgcatgccgctcacacgccgtcacgtacgcgtggcgacgcgacgaggcagagtaggcaaccgaccagctgctacccgggagcaaaaccggcgtgccgcggttgcgcgtacgctggtttcgtgctttctggaaacatcgtactgtatatactttcagtatgcgactattagtatagtataatcttctcgcggagacaagtattttgtatattatgtaacgacctcagcagcagcagcaacagcaatggagtactcctttaattagatgtgatgtactatttgtagtaggatatatcacatccaaccaaattttcttatacgtagtattttctctgttttataaagtaaatattttagcattacccaagtttatagatatgttaatgaatctagatatatatgtgtgtctatattcattaacatttatataaatataaacaagttttatattataaaaatggagggaatactatttaggaacagaaggagtacagtacagtgcttctgctagctagtgctcgcaatgtagagatgatacgtgtggcgactgatgttgctaggactgcgagtattgaacacactcacagggcgctgtgttcagcgacaattttggagttggcagccataaacgcagccgagagcgagtcagctaacgctagctaggacccacggagggacgcacgaatcagtcgcaatgataaggctaaaggctagttgatgcttgctggtgagtggtgatcgatcgatcg

SEQ ID NO: 60951 - DNA, 12663 bp, Oryza sativa
agcaggcaggcaaggcaggcaggcaggcgtgtgagcgttcaactccccttcaaatttggagctgtagatttgctgatccactcgtacggcgtacgtgcagcacacgattgatgagtgaggtagtagctgctccagatgctagctggcacacgatcaacaacgaagaggaagggaccccatccttgattgattcaattcatcgcagtagtagtagtatgcatgatgcatctgcatgcagatgtacggagtactcgctacaggttagctagcgtccgtgcgtaggccacgcgtgcatcgcgaaacaattggtaacctgcaattggggctgatgagaaactactccacgcgtacattattgttgttcagctgcgcgtatcctagtacgtcgtgtgtgaaacaactcgatcgagtcgtcgtattgcaaaaaaacgagtcatggctttgcacgaccgggtacaattctttttttatactcttctccattgatcggtgggaacgaggagggctcttggagtttttgtctgtgtacgtgtgagccaggccagagtgtcggacagaggtttagaatttgtaacgtgggtttggctgtgtttagatataaagtttggatctaaactttagttcttttccatcgtatcaacatgtcatacacacaacttttcagtcacatcatcttcaatttcaactaaaatctaaactttgtgctgaactaaacacaacctttgcgtctggattgaggccaggcatgtacatagagctagagattcagttgaagaacacataatttaatttctccatgttctcatcaattcctactagtatgatagtatcattcggtttgtaggaatgagatatatacgaaaacaaaagaaaatccagaaaacatagaaaaaaaaattatccaatcgaatctcttgaaaaaaattctatgaattaatgtgcgcatacatttctattactccacattttctatttctatgaattgaaattcctccaaacctaacaagcctaaaaaactcatgtaaatcgggcttaaagttacttatatttgagacccgggagtacctacaaaaccattattttcagagaaactatagtaaacttttaaaattattgcaaactagccttgagattaggaaaagatagttgtacatcaagatttctcccctgcatcaaagccctgtaaattcatgatagcttaagcattgatcttttgattgatgcaggatatcactaaaaagtacttcctcttattactctttgtctaaattcgttgtcttaggaggagtcacatatcttattaggttgtttttttttaagatgggagtacagcacgtagctcatggtggttggttgattacattggcatcctttattttcaactcccatgcgtggtacctatccttatcaaatgtcttaatcagtttcataatcgcaaaattgaggtggcatgagtatgtttccaagaaaatgatgacacgtttcaaaacctctgcggagcattggcggtatttgtaatcacacgggaccgtattctaccaatacgtcgaaatgtgtcaattttaatttatcccttaaaattgtgcaggagctgaacaatctactacttagtagtacatcaaggattctcatggtgcaaaatccgcagttaaagtcatgtttgcactagctaaaaatttcatactaattgcctaaaaagatacggtggagtaaacaaacagattcataactttttgacaaccagtattcgtacagtcgtacgtatcgtaggacactctgattaatatagttctgacagatatgcaattgcttgccatgcaattatagctagctgtatctgcgtagtactgtagcacagactgatgattgcacttgatgtgctctaaaaaaatcggtccttgaaaaaaaaagcgtgattgagaccctgtttagatgggactaaaacttttaagtccctatcacatcgaatatttagacactaattataaatattaaacgtagaatattaataaaacacatctataatcttggactaatttgcgagacgaatctattgagcctaattaatccatgattagcctatgtaatgctacagtaaatattctctaattatagattaattaggcttaaaaaatttgtctcgcgaattagcttccatttatataattagttttataattagtctatatttaatactctaaattagtgtctaaatatagagactaaagttaagtccatggatccaaacaacacctgaattcatgaacgcaaaagaaatgaaacgaatggtgtgagtggtcagaggtagtaccagcacaagtttgacatgttctcaggacaccactaatgtatatagtaaaagttaaataaactttaactatagcacttctcacaaatgtatatggatacaatatgacattaagagaagagagagaaatagagatagataatattatttatatcatatgggtagttcatatgcatatggatacattttgctattttctttatatgaactagttgcacaatgttaataggtggctgaatggaatagtttatattgtggatgccctcatagcaatgcaacttcttttcttaaaaaaatctgtggaaataaattccatcaaaatgacgagttaggcaaatcactaacctgtcatttgagatgcaaactctattaaatcttcaagccattaatttgcaagaaattaagaatccaaagccaggctgatattagcaatgcattttcctgcattgtcatcgtttcgcacatgactgatacgcttattgcgaaaaaataattaataaatatctttttaaaatgtgcatttaacgacttaaaaactaatgctaaaaagtaaacaacgattaaatagttatttttaaaatttaaattttggttggaactaatagtccaccaaatttatgtacagttaaacctggtgcattggggtcctattcagattcgtagtttctagaaaatatcacgtacctttaaaatttcttatattatactactccgtaggacggagtaccaaagaaccacaagaaaatttatacggccatctgaattctgaggagaacacaaccaaagatggcaaatccagcgatgagcaaacgagccgttgcgtccagaattcgctgaacgtctcggtcgattttaatatctgtactatactactacgtgaccctctatggcgtcgtcgagccgaaccgagccgagccccctctgctgctcgctacagaggccgctgtctctcgcccctctggtgccaactcacacccattacacggctggcaatggcacggcatggcatggcagagaaaagatcactcacttcgcggcaccatccatccaaccatcttccaaaacccctatataaaccccagcttcgccccctgaatctcccacacacactgatcaccgacacaaacccaaagctaagcttcgagctcccccattgatcagtgagctagctagtagctggttggttaaaaggcctttttgttttgtttgagttggagcagaggagaagaatggcggctctgcttgtggtcgtgttggttgccatgtcggccatggtggcgacggccaactttaaccaggagttcgacatcacctggggcgatggccgtggcaagatcctcgaggatggccagctgctgacgctcacgctggacaggacgtccggctcagggttccagtccaagcacgagtacctctacggcaagatcgacatgcagctcaagctcgtccccggcaactccgccggcaccgtcaccgcctactacgtgagtgtcaccttccgccgccgccgttgttgtcgccgatgtgatcatgtgagctgatggtgtttgtgtgtgcagttgtcgtcgcaggggccgacgcatgatgagatcgacttcgagttcctggggaatgtgaccggggagccgtacacgctgcacaccaacgtgttcacgcaggggcagggccagcgcgagatgcagttccgcctctggtacgaccccaccaaggacttccacacctactccatcctctggaaccccaagcacatcatgtaagtcaagtccacacaagaattcagaaattttacaggtgacaagagaatgaatcgtgaatggattgttcgttttgtttgttgctgcagattcatggtggacgacatgccgatcagggacttcaggaacctggaggggaaggggatcgcgttcccgaagaaccagccgatgaggctctactccagcctgtggaacgccgacgactgggcgacgcagggtggacgcgtcaagacggactggacgcacgcgcccttctcggcctcctaccgcggcttccgcgccgacgcctgcgtcgtcgccgccggtggccgcacgcgctgcggcgccaccgtcggcaccgacgccgcacccggcaccggcgccgccgccgccgccggtggatggtacaaccaggagctcgacctcacgcggcagcagcggatgcggtgggtgcagagcaagtacatgatctacaactactgcaccgatcccaagcgcttcccccagggcgtccccgccgagtgctccatgtgatagtaagaatatcccatcgtcgtcgtcgtcgtcgtcgtcgatcgccggcggagcaagatggccggagatgaggaaggtgactggctggcgtctgtaaaaataaataaagattggcactgggggtggtaaaaaaaaagtgtaatgtagctgtggtgggtaaaattcttttttgttctctgtttcgtagtaagccactgcacgccctgttcgtgtgtaactgatcgtgtccatgcaacaattcatgtgtaatatattcctcaacaacatacatgtgtctcgtcctcgatgtgcatacgtgatcgtgatctgctctacgttgcaactgtataaattttgttgcttactactccctcaatcccatcccgaaacaaattcatttttcacatatttcgcacgtattaatctctatctctactattataaatattgaaaatgtttttgtcgatattttgatacgttattcgtgtatgaatcggtttttaatttcgtttgcttttaaaaatacatatatgtatttgagtcggttttttaagactgttcacttttgataatacagaaggatttatataagaaatctatttaaaaaactcgcatgctaacttgagatgatcagatttctaactgcagctcataattttctaaaagtatatatatccaagcgaactcgcgactaaaccatataataataataagattaaaataaacatttctagaaaataaaaaagtaagaatttctcaatttctcaaatcctaatacaattacttatttctttattgttctctatttaaaaatcaaattattttggaataaatgagggaaacttaagaaatgaacttactgtaagcggaggtgtacaagtatagagttttggtctgattaattactcgtggtacagtcatgcactgtgcgttgaaataagttgatcttggtctatcgggtttcaaaaaaaaaagagttgatattggtcttattggtcagcagtgtgtgtcaacaccaggtcaattacttacgtacgtactcctactcagcactgggtctatcggagtagatgttgcggtctccaggtgttgaacagctgtgtgtagtacgtacgtagcctattccattattcgatgccaaacagtctctttaattgatcattaaaaaattaagcgtcttagtaattctttacgattcacgatatggatgtttggttcgacaagagagctttcgtgattagtgcgaaaattaagatacgattaactaaagatgctaccactagtctacgtcacacacgagtatatcagcatggaacaaccaaacaaacagatcaattaacttgattcagaatcaaatccaagcaaatcagttactaactcgattcagaatcaaattcagatgcccctctctcagttaatccacaaggctaattaagcagcagcatgagtgagtactgtgcgagtcacaggacagaagacgacgagaaggggcacgagtacgaatacacgagaaggacaagggctcgtaatgatccgtcaggtctgcagactctcagttgtctcgctgggcactgggcgatcgatgtgaaatgcgtgttcaatttctgattcggacaagtggccgcaccgacagattcacagggtgtagatagccttcgcccatggctggcctggccatcgtcggtcggatttttggatcagcacgaagctgatcgatcgagccaaaattcaccaacagaaacagatcgctgctgctacacagtacagagtaccggaacaaagctacaagccgtgatcttctctttctctgaagaaagatggtggctgtgggctgtggctgcttgccttatcctttcgagctggtcaggtcacggtctcacggaccagccgtttcaggctttcagctactaggagtgtctgaattttctgaataaacaattttacgttacttgagaatatatcataaggcattattttttctattgtaaatttggtatctcatgttacttagataatgtgagataccatgaggtaccaaaatcaccttaaaaaccgtagaattgctttctaaatatttagtaggtgctacttgcggtttcagtcgcccacaccgcttggttgtggtgttaaactggtagggacgttagcccgtttgtagacgatcagtactccgtggtgttaaactgttaaatttggagtagtagtagaaatcttcggtacaatgctttaatgaatcatgatgaaaagtcaaaggatgagcttgcagttttgcaaaatattgtgacaacctattaggatcaggctgtgttctagagagtttttttttatatgagcacggtttctgaaatattaaatgatattttttatataaaaacttgttacataaaattattttagaaaattaattaataatagtttacttaattaatcatgtgacttcttttcatttttttgtgttattgaatcacctcatccaaagtgttgtcatgaacaaagccttagttctttttaattatttatcaaactgttcaaacagattatttacgcggtggtaaaataaaataaaatttctataaaaagaactttcttctacttatattgcttagaccacctattttcgttatttgttaaatatatttaccacaaatattaatttatccctataatcgagtagataatctgcggcaacaattcactcaacaacttatttcaaacgaacatgagtccgttggtgagttttgagctaagtacaacaatctctttggcaatctacactaatggatgatttaccagaaaaaatggagaggagaatgactaaagatgtccctatttcttgttttttttttctttatgcaccattgtttcttgttgggatataagttcgctaagtgtcattatagttagctgtacctacagtgtgcgagtagtatgcaaccgacgtccggctgttttgtcacctcatcatgtctcttcgggtgtcgtctgatagggatttgggagtgggcatgcatggtatctgcagtaaccagtgacttacgattgattgctacacaaaagctctatcacaacttgtgactcttgcatgagcatcaacacacatgatcaaactagtacatctgctcttccttttgtaaactactactagtagtactagtaaaaattatgtactcctacattccttgagcccctttgttttagataatgacattccttagaacttttggaagcttggtttgaacagcaattaaatcatggacggttcagggagttaacaacttcaacaccaacatgtcgtgtatacattttttgtcgtgtatacattttttttctttttgccctgtttccgctgattggagttgcgtttagtcgtcgtactctcttcatttttggtttttctgttttgttttttctccctccccttagcataaaccggtttagctgattgcgttgtgtaaacaaactctctttttttctaatatattgatgtgcaatccttttacgcgttcgtggaaaaagtgtacaaatttttcaatgagagtttgaaatccaattccaggaggaaaaaataactctgaaccagtactgatctatgcatgattgagctggttgtacgcagtgcaatgatagactcaagaacaggatatacccacattgtcaaatttatgaagtttaaacagggagccaaataattggttgtccacgacgctttatttatgggtgggggtatatccgtatatgctagctagtgtcattctgccgccttcgttgcactctgcattgcgggtgtgtttagttccacttttcctaaaattaaaagtttatatatgtaagaaaattttgatgtaatgaaaaaattgaaagtttgaagaaaaagtttggaactaaacaagggctgcaagggctgcatctcttgttctcttgcaagaccctagcactagctgcagtgctatactgccgttgacaagtcacgtagagacaagagcaagtataatagggggttgtaattccgctaaatgctaaagtagaggagaaaagagaggagaagcgggctgtaaacttacagtcagcttggacgcaataaccaaaaaattacgtgagagagacaggtgtgccatatatgaattgtaaatagctaactattatatgcgtaggctaagaaaaggctataaagaaccaacaagttagttgtattattaatcttgctctaacttagttttcttttttcttttttcttttttttaaaaaagaactcgaccaaaaggagacacatcccgaagacattgcatttaaggtcgggaacttagttaagcattaatttggatcataattcaatagaaattttataggtaaacgtgggaaaaaatatggggtcttttggatcgtaggattaacctcgaatggatttactccctccgtcttaatataaacaataaatatagattcatggtattaggatatatcatatgttattttattttacgtgaaaattgttatagaatttggctccttgctagtccacgctatttcttgccgcacatgtaacatgtttatttgtactgtgcaagctataagagaaaaaaacatcataattgctattactaaatgatccaaggtcttacatagtagctgtataccacactctctttaattaattaatcatttgatgattgcaagatggtcctgaacctagtggaagatgagattacatgcaatccattccagatatgctgctacatttccagatttcacttgcctaacagagtcacaggttaaaattcgcactacaaataaaacagagatacagtagctgagttggactcattgcaaattccagcttcagtacattcatccaaattaattgcacaatttcagcaccaacataattggcacacctgagttcagacaactaccctggcctaacctgcatatgattagatattagaggatcatcatctagcctaattagcatttgggaattgggattactacttttgatgcatcaatggcattctaaagcgactttctgataactgagggaccagtccctctcctgcggacagctgctatacgtgcaagactagtcctcctcttggattggatcacgccttagatagtcctggacatcattaagtttggtcaagtatgagaaaactcggttgcttcttttctgaaagaagataattcagttgcttgtcactacttgggtttcagttactatctagatctatcatgtatgcacttcatcctagttggaaggtgatggagatgcaagctataaatcacactatctgtttaactataagcttggagaacacatgtgatggcacatggcctgaaacaacccaaattatgtcaatcatctcgcagagatgaaaggcatggccttgaaagttgaaacccatccgaatttaaaggaggctttaatagccactgacgagcaacaagaatgcatttgctgaactttcaactcggcctatgaacatcgagctggatccaactcgatcgtagcttgctgagagcttaaatgtgtactctgttctgaactctggacactgtctgtgtccagctaaaccgtggtgcggcgctcaagaggctacgaactcggcaaaaggctttgctttcgggtagtagggtttaatgtttgggtgttagtgcctttgtgcttttttgtgcaactgatccagctttgatgttgcctgaaatcctgcattgttttctgctctgccgctagtaaccccaatcaccactcgaaatatcaaggaacccaatcattatccattgtgcttgtgcatgaacaatcctgtccgatcgctcaactcaaaagttcacagctggaaaattttatcattgtcctacccttttcatgctttcgtccgtgctcatatgtaccgcgagtgcaacaaacaaaatagtttagcgcagctgaattcctggaaatttccatacgaaagtttctagaaaaaaaaaaacgtaagtcaggagcacagctgcgctaaatagcaaatctgcaattgtaacaaccatccctccaaaaccgcgtagcgtagcccaaccgataagcaggcccacttacacacatcactccccttacactttcgttatcgcttcgtgtaaaagggttaacccgggagtgatgtggttggaaggaagaggccttataagtcggttccactcggctaaactagtaaggtggtactaaacatgcgcacacaacttatatgggccacacaggcctaatccttattgggtcgggatgtcacagcaatcccctgacataggcttgtctagctgagtggtgctgtgtaacaaaaactcgttttcttataatatattgacgtgtaatcattttatctgttcgcgaaaaaaaaaatccccgatcaatattggtaataggagttatagacttatagtacttaccggatgcatccacatcttgctactgcgattcgatagccggtgagaccacaaatcgtccgcattgacaacgggaaggcctgtgaccgcgcaacgcgatcaccgatcaacacgcgggctcgtcggcgccggtgctgatgctgatcgatcttacgtcgcgtcgcgatttaactttggcatcagagtatcagacattgtcaatttttctcttgtcatcgcctcagctcgactgatgaccggacgaggcaacgtcgtcgtcgcgaccgtgccactggtggtgtagctagctagcgcttctattacgacgtcgtcgtgtggtgcaacgagaaatcctgccgctattccgcacgatgctgcatcgtgttgctgccgagtgccgacagattcgcctgggatatctatccctttcgtttgcccataatcgtttgaggaaaacgtggatttccttgtagatttgtagtttctactagtgacaggctacgtgcaaaagcgggttcccaaattcccaatcccgtagccttcttgggcttagcttaggtgcaaagtggggtacaggagaagcccaatcttgtgcacaattctaccagggaaaaagtacaccgaaggtccctcaacttgttatcgagttacaaaatcgtcgcctaaccgtaaaaccggatacaacgcatcccaacttacaaaaccagtgtagattagatccctcggtggttttgcacccggttttgtccgacgaggcggctgagccagcgtgggacccacgtggaccccacatgtcaggatgccacgtcagcaggctggcctctcccttcctcctctctctctctcactcctctctggactgggcagggcggccgacggtggggaggaggtcgccgggtgaggagttccgacggtcggccggcgatgcggcggcggagacacgggagaatgggagggcggcggcagggcgaggcggcgtcggcgggcgagcgcggtggcggagaggcggcggcggcgacgacgccgtcgcggctcccactccctctcccactcctccccaagcagcggcggcggcggccaccgagcagcggcgcgacgagggcatcgttcgccatggcggcggcacttgggctcagcggcggcgaggcgttccggctgtcggcggatgcgggcgcgggcgcgctcaagctgcacaaggacgacatcaccctctggtccgtcgacggcgccaccgtcgccatcgtacgtccttccttccttgttaattcattcccttcctcgatccttgccgatgcttgtgttcgtggctatggtgcgtttcgaatctgatgctgctcgtgtggatttggtaggattagtgcgcgtggccacacatttggtgggattagtcttgtgtttgactttcactaatcctcaatctttctagaaatatttgcaaaattgttaaagcaataatctctaactcttaactatctgggtatgacgacgaagaagatgacagttattcatatttctcaggttaatgctgctaatgaacgaatgctaggaggtggaggtgttgatggaggtgattgaatgcagctactagtgagctatcatttatctcatcacggattgactatctcatactccagtacaattctcattgtagctatacatcgagctgctggacctgaactcgtagaggcctgcccagtccagagacgcggggctggc

SEQ ID NO: 60952 - DNA, 28776 bp, Oryza sativa
tgccagccccgacgacggcctctccggcgaaggcgaagctggcggccgcgaggcaggtgccaggcggcgtggctagatccaagaggaggtgagctttcttcactttgcctccacgctcacccacgccgtcgccttcggcttcccgcgtcgcagccgccgccgccgcctcctctccgccaccgcgctcgcccgccgacgccgcctcgccctgccgccgccgtcccattctcccgtgtctccgccaccgcatcgccggcgacctcctccccaccgtcgaccggcctgccaagtccagagaggagtgagagagagaaagagagagaagagaggaaaggagaggaagggagaggccagcctgctgaagtggcatcctgacatgtgggtcctacgtgggtctcacgctgactcagccgccacgtcggacaaaaccgggtgcaaaaccaccgagggacctaatcctacactggttttataagttgggggatgagttgtatccggtttcgtggttagggacgattttgtaactcgatgacaagttgagggaccttcggtgtactttttccttctaccaggccttactgtccatcacagagcgatgtagcccacagccaaatataaggctttggagttcggaaggcggaactggacacacggcccatcctcttttccgcggtggactggtttgcgggccagaccaacaaaacaaatgtaggaataagtctattttgcttccctcaactcatgagcgtggttgaatcgcacccctcaactgcaaaaccgggtataacccgtcccttaactttcaaaactgttgcaaatcaactctctggcggtttcggaggcggtttcatcctacatggtgggttgacttggtattcattccacatggcatcgatgtggtgcttacgtggcactaaaataaaaacaaacttaaataaaaataaaaataaaataattcttggacccacatgtcagttacccaactcctcctgctttatcatcggcggcgagcaagatggagagagcggcggagcggcggagcggcgggagcagaacgacaacgggagcggagagagagcagaggtgaggaagcctcgccatcgccgcctcccctcctgcacccctcctcctccgcacaggtgaattgctcctatagttgcacactcatattggatgcaaggacgtcgaggacacaaggggatcggggagtcaaagtggccagggtttaaactagactcaagcttagtttagcagcaagggttcccaacccatctttttcatgttccgtgcgcacgcttttaaaactactaaatgttgtttttttgcaaaaagtttatatacgaaaattgcttaaaaaatatattgatctatttttgaaaacaaaaattagcaaatacttaattaatcacacgctaatagaccactctgttttccgtgcgctggagatacgttcccaaccgcctgcagcgaacacatcctcactcactttacaagcatatggttctcggggtatattcgtacttttcacatgttctatagcggatacatgttcttgttatgttctacagtaaagatcacaacgtttaaatatcatttagcaaattttatatttcgaaatcatggctaattgtctctgataggatcataggaggctggcgtcatggcgtgcatgcgcgtctgtggaattctgaggtcctgagctttggtgcgcaaagttggacccctgatgaaagattgtcttcgtacggaagtccagccgccgccgggtgcccagggcggttggttccattccatcaatcatttttccaatcgttctaattgcacttcaatcctaatctttgggtcgaatttggcgtaatggcgcgtgaaccggtccccgtcgcatatgtaccatgtcattgtaacaacagatcgaaatgcccaaagaatatttctcacaatctttaaagccacttttgacaaacaaacttattatacatccatcgtcgtcgacttattatcttcctcgtatccttttcccatctctctactactttttacacgacaataacacatacagcaatagatacagaataattctacaataaaatagtttcaagtgcccctttttttttcctacttggcagtgcactccggcggtaacccctgggggaaccggtacgtgtcggcgcagtaattgtagatcatgtagtccctctgcacctgccggagccggtcctgcgacgcgctgtccagctgctgctggtacatccacgggctccccgggttggcgcacgccgtggcgtcctgcgacgtgcacccgctcgcggcgagcccgcggtacgacgccgtgaacggcgcccgcgaccagtccgtcctcacgcgccccccctgcgtcgcccactcctccgcgtcccacaggctcgcgtacacccgcatcgcctgcgcccgcgggaacgccacccccgtcgtcgcctccgtgttcctgtactcccgtatcggcgtcccgtccacgtagaaactgaacaaacaaaacagattaacagaagttgatccttttgtcattttagcgattaccacgataaacgcgcgcacgcgcacaccactatacactctaacacaaaccaatgatatattttcgatatcactaaaatcttattaaaagcccatctacacatgcataatattcatgaggaattttataattcttgataaagtgtctagaggtaataagattttatactagaaattttggtaactcaagataattagtagttagatgtactaaattttaaattaaaaaatatggcacctcccagtacttttcaagtatgataaaattacttaatattcgtaagcaacagaatttatattctaatgagttgagtcatataaccacgactctactaatgtataagtgcattggtgtaaaaaaagttgaaaagaacataaccgtgatacgtacaggatgtgggaggggttccagaggacggagtaagtgtggaagtccttggtagggtcgaaccacatgcggaactgctgctcgcggccgcctttcccctggctgtacacgttggtgtgcaccgtgtacggctcgccgctcgcgttccccaggaactcgaagtcgatctcgtcgtgctgcgacccctgcgacgacagctgcttccacgcaacacccaatcaccattagctcttacaggcaggcatacgcatatgtactcgattggcgatgatcgatgcgatgcgtacgtagaaggtggcgacggtgccggcggagttgccggggacgagcttgatctgcatgtcgaagcggccgtacaggtactggttcttggactggaagccggagccggacgacctgtccagcgacagcgtcaggagctggccgttgccgaggatcttgccgcggccgtcgccccaagtgatgtccacgtcctggtagaagttgccggcggcgccgccggcgagcagcagcacggagcacacaatcgccgccaccaacggcggcgttctcccgggattggaagaagaaaccatcgtgtgtgtgtgtaacactgttggattggattcggtttttgatcgatcgatcagatggttttcgtgcagtggtggtgaaagatcgttgtgcgagctgcggtttttataggccactggagtggaagggtagcctttcggtcggatggttggaccagagacgagaagagggtgtaatgtaacgtacatgagctggatccattgagcggcttgacgatgtggacgtacacacgggtcagaatcgcacggcttggttttagccagtttgcttcttttttgggccttagttttgctcggtttagtgttgtgatatgattggtgtgcgtcacgcgcatgcaggaaaaggggttcctggctcggaacggaattctgtgtagtagcggtggagccaaaaattttctaagcctagcgctcgagtagggctcaattaataggatattggttttctagaaaaatatgtaatggtttaaaaggatttaagcatatttatggaggtaagccgggctcaagtctaagctgccttagtcttgcctctgccctgctatgctgttgtgcagtaatatatatgtattaggtgcaagcgtttacaatcccaacaaaaatcagtctagtttacgcgaaaattggattttctggactaccacgatagcacaaagcactcgttttttctttagtcaagttaaaaaaaatcaaactaaaatttgattttttgacaaaaaaaaaacttcttcgatttccattggtttttattgatttaccaatatatttttttataacctaagataccgctcgggactatgaaccctgtgtgcaattgacatgtgggcagaggttgtatgtccggctggctcactgcaccgaaataccgaatgatcggcaacctctcgtcacctattctgatcccaagctgaggagtcgtggagtgacactcaaatgcatgcattgatcactgataagtacgcacagattgcagctgtactaacgaaacatgaatgaagagatatgatgcacgcaaaaacaaacgggtgcggatttaaaaacgatgtgaccgaaccgaactaataagagcatgatggtgattaggattagtttgtttagatgtcctattcattagctagcttgttatggaaatttatgctactgcttgcttgtcaattacacgctgattaaatgaacatatatggattaagcttttttttttttaacaatccttagaaaggtactactcagcaagagattctgatctgcagttgtaggagcaattcttttaactgatagcctcatcggatggctatatgcacaaaatacgccaaatagcgtattagcgaaaaactataatgtgtgattaaaacatttacatttattttctttgcgacttaaacgattatgttgtaaaagaaattatgataaaaaaaactcaaaaactactttaaaattaaattaaaaatttaaattttagtattagcatatgctggttgagccaaaagatgaaagcctgacacaaccaacacacgcacaaagggaatcaggtaaagccaagtcgacaccttaacgaacgatctgttggccgttttccctcgcatagctaggttttgaccagttttgattccccgtggataaaaagatcaccataggcgactacgcatcatacaccgtctgcagcttgacaaaaatgggagcacgggagatgcgctctgaatttctcatttctcaaatcaaagcgacagcttaaccgactctgtctaaacccctaggattgaagtattagatcaggctgtcaataattatcgtagcatcaatcgaactcggaaatacatgcatcgacgaactgatcatttatgcatacgtactgcaaaattaaatggcactccgtgaacaaggcgaattcagactttcagagaaatgtaacgctgaccgtgctaatataagcttcagaatcccaaatgcataccgctcgtccaataatcaatccaacaagcatataccctataatgctctcttctagagctagcctagacaagtgctccattccatgaccatgtagatgtagctagccttatctgctcaacaacacccatcccattcaattgtccaccgtctttagctcttgttaaacctatctttttcagatagatcaaaaggggagctacgcatgcaagaatcatgttgcgacagtaatggtcgccatggccttcgattcctatatcataaaatcatttctatggatcaagtggtgtcgccaatttctaggatgataatgggtcggctggtaaagttgggaatcatgcatatacatcagactatcagagtgttcagctatccgcactgatgagctgtaggctgttctttttcttccagcctccaactgatatattgtactacgtatattaatttgtagctagtcagccacaatgcatgagcattcagtggactaaccacattgggttctctatgattagtgctaatgcattggtgatcactttgtgttgcttgcctggtggtcctctgagggacacgtgtgtcaccttttcgtttttctttgaaacgtaggtttccaagtgatagaacattatagactagctttgataatggtggcaacaaaattaatcgatcactatcgctcaagagctcagttggtgagagattcggtgcgcattggcacgaaccaactaggtttaatttggctctatggaactcatattaaaatgcacttcattttcttaacgaaaagtaacatatccctccattttctctgtagaaaagtcatagtcactgatgaagactgcatatatgtattgtagtggatcagcgcaacagggtaaatatatgcatggtgcatataatttcaaacattaatattggaagaatggacgtatatagtatgaaaatcatcaaagatttgtttcagagtacgtacttataattcaaatatcatacttcaatgggtacaacaaagaaaccactgaaaaaatatttttctaaaatataagtcactacaaaagtaaatggtatttcttccgctttcaaatatttgttcacgttaactattactattccaactttggccatttaataactcttaaaagactagtccatgataaatgaaagtttcatggttatgtttaatgtgtgtaatacatagtatgttattttcttatatatctataatttttccacataaaaggcaaatcagagtttgcaaatgaacaatgtcttacgccagtcttttttttgaaggagtgatgtcaggtaattaaaaaatggagagaatagtaacatacttttttttataagaacaaataattaacgtcaaaagcgtcatacgtttaaaaccgtagtagtaaacatcactctcaagctgtcgccattttttttgtcatcttttacagccttggtgctggcacgcgcttcctatgaattgagatccaatgcagttgtaataacgactgcaactttagcagtgatagcatattatgaccgttggatcgatgcagccaacagcttggatttgctctgccaccccctgcacagtatacgctacagtagaaaattgctacagtgattcgtgaacaatattttctaatgatctgagccgctgatttttgatccatcagctaccttgcaactgctaaagttgcagtgatagtaacaattgtactggatctcaatccgcttcctatatatcttcccagttgaaacaaacacgacttctcatcaagctctagcaaagatatcaacctccactgcgggcactaagcttatgcagcagtggagtcataaacctacccacacttattgaagccacaaactgcaaactttacactactagtatatactagtagtaatataagtatacaaacaatgtatatattttttttttcagacacgtagctcctttacatattcgcataaaaaaaacgcctttcgaattcgagcaatctaagcgtgactattatatacttcaaccaccggtatatacatgtttcaagccatacgaaaaggaagctgaaaaaggagtagccgacggcgtctggtccagtgtatgtcggggaaatcgacctgcaatctgcacttctgcagaacaaataaacggctaccacgacatggagtcatggatgacctgccggtcatgctcgctgcaattctaaagcatatctgatgcacgtagagtagataactatagctatataaagattgtatttagtagcaattaatcagaccgtgcaccaactgagcttggctagctagcttgccagccggacgtcgagttcgtcagacttggagccacatccaacgtccatacattattccatcctcctcctcctactactaccacaacacaaatcattaaaatctcttactcctagcttcattgtttggtttatttgtagaataagggaaacggccatatttgcaaacgaaaaaaataaattttaagggaatttgtaaacgaaaactaatttatgaataaaatttttatatacgtgttcttagcgatttaaaagtttatattaaaaataaacttcgataaaaaaaaactctaaaatcagctttaaatttaaagttaaaaatttaaattttgacttataagtataagtataagcgaaaagataaaacccgaatactgctgcatgacaaatcgtctaggcctgtcaagagaaggacgtacaccttgtagcaatctggagccgagttggaagcagctgtctgactagactctctgctcttctgctgatctcaaacagcagtagcacatctcatgcagtagctcgtggtctccatgaagggatatttgcggggatttcgggtcctctgctggatgttgatgcctgaaagggaggtggaagaagaaccgtgaggacttcaattttcggaagggtgatgaactagctagctgatcgaagataaggtccagtttttcggagggtcgcatccattgattattgctggtgaaatgtcgttgcggcggctaagttagaggggagcactgggaggacaggcgagcacggtgcactgtggacacacaaagcagaacaattccttcctttaatttgagattttggacgtgaacaactaaagtagtaggaatagtgttctctctgcgtaacagtaagaaatgtttggtgcatattaaaaaacttaaaattgcacatcgcactggaaatccctcgttttgttcatggatgaattcacctgaggttttcttcacaggagctagacatctcgaatatatatgtaaaaaaaagtctgtgagttatacagatattaatagcaggtccagtccccatgtacgcttcagcccattccacaaattattgggcttaatactttggcagataggcccatacccaccaagcataaaggcccagcactaatacttcgccattacggcccaaacatccaatttgcagagttctatagctcgtcgtctcacaataataaaagccggggacgatcacgagacgaatagatctttagaaaaaaaaatcaaacaagaagtccatttacatcgtcgtagccaacaaagaaagaaaaaaacagattctggaacgagttgagactttccacattaccctgcacaactcaacccaaacctaaaagatcaagaagagacgattattcattcagttcccctcactgcaaaacacaagtatgagcctacagatcgctggacgacggatggaatcatcatggagtcgacgtcgcgtacgacgcctcacgttctaccgatggggatgatgcactcggcggggaaacggtgcgggaatcgcttcctgtcggcgcagtagtcgtaggccatgtagttcatccgcacccagttgagcgtcatccagctccaccagtccatcctccgcctcatccacccgccgccgccgccggcgcaccgggaggcgccggcgccggcggcgtcccagacgcaggcgttggagacgttgtagcggcggtacgtggcgacgaacggcgcgcgcgaccagtccgtcttgacgcggccgccctgcgtcgcccactcctccgcgttccagatgctggcgaacacgtgcactggctgccgcgtcgggaatggcaccccgtacgcctcgttgttcttgaacaccctgatcggcgtcccgtcaatgtacagtctgcaccaccaacatttttttttacagatttgttacacacaggtttgtctctctgaatttgacgaggagaccgagccaaacgacatatttacaaacgaaaaataatttataaataaaacttttatgtaaatgttcttagcgatttaaaaacaagttctgaaaaataaactatgattaaaaaaatctaaaaatcaaatccaaatttaatgttaaaaatttaaattttgattgataagtataaatataagcacagaaaaaagaaaagatactcctaaaagataaaatttaaatttttcagagcttacatgatgttgtgtgggttccagaggatggagtaggtgtggaagtcggcggtggggtcgaaccagagcacgaactgctgctcacgctcgcccttgccgtcgctgaagatgttggtgtgcagcaggtacggctcgccgctcacgttgcccaggaactcgaagtccacctcgtcgtgccgcgcgccgccgctgcagatctgcgcccgttggtttggttgattaatttaattaattagttgccaatgcgagcagaaaaaaccatcagatatgtcgacgtgtgcaccatgactagctatccaggtatttcgatcagccaagtatatgccttcaggcgaattagtctgaatctttttggataaacttagaaatgttaatcgtggacaccatgacaccatgactaaaactgcctactactgaaaattgaagatgttcagcctggttaccggccggtagtaatacgtgtaatatgcagaaattgatttattttacggctaaaagtgattatacaaatattctgttccaggaaaggtagcaaatgtaataccaacattgcttggtgaaagtgatgcaattttcaccgaaacaaaaataaaaatgttatcatttttctatctctagggcatgaaccgaccaagggtgtacctgatctacatactgctacttaaatgcagaggccaattgaattcacttactgccaacatttatgctgctgcaagtacaaaattcaccccaatcaccgctcaaccatcccatctgctaatcgaggaccaaacttgttaatctgggatgacaatcttcttcttattattttctgccccataaagtaaagctcatcccaagaatgacaagtgtcaactcgtggaattcccctggtgttcctctgtcgtctactactaacaatccgagctactttaacgggatgaacaattcttaggatttcacacaaactagggggaaaaatcgaacaaatcaagccaagatcgatcagaagactgccccaacttacatagaaggaagtgatggtccctgcagactctcccctgacgagcttgatctcgagatcgaacctcccaaacaagaaccgctccttggactgcagccgcgcccccgtctgctcgtccagcgtcagctccaccatccgcccgccgtcccggaacctcgcattgcccttcccccacacggcgtcaaagtcccggtggaaattgtggtcgccatgccccgccgccgccgccgccgtcactgccgcagctacgacggcgacgagagccgccggccacctcaaccggagagaggcgccaccacgcatgtccgcgcacaatgtaaacgcatgcacaaggcacagtgacagagctccaccgatccgcgaaatgcggcgtatcgaactgacgagctgcaagaggagatcagatggtagagactagaaatgaaactggaggaaatggaccagtgtcctgcgaagaagacagagaaagagaggagagaggtgaagtgaaagaggatgtccaatttaagggcacgtaggggtggcactttcgccagatgccagaacgaggcggcatgcacgtcggttgctgcggcaggtagccctgagccccccagccatgcggcgtccactgaaatcgcatcgtacgagacacaaaccacccatgaaaaaactcaaaaaggaatccgacgagcaacaggacgtggcacagagtcgacggcgccaggggagatcgagcggtgaaacgtagtagagagtagtgtgggcgtatgggtcgcgtgtcgggttggcaatacgacgtgtgagcaggataaattagctcgaccacggtgttgctgcaataaaaaccggcgggacgggacggcaaacggcatgcatggcatgagtgcgcggcacaaacggagcggaagctggtctggtggtctgctttgattcatctcggctggccgcggccggtgcgggcggtggacgacaccgtggactggtctcgagcgcggccgctgggtggtggttggtttccaaactttaaatgcgagcgatcatcccgtcgggtcgtgcggtacacgcgagcatgcctctccgctgcataggcgtaggacgcttaccttcgtgtagcgaagttagtacaatgcaatggcttcacatgcgctgcgaacaggggcgcgggcagtgtgatattccaattctcgtctcttgttgtgacttggtcgccggtgaagctctggtagcgtttttactgtggcaagttatggttgatgctgtctgttgcatgtgaccctgtaggttgaggaaattaggacctgtactgcggtgggattcggtggataatctggtgatggcgtgatgctaatggaacaagcgacatgattacacgacccgctcgatgcaaattaacagtcttctctctttctttagtcagggcacaagaaatcagatcgtgtcccatttttttctcttggaatcgaattgggaaacagatatctgtttgtgtcttgaactcttgatgatactactactgagtatctatctagtgaggcatgggatggatgacgtcaccgtgaagggtgggcgtgttacggcccacgggacttgtgtattgcctgttgggcctcactggggcctggtaggtatttctcctacaaggtaaaaaaaaaatcataactatcgatcaagtcgaaattaggcaggtgaagtgggccgtattccaaaattttcaatgtggttactggtgagccggataaaggctgatgaagttacaaatgagctgggttggcaagctgaaggaaaaagtatgccgaaggtccttaaacttgtcatcgagttacaaaatcgtcccccaaacataaaaccggatacaatacatccccaacattcaaatccaatgaaaactaagtctctcggcagttttgacttcggttttgttcgacatgaccgctaacttagcgtgggacccacgtgggccgacacgtcagggtgaccacgtcattatcatctctttcctctctcccccctctctctctctctcccccagttgtcggcgacgagaggtgcccatttcctccaccagctagcgcatcgccgaccgccacgtaggacaaaaccgggggcaaaatcaccggaggacctatagtaaacggtttttgtaagttgatagatgttatatatctaattttgtggttgggggatgattttgtaactcgatgacaagttgagagaccttcggtttaccttttccgcaagctgaatacaagttctcatttcccgggcttcattcggcctgacaattggaccttagcccttaagttgggcttatttacgaccaactaagttaaaatcgaaggaaaatgatacatgtacagaaatgtgtttagaaacattttacaaaaactgatgtggcatttgttatatattgtatcttgttttttcgtaactatccactgattaaatccaagtttgtaagagtttagtaaagttctttttaagtacgtatagcattactcagaatcgaatcacaacctgtgattaaaaaaataatttctaattccaaattggttctaatgcatcatgtggtgacagtttgacagaagatgatcagaactacgctgcaaacagtggcacgagaagcagtttgtgcaaacaagcgattgggtgcgaatcaaaaattttaagcaaaacatggctggttgatcaaaccgagtgcgagcattagttttgtttaatccaagcagatcttatcgtttccaatataaaatggttcgacgttttcgttagcagtgttgctgcagctgcagatgcgaatgttggtccctcggttaaattaatcaaaaccggataagctcgatctccccccacgcaaggctccagttttacagggtgtccattgtcgaaggtggccagtctggctggcacgcccagtactagtacaggtttatttcagcggctgagcacacggaaaacatggccaaaacccacaaagggatccatcttctggctaaaagcagctcactaaaatttatcaaacttggtacgtacatcgaccccgtgttacaaaaagatatcaaagaatgcgatatgcatactacatttacatctccgtggcaacaaaacacattcattattcgccatctgacgtgctcttctcatcatttttttcatcgatgacggatcatgcatgcgtagcgtacgttatgatcatcttctcgtgtcgatctcaacggagcttgcactcggcgggggtgccctgggggaaccgcttggcgtcagtgcagtagttgtagatcatgaacttcctctgcacccacctcatgcggcggtagctcatgtcgctgagctcctggttccaccacccgccggcgccgcccctcctgccgccggccggcgctgcgacggtctccattgtgccgacggggcagcgctgcgcgccgttcgaccagacgcaggcgtcggcgttgaagtcgcggaaggaggcgacgaagggggccttgctccagtccgccttgacgcggccgccctgcgtcgcccagtcgtccgcgttccacaggctcgcgtacacccgcatcggctggctcttggggaacgccacgccacgggcctcgtggttcttgaagtccctgatcggtgtcccgtccaccgcgaatctgcacgcaccaccaacacgttgttttagccaaaacccatcgagtatcaaccatgcgtctctgtctcgcgtaacaacaagaggggttcacgtgccaatgtggaagtaaagtaggggactcacatgacgtgctgtgggttccagatgatggagtaggtgtggaaggactgggtggggtcgaaccagaggcggaactgctgctcgcgctgcccctgcccctgcgtgaacacgttggtgtgcagcgtgtacggctcgccggtcacgttccccaggaactcgaagtcgatctcatcgtgggtcgaaccctgcgacgacaactgcagccacaagcacagaagatcacacaaaccatcagcttcattactccactttagttccgtttttttgccgaatttggtagatgaataaatgatgaagtgatgagaccgtttggggaggaagataagcttacgtagaaggtggtgacggtgccggcggagttgccggggacgagcttgatctgcatgtcgatcttgccgaagaggtactcgctcttggactggaacccagagccggagctcctgtcaagcgtgaggtcgagcccacggccaccatcgacgatcttgccgcggccctgcccccacgacacctccgcgtcctggaagaagttgcctccatgcgcaatggccaccaggcaggccatcgccacaatgccaagcgccaccgtcctcatcgcgcgatcacaacacacaagaacccaaagatctagcaagcgagtcgaagcgtgaggacaatgagagctactgggatcagtgtggattggtcactggaatgggatggcgaagcacttgcctatgagccggtatttatacttgggcgtggccggggcagctagcaatagcagagctgcgggcagacaggtggtatccgacgggcaaatgccggctggggtggcgcgtcgcgtacacggttaaagaagtaaatgcggcacggagcgcgtcgctgcagagcgccggatagatttggggcgggggcgatgcatggctggacgcacgctggatccagccgccgcgtgcctacgccggggtgtgggggccagagacgcgggggactttacttgaccacaccacacccatccccgcggcggcatccgcgaaagcggtaacccgtaaaccgggcaggtgatgcctgccgatggacggatggatgcgagtacgtggtaaagtgtgcagcttttgtggcgcttttgctcggctttgctcgcggatcgtacgtcacacggggccgcggccagcctcggctttacagttcatggcctgcagtgcagttcggttcgcgcggaagcagcagatcgtgatccggacggacgagccaacacgacggcattgccgccatgtgcgcgaaggcctgcgattcggggaaggttcgcctggtttgccccatgggcgaaggaagtggcccggccattccatccagggcatcgacggtcgatgcacatcgttcgtacgtactgtacgatgagcgagtgatttaattgcggtcacaaatcggtctcgaggacgactgttgctgctggtgagagtgtaattgcgcccttgatgtgtctgttgggagtttgtgttttgtgacagcggattacacgctgtgatttactggagtagtggtaagttttcaatacctgaaaggttacgttttgattgatcgagttcgggattagtaaggacgacgtccgtagatgaatcgtagctgggctctttagtactccgacatgatgccgttaggtacgggcatgttgattacgacacctctggccaaatgatgaacagagtcgccattggacttgtctaggagggagacaattgattctctggccaaattcttgcgtcactcaaccctaaagatggataactattttttttaacacctaaaatgattacacgtcaatatattagctaaagctggatatagacctaacccgctatatgtaacttgcactgtggagcatgcagcttatactgttcttgatctacgtggcatgtgaagaacgataaaacttggtggcgcgctgtgagtggccctagattgatgtgaagtggctaaggctcgcgagctagactagtgggctacaactttcttgcctcatgattgcttgttatgtctaacgtctagtcgactcaatcctaatggaggtaaaacattgtaacccttaggaaacagcatcatgatctaagtagttaaggcctaagagtatccccagcagcttatccaaatttgattctcggtacactcatatggatggccatcaaaaaaagattccttcttcatatccttctcactccaatagatcatttatatttcatactccataccacatcctcctatcttttactaatatctttcaactaagcatatatttgtattattttctaagggctatattttgaacaactaaattttaatagttttattttatcacggtaatctaaatggttagattttaacggacatatttctaatagataatttagtgcattaaattgctactttctctaaaattactcagactatgtttctcttttttctctacccatagtctgccttttgcccattccaatatattccaaccttttctattcctccttttctctctgctctgttctacactcttcattctacccaggaagcatgcgtggaggcaaggtggcctgcgagcgcagaggtacggcggcctgtcggtgtagaggcacggcggcctacggacgtggaggccggtgggcgcggaggcaactggagctagcaggatcgatggtggcggccgacgggcgtggaagggcggacgaagatagcagcaaggggcggaggcagtcggcggggcgcgcgcagggccgacggccacaaccggccggcatgaagggttggagggatgcatgctgccgctggcggggttctccttctagatctggtatgtctctctctcaccctccctccatggctacacactccctctacaccatccaccgtacagaaaaatacacatccgaccggcgacgatgacaacataggggaggtcgatccaaaactcctgataggggtgggagctgcggccactgtgatatagcgtgaggagagagaaacgctatatttgggcttcctctctccgttttggcgcatcatctatttttgaagggctagatggcgtatccactggggccccgtttttcactcccgtgcactgtatctcggacagggtatccgatagaggatctcctgatgctctaaggctattcccaacccaataattagaatgatgtccatagcattaaataaggtgccacctaggatgaaaaatgatgtggcaagtgaataaatgaggaaagagaaggaaatcatgtctacacaatatccaagacatcatgtgtgataaggagcattaaatttaagtatggaatagtaatgcttgtattaaaagagtagtgtctagtactaatttcttgatgatgtggagtttatagaaactatctagtgttttgggttgggaatggtctaatggggtgtaagagtcgaagacccccgttgtccgtacgaccatccgaaaatgcaagactcccaagtcaagtcctttaccacgcatagcatgcaagacttgtctgtcacacgacgtgccacgatggaacccacatggcatatactgcttcttttgctggagatctcgtactatacaatacacctggttccagaaacttcacaagaaatctagctggccatggcataagcaaacattcagcaactgcatccaataaaatccaaataaatacttccacagtggcagcactgaagaacacctcggcatccactactcagagacaagcaagcaagcataagcattattctatgtactgccatagtgccaccacaccacaacattcaaattcgcccatgcctctccagtagaaatacggagaagcagaaatgatcatcatgccacatatcctcgcaaacaacagctgtccgctttgtccatttcagcagcatgcatactggtgccagccaacgagccagcagcagaccgacgcaaacgggtactgtacgtgctgtggcgaggaagcagggtgggccctcgacgcaaacggcatgggccgtgcatggtttatggtttatcatgccctcattgaacgattcaaatcattgctgttccaaggggcacgtacgacgcagacgcgcacaataattcccgtgtccccgaccgacgcgcccatgcacgcatcggggactcggggtcgacgactccggcggtgcgcatttgtggcttctactgcaatattgccgatccatcgatcggtagtcggtagagcagctctgccataaacttggacttaattggttacttagccaaaagcccaaaggagaatttgcagctagctaggtagatctgatacagtgaacacaacgcattgcaactgaggggtgtttaaatctaggattataaagttttggcgtgtcacatcgggtattatatagggtatcgtatggggtgttcgagtactaataaaaaaaactaattacagtatccgttaataaaccgcgagacgaatttattaagcctagttaatccgtcattagcacatgtttactgtaccaccatattgttaaatcatggaccaattaggcttacaagattcgtctcgcaaattagtcgcaatctgtgcaattagttattttttagcctatatttaatactttatatagatgttgaaacgttcgatgggataggattagaggttaacatctattgttattggtaaaaaaagaaccatagattaaattgttggagtactaagaagaggttaacatatattattattggtaaaaaaagaaccacagattaaattgttggagtactaagaagaggttaacatattattattggtaaaaaagaaagggttaattggatccatgccactgtaaatatgacaaatcagaaaaatatcattactattcatgaaatcgggtagatgctactccaatcttctaaaattaaaaccataccactccatcacgatttccgtcctctccgtcacatttttcgccgtctccgtcttatcttcgtctcggtgcctgaggaggagggcatggcggcacgccgccctcaccggcgccgagctccatgagggagatgatagccgggcttcctctcttcgttgaggtggttgcgctgagagcagacaattagggcgatggcgcaaagcggctgaaacgcgcggtggcagcggagagagaaggaaatcgttgggagaagcggccagggcatggcgagctcgggctaaagttgggaaaggaagaggagacccatgaatttcgtttttgcaatcaatttaagaagaagagcaactgggaggtcgtattcgaacgggaggcggaggcactgcgtacaggcacggccgcacgggacttcgtatagaggttgaagacgatgtgctatagcggaggcgcagcgcacgggcacggccgcgccggtgaagcccttccccatccgccgtcgttccccatccgccgccgtgctctcctcctccggcgccggtttgtccgtcgagacgaagacgaagacgacaagaagataacacggagacggctgaatgtgacgaagaggacggaaattgtgatggagtggcatggttctaattttagaaaattagagtggcatctacccgatttcatgaataataatgtcatttttctgatttaccatatttatagtggcatggatccaattaactaaaaagaaaatggtgtgataacctgtgtttgaaagaattcgagctcagaccaatgcatagctctggcagatcccagctagtcaagcactcgagctagcagccgttctcaacggaaccacagattagcaatttagcattgccaggctgccagcgacaccacttggctgtgttcagatatgggaagttgggaactaaactctccgtacggaaaacggagcggtccattagcgcgtgattaattaaatttttgctattttttttaaaaaataaatcgatataatttttttaaacaactttcgtatagaaactttttactaaaaacgcaccatttattagtttgaaaaacgtgcacgcgaaaaacgagggagaagggttgagaacatgggattgcaaacaaaactgttcgcttcacatttctactagttttctaactacactgctaactgcttcactgtacccattttgccattgagtcagagtactcgcctgtactgtacgatgtagttacataccaatacggagtactgcgattttcagaccaaccgtgcatgggatactcttgcgttttcggcttcacatcagttacagtacacgcgacggtcgggccctacgttgtaaagccacctgatcaatgccaattgaaacgttttaacgctccccaagcacgggagttcggtgactatttaaggttttgttagcttgtcgaattgaatgcatggatgcgtacatacatttacatacccacttgtttcactttcacctttcctccgcacgagcgacctaacaattttaactgatttataccagcacaagctaaggtagcgggagactagtgcaaccacgctacagacctactccctccgtctaaccaaaaaaaaaaaaagacaatccctgggtttccacgtccaacgtttgactgtccgtcttatatgattttttttataattagtatttttattattgttagatgataaaacatgatcaatactttatgcgtgacttatctttttaattatttttataatttttttaaataagacggacggtcaaacgttggacacggaaacctagggtttgtcttttttttttttggatggagagagtatagtacaggtcaaggaaacgatgcacttttaacttactgtaataaaaaagaaaagaaaactactaaaactccagctgcagcctgcagaaacatgccgtgcccagagaggtgttctctccgtctcagacaacaagcaagcaactaatcaaagccgccggatcttccgattctatttcaacttgaaagagcaaaaacaatcaagttctccgggggattgcattcggtgtttgggctctaaccctttggtctgtgaaattgtgagtccatgggctatggcaatcttactcttggacttgaacaagacagacagctatgggctttgcggtaaggaaataaaagcccaacccaatagtctaacacggatacgatcttttggtttggaataagttcatcagaggtcccttaattttacgccgaatccgattttcgtcctcaaacccaaaaactacatacaactggtccctgaactattaaaaccggtgtaaatgaggtccctcgacgtttttgaaggttgttttagctgacgtggcgcctacatagctggtttgactaggtctacgtcctacgtggcattgacgtagcgcttacgtgacaattatatcatgaaaaaataataaaaaccatagccccacatgtcagctgcacacaaaaaaaattaaaaatagtggggcccacgtggccccacatgtcagcctcactcctcccttctctcttcttcatcctcactctctcttcttccctcttccccctatctctctctttctcttcttcccgagcagcggatgagcgggtgggcagcagagcaggcgagcgcggcgagcagtccaagctccggcggcggcggctcgacgtgcgccgcgtcggggctaagggagtcggcgacgggggaaggaggcaagcctcgaccggagagaggaggcctgcggtggggtggtgggcgcctgttgacagaaaacacgaggcctgggagatctgcttaactccagtgcaggtccaaagctcgccttcggatgtatgagcgtgccagttgatttgatcctgcaatcaacaagagatagaacaaagaaaccgcaattaatcctataaatgatagccgatcggctagatgccgatgacatatcatttatttcaagccgatgtcatgcgtacatcgatcggcaaatatcaataagcaattcagaactaaatctactcgatcaactgtatacattaatgatatataatccttatatcggtatatacttaaatcaagtgattgggatatatcggtcaccttgccgagatagtataaatcacttagatcgaaatatatattaatagtaggattatatacattcataacatagctgatcaggtagatctagcatgtatcggctaatactccgataccactctatactaagatattaaagcaagtagaatataccaaacataagcttaatatacttagatgcaataaaatcttaacataaagggcagatttaacgtgtcaatcaagcatatagaataaaagtagttaaatcaggtaagatcggttgaaactccgatactacccttatcggcaaccagaaagcaggctaaagattgcaattctaagcacgacttaatagatcaaactcaactgatgcagcattaagtatgaaaagaagaacaatatctagacaatcaagccgctggaagtttcatagagtggtagatatatcacataatctaagttaacgtcattgtctaacctaatcggctgccttccattagcaaatgttagccgattataggttagataaagatattatcgaagactatgtgagatatatgataactcgatgaattatatatacaagattagagtgtcataaagatggaagcactaatcctgagaacataagtcgtcacgacaagttttacctcttgttgaagatcgaaaccgatgcagctcaacccgagagcacaaactcgtcgaaataaaagtaaagcaaaaaagggtggcgatgcgccgagattgtattggatgtgttgtctcttttttacatagggctcgggtctatttatacccgagaattacaagatacgtccataacggacacgactattatctgtaacaaactctaagatatcataagtctttacggcagacttttgcccaaacatatctctaaggaaattacatagaatatcctaattaataaatataattgccttcccaggactctatccaagcatggcaatcaccttgaagcacatcaacttgaacccgatgacgttcaccgggtcatattatcggaatcagctgtatcggctagccccgtgcaactcgaactctgccgatcctgaccttagccgatttagactgtagccgatttttactctgtctccgcaacgatcttcatcttggattccacttcgatctgatcttcatctccgatgccaatagtgatagaatttaccaaatttggtcgttaacacatgccccccatgtccgaaatattggataatgtttcagatttgccatataccgactctgagagaaactcgcacttgccgttttcccgaccattatcgctctgctttaaatactaaccgtcgccccagagaatctccacgccgtgatctccgttttcaccactcaagcagatcccgtcttctctctctccggcgacctcctcgacgcgcagggcgatttccaaacgattccactcccggccagatctccacccgcgacgatgacgacctccaccagtccgaccgccacatcatctgccgaatatgctgaggtaagtcctcatcggctagatcccttttccgttcatcagatcggttttcgctcgccttatcccgttttctccttctctattcttgtagcatctttccaatcttgttgcagttcccagtctgttgcatgaccaacaatactttctcggtccaatcggcaatctagaccctactgaatttatcatagccgaaaccaatagaactccttttaggtcggccaatccaaacacaagccattggaaaaacaccttcaaatcctggccttctctggagaaaagctggcctgtatggtataagcggatatcggctagcaagcaggcccattgggatgagatcggaatcagccaagccctagccctcacagtagcaaattcggccaaagatgaacccctgttggcggctgcaacttatttctggtccgacactctcaatgcctttcttttcaatcaagggccgatgaccccaacgctgctggatattatcatgctcactggcctagatgtaacctcatcggctaaccccatgagcctaaacaccaagaacacttttgagttcaaaactaagagcattgggggttggtcaggatatatcacagcatatatgggcaaagggccagtcactcctaaagaacacgtagcttttttgctgatgtggttggaaaaattccttttctgcggatcaagctgcggtcctacaaccaactggcggttcttagccgaggccctagtaacgaagaaacaatttcccttaggcaaaatccttctcggctatctataccagatgttaaacagcgcatcggccaaaataattatcggctcagtggttggaacaggtggatcatggtggctctttcaatcctggctgaacctggtagtcatgaaggttttcaatcggccatctgtgacagaagctgaatttccaaggttggagccgattgtagaagatgatggagaagaacgcacccatcgcagatgtatgtcatacggagagtatgcatctacaccagctgatgcaggagcaaaattatcggctgaacttctgaaggactggttcttcagcttttatgacggattccaaaaaaatgcccgagtttggttcttctatgccgactcaatggatttcgaactgccagccgatttcaggttcgaggatattaatcatgaaaagtttcagcaatccagagaaatctttactactgctatcagcccatgtatcctcccagtcggcatccatcaagggagaaatatccaagtctactacgagttttatcatccgatgtcattagccagacaacttggaatgggacaattgccaatcggcctgtactttgctgacaagatccaatgcagaagcgacatctcctcaactttaatgatggatcggctgttgaacatccccggacctccgttgggcagcatcgagaacataaagctggcaaggttcaggagtagggcttttgacagatggtggggtgaatggaaactgcacgtgttccaccaatcgacctccatgtatatgacggacctattccctgataccattcctcaggtaagtcttcactttatcactcttacttaaataaccaacagccgatttaaaccttaattaaccttttcttctgatctgcagacaacagaatcttctccacctcgccggagtaatagtggtaaagacattgaatatgccccaagcttgattcccaatggaggtgggccatctccttctgccatcggctacaatgcccgaaagacctcagcacttctccgaggactcatcagagaaccagccgatgccggcgagaagcggagaaccagatcatcggctgcagatccttcagccccggctccgaagaagaaggctaagacaaagaaagctaagccagctgacgatctacccaccctagatccatccatcgaacaagctctggatgaagaagaaattgaggaagacatcgaccaagctgcagccgaaataagcgatactgaaaaaacaccatcggcttcacctaagcaggctcctccattcccttctgctccagctcaattggcaagggtaagcaactttctctgtccacttttgcagtcatctactttatagccgattcctcacaattttaataaatatagagaaagaaaattgtcgtgaggaagaaatcggttactccaacccctaaaccagctccaccagtaagatacttctatcatctcattaactgacttgggctgattatatctaacatttatccctttggcagcctcctcctcctccttcttcccctcttatgcaggcagaatcaggcggccgcactccatcggctgcaggcagtcatcatgttgaagaggaggaacaattagctgcacctactattttagtaagttttattaacataaacttgagatcggccaatcatatcttgatccttaatcatccatgatattgtctcttgcaggtcttagccgatctgttctcctttgacatcaaagattacctcgatgaaacagaagaagacaccaccagtaaagcaacagctctcctgtctgatgatgtgaagaaaacactcgaagacatctcccatcggctaggagaatcactagataacctggtgaccaactgtggctcgatccgggcaaggtttgcagatatccaagcctctcttccggacgaattagtcgatgctcttactccagctgcctacctcgagcagcatcaattcaaactggagaaagccaggcagaggttagccaatcgccgggaacgcaaggacatcgaggctaaaatccaaaccaatcgacagcttgttcatgaagagaaagccaagcttgatcagttatctgaaggcccaatcaaatccaatattgatcggcttgaagctcgcaagattgaactcttggcacaacttcaagaatgcaatgctgaactggatctagagcataggaagttagccgatctcccgcaagctatcgaagaacagaaggcaaggctaaaatcggctatcaagaacattgctgagatgactaaatccttgaaagtcattcctggaaccgatgctcaagacgcccaagctatcgaagaaataaatcagattaggcaaagggctatatcggctatccagcgatacttgtctcagtgatttccatataatagtctgtaggaaattgttgtaatcggctaagacaccctaattactttgctgtttaacacatccaattttctcaaaattttgcaattttctatgtatgtgcccccctaattttacaatgttgaaaacattgacaaaattatagaaacgactaagggcgatataacaatatcggccattcgtacatgggcaaaccacaaccgattacaatagtgaaaagcaactaagggcgatataacaatatcggccatcccaaggcgatgcaaacacatcggctatcatgcatcgacaacactagccgatcatgcattaacccaaacactgggataaaacttcttcaagtatttgccatttagagctcggccataaacttctccatctagtccttgcaacatgtatgctcccttagacaccaccttatgaatttggaacagtccttcccaattcggcgaccacttgccgaatttgctatcccgagtcccaatcggcagaatcaacttccatacaagttcaccttccgaaaagtccttaggtactactttcttattataatgccgggcaactcgctccttatccctagtaacctttgcaagggctcgtagccgtgattgaaccagatcttccctttcatcggccataaggttatagtactcatcggctgttaaagtattttgcaactctgttctcctcgagctaatccgaacttcccacggtaaaacagcctcatgaccataaacaagttcataaggaggaacctgtatcgatccatgacaagccatctgataagaccacaatgcttcagccagtcgagtatgccattgccgaggataatcagaaatcttccttctaatcaacttgatcaaactcttattagatgcctcggcctgcccattagcttgtgcataatacggtgaagaattcaacattttaattcccatactatcgacaaactgaacaaactcatcggatacgaaaattgaaccttgatcagtcgtaatagtttgagggataccaaatcgatagattatatgctcttgaacgaactgtatagcatccccagaatcaactttctttaaaagaatagcctctacccacttggtaaaataatcggttgctaccaatataaacttatgtcctttactcgagggttgccgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaaagggttttataaaaagaaaaatccctaaaagtccttttccccccttcctctcttgggccggctcggcccaactccctccctctct

SEQ ID NO: 60953 - DNA, 948 bp, Oryza sativa
tgagatcatcatcttctttggcacaatgtcttctatccagcatatctcttttattaagtctatcacaaaacattagccaggcaaagactttgatcttcatgacacattttgttttccatagccaaatcatgggtctggggggttgcaatgcagaataatttagcttatagaatttcttagctgtgtacttatctgagccccagataaaattccaagcatcccccatccctgattgtaaattcaaactgtccagaaccccctgaagttgcaagaattccgagtaagcctcatccgagaggggtagagcaaaagaatcttctaggggtcttgaacacatggccttgactgaatcagacttatacatagtcacaaaaaagagattggggtagctggtgcatttaaaatcatcattccatagatcattccagaaaagggcagttcttcctgtcctgatttcacattttgctatcccctgaatatgtctacaagagttgtgatgtccctccaccaaaaagaacccttattcatcgtcaggtgtggaactttagagacatagtatgattgtgagattaatttcacccatggtaaatcagcaccattatagaacttgatcatatgctttagaagaagggctgtgttttgaactctcagattgatcactcctaagcctcctttctccttaggcatgcacaccctatcccaggaagctagagatttccttgtcgaagaagggttattacctctccacaggcaattcttacgagctgtgtcaatggccttgatgactgtaactggtagctgcaatgaggacatgtaataggttgcaatgaggatctaccaagttgacctttcaacctttgacctgactggtaccacatccaattcagttctcttagatttatggtgcaatccatgggagtaaaaggctttttctgggggcctatgcgt

SEQ ID NO: 60954 - DNA, 1717 bp, Oryza sativa
attctccagcttaaagttggcccctatgtaactccttgtgactaaagtgaatcaactctctctttcttgcaggctactggaaaaattgttgaaactcagatggcatggatcaataatcagagattgttcctggcacccatactttccaacgcttgttagctcttcttgggatggctatctagtccggtgggaagcaacagaggacgacaaggacccctccatgctcaagaccggaaagcaaagaatgcatccagagggatacacattttcgtttgtgttttagaaattcagcagacggcagggtcctcaatgcttggaagatgtattcacgtcgatgctactgtgtcggattagtcattttctctgctttctggttcaagtagcaacgtattcagccgtatagaaattcaccgaatcaaagtacaacattacaagttacaaaggtagagtagttcaatcagtcatttacaaatgtatgtctttgcttctctttttctcccatttgggatttcgacggccttgactagatagatattggtgacgggcaccttgctcgctagtcaggcttggagaatgctccaaaatttgggtacaaatatgtacagttcaaaagatgaataaagtgaggaatcttcaatgcattgtgtttttgttcactcgaccccgaattccaaaatagcttttggcctcctagtccctacggtaaaacatacatgattttaactttatttatttattttcaacagtctttgagctacgattgtgatcatgatttaatactagaacaggttaataatttaatatgtttatgagattatgaaagtactctacatacacattcaatttttatattttcaaactatgtatagtcactaatagtcaaagtgtcaaaagtttgattggattttgtcccaaattcatggtcaaaggaagtatatatgtatctcttgtaacatataagttaagcgtcatgccaaatggtatatcttaaaaactacaaagtatttgttagtatatggctagaattgtaaaaaaaacatgggtgtgattggacgcaccacgaggcataaggagaaaggaggtcatacaagttgaggattctctataatatatttgtatatacagtaaccgtactaacatatgagccaatgctatatatagtgtcattatcctgttgtacatgatgtggggacaaatatggtgagccaaaaagaataaggttatttgtaggccttggtgatcatgagagtcaagtgatcattttgatgggtgtcctaggtagcacacatgttccatggctgataaaaatatatgcctatggggatgaggccgggtaatacacccattttaaggaaaaaaaactccattatatcgtatgcatgtcatgtatttatactatgacttaaactcaattggcatagcgtctatcaagtgatctatatatacaatgtggataatgtgaagtaatttggtactatctccgtcctaaaatattgcaacctaggatgggatgttgcaacattttgggacagaggtagtagatcagttagtgatcaggtagaggtagaggtagagatatgattgtggtcatgtgtagcgatagtgacgacaagggctgtacaatgagatgatgatgaacttgaggtggcaaagcaaacaaaatagagagggaggtgatgaggtagggaaattatgtagtgcaaaccacatatgtagt

SEQ ID NO: 60955 - DNA, 29255 bp, Oryza sativa
agtttccaagtttccactacatatgtagtttgcactacatattttcccgatgaggtaagagaccccattttgccttgtacgtctcgtgtccttgtactagggttttaaatctcggctatagttgccactatatatcttcagctattgttgtttgagaaggatataagctatttgctctcatgtataatttagctgctatagctcctttcagcatgctatagctgctgctatagctgtttgaaaaggccaaccactaaatactttatcccgctatttaaggcgctgtcttgtacctacatgagttcatcctcgatgaagagcaaaattcgctactcgctactcatgtagtaggcaaggcattttgcaagaatgaaaggcggaagcatatagcggtcaaacacgtgtcatctagatctacatcacgagtttactttggcaccctcaataccaaatgcacccctttgtttcttatgtaactagagggagtatcatagttggggacacttcaatttatgcaccttttgtttctgtgtaaacttatttgtaattaatcctgcttaaaactcaatgagatgaaatcacttcactattggagaaatatttttacccatggttcgcaaccccctgtagtcccgattatacaaccggaactaagaatccgggactaaagatctttagtcccgggtgaaataaccaggactaaaaatccatctttagtcttggttggtgttaccaactggaactaaagatggtagcgtcagtgtcggttgatcactattttttttcttttttttttcattgtacctttgctcactacaaatctagaacaagcttgttgtaaagaagaaaacgatgtaattcctgcacgtgccaaatctacaaactacgggtattaatacaatatatataatgccattcccaatagataatggcaagcgacagagccgcatgctggcaaagcccggatgactagtgaccgaccacatttttcttttaagatatgaatgacaattgacgatgaagaagcaatggtggagtttcggcgaccgtatgacaagtccaggagttgactatggtgtttgaaattcatgtagataaatatgaatatgaagattaagtgttttatacaaaatcaggtggtattaacgtataattaattgagtttcaattattacaaatttgaaaaatatacttatatgatattttagagcaacttccatatagaaagttttcatatgaaacgcacagtttgaaaagcgtaacacgaatatctaaattttcatctaacttttttttagagaaaagaacgggaaccagttcaaattgtctcaattcattgaccaaatatatttatggtgtacactgcacacgaactaatattgcatatatacatatatgtaaggtgttaacttcaaatttattttattttaacaattggaaaaaattgtgacaactttaagagcatatatttgttagaattttatcttgtttgtaacggctaaaatataatgattttcaagataaaactttgtagtatataggtgtaatattattaaaagtactatacaatttttttatagattctttttaaaatctattagttgatgcgtatgaaatttatactgtaagtttgttggcatggaataagttgccaaaaatatacatactctacttaaaatcgagtgatgcaatataaatttaggtgggcatataagtaggtataatagatctatgtaaacgctaccgagcacatgcagctttgaaattacaaacatataacggcatgtttggttcgggggagttttttataagggattgggagtttagaaagatgatattataactgttttatttagttgagagatataggacttttggtggaatatggatggggaattgtggaagaaactccctccttttcaatacccaggtaggggtggtaattgggaggaaatgcctcctttactttgcctaaacaaatctcaaccatccgtttttattaatgacctaatctccaactaaactccctaccaatttacaccacctctaccaaacaagaaattgggattaaaaatcaaattcccatattaatatcaccatcaattccctcatataaactcgcaatccccttccctcgacttaaacatacaaaaccctcatttaactatatggcaagatgctttgcctcctaaatttaaatatatagacatgatgcttgcctgcatgtctaacaaactagggttaattagatccatgccattgcaaatttgctggtttaaaaaaataccactacttttcgtgattttgggtgtatgccactgaaactttataaaatttgaaccgtgccactccgtcaccatttctgttagtacctttcgtcatctctaacaggaaacgagcactggccgatgccgccgccgagcatgagacggcgatgacgaggaggtcgtcggcgagggccaggtggtctaagggtttggcaacgatgaggtgcagctcggtggtggcggtgacgagctcagcacaagattggggtgccacgagcaggcatcggtgatgtcgaggatggtaacccggcgagctcgggcatcgagatccagcaccggtcgtcggtgccggtggagaagctaatgccgttgctgagcacgactccctctcgcagctccaccctctgcgtcacctcctccctcccttccctttcttttcttttgccggctgccgcgggcgtcaagatccagcgccggtagtcggtgccgacggagaagctgatgccgccgccgagcacgactccctcccgcagctgcccgcgacggcagcggcggcagtggcggcaacgcctgcgctcccctccaactccaccggtgacgtgatgtcagactcgtcggatttggtggctgcggtcgccgctcccttccagttccacctccctccaccaggtgctaagcttgctaccatcgccggatttacatcgccgccgcgtgcctcctctgcctcgctcgccgaagttgggcgcggggaccagcgttggtgtgggcaggaggagaagcccacgagttgccgcccctgtacctcaagcccacaagctgccatcgacaagaccgcccacgagccaccatcgacaagccccctccacaccgctgtccatgagcccgagaaccgccggagatttgtcgcttactactgtacgtgccggagctggagaagaaatggaggcaccgatggaaatgtaccatcgcatgctcagacggaaatcttgacgggagtggtacggttcaaattttgcaaaatttcagtgacatgcacccaatatcatgaatagtgatggcattttttcaaaccagcaaatttgcaatggaaattggaatggatgcatttaacctaacaaactaacaacaggccattcagttgagtacttgcatttctggaattacatggcgacgaataaaataccgcaacttgctgtcttgccatcaaacctcattttcttcttctccatcgggctgtcctctgccctagctaatcctaacgtcaattcagatgttggcttttattttgggaattggaattgcatatagacggtttgatttctttacagttcaaatctaattcatccggtaggataaccaaaatcataatttgtgctaagtgctaacagtcttcatttgttttccatagcagcagtggtggatcagcttcaccttcacagggagagaaaaaacaacactactcaatttttaatgggagtagcaatataaaaatatttatagcgccatattttttacaaaaaatagtcagcatgtatttacaatataagtccataaattacatatgtaaatttagtgtatttataatgtaagtttcaaaattatatatgtaagtcttaaaattacatattaattacatatgtaagtggcgtgtaagtagaatgtaagtagatgtaactacagtataaatttgtataaagaatagcatgcatgcgtggaaaaccatcgaaagcttgaactaatgaagatgttaagttttaattaatcacagtcgcaacgtcagttgccacggcaataacacagatcttatagcaacatcaaccgttaaaaaatctgactgtaaaacaaacaaatttgtggcgacacaaatacaacctttccgtttttgatactagtgtatattaatctcttggacactagttaagcaaacagtacatttgtttcgttaggtacttcgggcatcagatcaatcggattgattgttcacttgaatatgttggttacaacttacaaatagaatttgatacgcaaaatctaattgatgctatgttatcaatttgacaacatggcatgcttagatttggaattccagagctgcatatggtcggtgagctttcgtttcctgtgttccccagtccggtcctgtatataaaggccacctggccacccccgaaaagaaaagaaaaaaaaagagaagaaaaccaagaaaggcgagagatacgcggagagcagccaactcctcgccttcgccttcggcttcggctcggcgccgcccctcccctctcggttagctgctgctcctgcacctgctgctgctgctactgccaatctgccattctcccccattcgacctctcccccgtttcctccgatcgactcgcttgcgcgcgggggaggtgtgatcgatcggttctctctcaccgcattgtgatcgatcgtctaggtcgtacgggcgctcgatctgcttcgaatcctccatttggttcgtagtttttattccccttgatggcccggacgacgcatggtttggaatttttctgctctaggctgggtttagtgtgggggtttggggtttttgttttttggttggggggatagcgtgttcgttaggtatttgcgctgctctgctcgttcggtcggtaaacgatttcaacggggtgatgcttcggtgtgttagttcacgaagttgaagcgttcgggttgtcggttctactaaattaatttattttcgcaatgaggctgaacaaacgcttcagtttctttaaataatgttatgttttgttcggatggggattttcttgttggaatactttagtttataatccttatgttggaaataaagaacctgcataatcaatatctgaagttaccacgttgctgaaatgtagcacctatcaagtggatttactactgtctactgtactagatatgtacccttttttttctaaaaaaaaaatctcgttgctaccaatgtcttgtgaaattgataaattgattacagtttagtggttcttaagaaatagggattgatttatcaattgtcattcctctaatttgatttaatgttgatttctgcagctatgatgagctcttcttcgtcctggtctaccccaagctttgggttagccagggaatcctcttcattgttgtttacacctggccttgtgcaacacatgggtcctaatccatcgtcatcttggtccacccctgctcatccagtctctgatagtcccacgttttctttccccacgccatttttctgtaagcaaccttttctttcatctttctgttctccctttctttttgtgctctttcatacctgccaactttataaaaaattaacaacatgataggtgcaagttcttacctacaaacagctcattttcctgtttatgcgtgtttgtgcttgtgaattcctgttcttctctatagtacaaatttctattatgtgttctaatgcttcaagatatcatcaagtagtttttttggtttggttatagtatctgtgttgcacatcaatctataagtccaattaatgtaggaaagcctcgtaatcactacagttttgagcttcttggtacatattttttttagtttgtctggtcacatactatatttttattaatcagaacgaattgatgcttcatatttctaatgtagtcgtccaatagtttttgttgatgaatgtcctgtggtaatacatcttgaatgctcaaaaactggctggttttttctaattgggccaggctcaaaaacatcttgatgcaaacaatttgctgaaccccagaataaaccaccgcagtattatattgtattaggcacctattgtcttcccaaacatccatagtgaatgttcaaaattgtagttaactgttatcttactcaccttggagaacctctgagctagtagtactgatgccaatggtggatgatgccaccctgattaccaatatttgatatgcagtggttgctcctgtttagagtaccttatgtatgtctatctttgatgtttatccttggtcgcacagacccttgtttagcttgggttgaaagtgctaatacactggaaggatttcacctactttatgtctctgagcatttgtttttaagattgtgaggaagatgcacatgcacatacctgtctgagtgtcccccttagcacatacttgaacttatggaggttagggatgaatctgtctacctcacaaaaaatgtattgaagcgcgcaagtgtgcacatgaatgcattcactaggatttgaaccatggtaggtgagtcatacaccttctccacctctgtgattggttaattgattgtaaggcaattttgatactaatctattttttcatggtggcatggcttaaaatttgacatgttccatttttttcactttgtaattttcttctcccatttcacttcatctagttcacttcatttttttgtatttttccatcgtaattatataggtgagcctgcgaaaggcagcagggtctatgcttataccaagactgctgatgatcttcctcataagcatacactatcaatttctgcaatgccagcatacataagcaaatcccatgaggagcttcgacatgaagattatcagagaggagacaaaggtataagtgtttgaagcatttttctgaactttagacttgtctatgaaatttgatgagttagaatttggataatgcgatctttaaagaaagcagtgacatgtcactacattttggagtaaactctttctttgttcctagaatttgattgcatcccttgtttgcgcttgcatcctttattattagcctaatgttacaccaaaagacaaattacatagctatttcaattgttatctagagcatctttacaacttactatctgagttcacgcgtccaattctctctagttatttaatctgaagcatctttacaacttattagcaagaatagttaactatttgatatttttttctctagtatttgcatgtagcaaattaaacagctaatgtgagcaataagcctatagttctaataatttatgcttagagttagtattaatggatcatttcctgtgatgatttatgtttaatattttgttggcacatttgctatatgtttgttccttttctatgtattaatctaattttatttgttaactctctaggcggtgatggcctgcagaaaattatggttaattcagctcctgtacctcccatgcccatgttatcatctgttggagctccagttaatatgatcaattcaagtcaacctgctttcagtttgaagtccaaaacaaatttcagtactccattttcaccagcagcaactgctgatcaacaatctgcacagctacagttctcaacacaaaatcactattatacttccaacccattttggcctgccccaataggattggtgcgaccatgttcatcaacaggactgcaatcttccacgccaggtctaaactgtaccggcatcacatcatttccattcctgcccacaaagcaaccgtctgtgggaacccaatcatcaactttatttcctaccacttttgtgcatccatccgtggagttgcaaaagaatgcctccacccactgtgctagctcacagactgctccttgtacgacacacggaggaattctattcggcacggctgcaaatacagtctcattaactacatcatctactgtaagttccttaaatcatggcttgtttgtgaacaaaacaaattggctctaatcattgatatttgtgttggttgacaggagccaaccacatcatcccttggtccaacctcatgccctgctactcgacatggagatgcaccttctactggatttgcatgtcaggaaaatgtattcagcaactcagcggcatatacatctactgtaagtgttgctgttgactgtagtatttatttgcggtgcagtacaagaggaactactatgcatgattattttccgttatctttgtttctcagaggaggcataaatcaaaacttcttcccacctttcaaatccatcgctcgtttttccagactctgctttatatgagaaagataatcttctttgcagataaatgcggatgttcccacgaataccatagatttgctacttccaaataacatccggctggtaaggcttagattttcttcaacaaatgatggtaatggaagtgttgcttcagaggtacggaactgaatctccatagtaaagagttgctctgcacattattatgcatgagtctttcataaaatgatctcttggcccctgtggcttctaaaatcatgttggaagctttgatgctttacatccttggtctcattactatttagaatgaaatgactttgacctttatgtctattcattctgatggtcatataataacataaccatgtccctttttgtaggttcattgtcatcatgatgctaaaacttcagaaacacccatttctttgtgcatatatcctggagagaaccaagagctgattatcaaatcaatggtgcagcctgctaagagtcacactgggaaacaatctagtccaactggtggtcatccagatgatcaaagtggtaattagtgtttgcatttcattccttctgatatatgtttcagacaaacagtttctctactctgactcatatgtacagtatgaatacatcatttatttattttattactccctccatcccataatataaggcatagtcaaacttggcacggtcttcaaacctaatctttgacttatattttctcatatactataagatttattgcaacaaaattataaccatcttaaagtaaatttaaatgtcaatccaaagatattaattttaggaaataaaatttaatttatagtattataataattgttggtcaagtatttttaaagttgaatcttggactgcgtgcatgtcttatattatgggatagaggaagtagcaattaaggagcaaaaatatgatcactgaagtgtggtgtaatttaatgttagggatatctgttgtgagtagtgaaaaatacattatcatttctaaagatttatctaaagatattcctataaatgtaaaggtatctcagaactgaacacttatcatacaagttcgatttttggttacttcaggtcgcagcaaagtatgcaacagtgctgctggtctgccatcgtcaggacctggtgagaatcagaaggggaatagcagtgctggtcacaagacaccaaagtctccactggctgctcctcgttgcgaagcgatagcggagtctgtactgcctcgcctgtacagcgccgattactacaccgtgccatctattgtggagctcgccgtgggagagagggacgagccaggctattgctcacatgtgaagggcttcacggtcggcaggcatggctatggcagcgtaaagtttgatggagaaactgattggagaaggcttgatattggatccatcgtggagttcaatgagcgtgagattattgtgtacagagatgtgagcaatacgccgcctgttgggcaggaactcaacaagcctgctgaagtcactcttctgaatgtcaagtgcgtcgaacagaagaatgggttgcagttcacagaggggccggcagttgataggtacaaggagattttggtgcagtggacaaaggaccatggcgcagaatttgtgtcatttgacgcggccaagggagaatggaagttcagggttaagaatttcaatatgtagagtcctctgagaatctataattctcctatcagtaggctcctgtgtctggtagaagtaacaacatagtaatcctgtaaaaaatgtgttctttttgtagttcggtcacttggtacggatagctggatacttctggacgaaataactttagctataaaaactgcctttgttgcgtaattttcaattttgcgcggttgtaatgattttgttagcgtttctgtcagcctggattgagttttagcatcaactctaaaatggtaaaggcagtattattttcttaaaaacaattacgtgtaggagtaacaatatatttatcctatgatctctactcctggaaatagatatgtagtcagtggttacaatgatttgagtaacatctcaagatcttgagtaaatctccatagtttaaattttaaaacttaattttagaattgtttcattttaattctatttttatattgatctttgaaccgttcataacacacatataaaagtattattcattaagttcttttagttgtttcattccttttttttccttttttttatcctataataaacaattatgttctaccaatattattctgaaacattcttttataacattcccactttgctactaacagtattagacaatatcttaggaacaaagtagccaaagtagaatggaggggggtagtttgcacgtctgtcattcagatagggagaggctgtgggcatgtggatgtggcctcaactcgtgcaaggatttaatactctgatgaaatttacattgcttatattttccatgtcctcaatatgtgggtacagaatatatgcaagattttagcagtgaagttgatctgaaatgctaatgtttaaacatataattgggttgcaccattttttttaacaatacaagtgacaatgtcaaggttgttaagcacagtaggataggatttgttatgatttgcaagatgtcaagttaccttgacaagtgagagcgcatagtttcttcctacgtaacacacgaacatttcgctagcaaataaataaacgctacatctcaatacatgttctaataaaatcatacatacagtgtattatgctcagcatggtatgaagtgttcgctaattgttaaaaatcaagtttctggctagagtatatcctatattcagcaccaatattatatcctcacaagggaaaacaaaagggttatttgacagcgatgaacaaagatagcgttcataggaaacacggtgatgctccatatgacaagtcacaggaattttctttttcagtttgttttttttcgtcaaagggttcccttatgggcaatatcttgatgttaagtgcaactctgcagtgaaaagaagtcctcggcatagcaccacttggaaggataaaaaacgtacacacacaattaacttacccgttctaatcatctagaaagagaggataaacttttggttttttatggcacgcttttcaaaatgctaaatggtgtgtttcgtgcgaaaattttctatatgaaagctgttctaaaatattagattaatccattttttaagtttgtaataattaaaactcaattaattacatgttattataacctcgttttgcgtaaaacacttaatctcatcttcaggagattcaaacaaaacgtagagtgtcaattgacttggggcgtatttactttcttaatattttcaactgtaccaaaaatttattttgaaatattttgacgttgtgttgaatgtgtttgctttgaggcttgccaaattttgatgttgtttttacgagagaaaacatcccgaattactaattcttttagggtggtaatgggaggctatgtttagtttgttagccctgaaagagaaacactaagagtaggtacaatagcaggttataagctagctataaacatattttaaagagataaagaaagagatggaagagcagcgggctacagatctgtagccagctatagcacggactacaagacgtaatgtgtgtatgacaggtgggaccaggtattaatagtatagtaagcaactagagtatgaattagttattacattggctatagatgatttggagctagtagtgggctatactattaaacttgctctaatgtcgtggtggtggagtcgtgggtgtataactttacccactagggttcaaatcctggtgtgcacgaatattatgcataggtaggtggactttcaacatgattttagtgaggttagagatatgtcgctggttttcgtctattagagcataggttaagagatacattcacggggtgtgagagtggtgttacgtctgtagtgaaaatggcaataaatcaaacatgccaattattggttataaatatgacttcttaattatgaaggcatattattttactaaacaaaaggatcgaagcttaaaatcagtttaagagacatcagtcaaacatggcacaaagagctataagatggaaaccaaactccaatagttcttaagtttctttttttttttaaaaaaaatctcatacattgattagtactctacaaatgtcatcacacctgttggtttcctggttccatagtgttgtattttggcttccaccacaagcgcaatttactcattgttttccatttctatatcttccactggcggcttattctcctccgctgcatcaacaaccaaaggtgagtccggctcatcatcctctgaacgaacaattactattaggcacaatgacctctaccggtgcaataacctcttccggtgctttgcattgaccactattgcaaacattatcctcttgcacgtcctctataggagtttgttctacctccgtgtgacttgtctcgatgattccaaaaatatatgttttcttctgcaccaatattttcagactataccctttctcccttattctagccacaaactttctccaactctcaataaatgcaagctccattactctccattgtcatccatattcaccccttactggccacacaacctttatgatatttttttcaaacactggatcttccccagacatattatacaaccaccctaacacgtcgttcaaaaccaactgctccggcgcattcaggctagtatcaacaaagatcgaaaccaccccgctatcacaaagttgtacatgaacatcgctataatatacacgaacggccacatcacctgacatcctaagaaaacatgacagattatcttactacattactacccaataacatcacctgtggtacatttttactctaatgcaaaataactaaattcgtcactactaaaaataacttcatgttgatttctactaatctacatttatttttacttagtggacactactttcaaataacttcatgttaatgtgtactagtactccatgtttatttctacttagtgctcactacttgcaaattaatacattgctactcacctaaaaatatatgtactaacctagtactaacttcaacatactactaatttaatatatgtactaacattcaacaatgattaacaaatcattagtgtcgtacttagggattataaatttatacctccagcgttgctgctctcttctgcatagtcatgggcatcgcatccccttccagccgcgcagatctctcccgcgacgatggcagcccgatgagacacttggtggtcctcgccccctcaactccaaaaatgacccttgtcgaagggtggagagggggatttaaagccgccagtcgaacacccattgtttgataggggcagtcgcagggacctgttgacagccacagttcaatattgtgcgctgggacctgttgacattgcacactgtcagatgtgggcccagtcgaacactcgtagttcgacaggtccagtccaactccttttgttcgattgcttccacctgttgaagactcgccgtttgataggcacctgtcgaatttcggcagttcgacatggccctattttgacaattatttttgggtggccatcatttttactattttccattaaatgaatattatttctgaaaacaattccacataaataataagctatagagtttgtgattttgctatagcttataacaggaagccggagtaacgagataagatccagggggactgggaaagtgcgcaaccaaaacatccaagaaaccaatcaaatctcgctggaagaaagcataaatactagacaaaaaaattccatttggacgaacatatatattccaagaagttggtggagactgactttttcttgggtagaatatttatacatgttgttgcttttactgaaatatgctgtaaaggggatactgaatagcactacagctagctaggtagctcaacactagtccagagaacataatcattatatcaaacaactcttgcgccatatgttcatgtttgattgaggagaaccatatgattgtgttaataaacaatttttttggcaagtacgtacggatgcaactccttgagtactcacaatcaaaatattatcagtatattttaaagtaaaacgaaggattagtggattaattgacaagagatgagaagtgccgattaatgaaggaaagctccccaatgtttctctctttcgggttgtttgaatataatcctgtttcgtttcttccatagattttttttttcggcgaagacatatttatttcttccatatgcttgacatgacatatatatggaccggaaccacggtcagattcatttctcgactcttgaatgatctgtcgtgccctacgttgagccaggatttgtggtgcactacatgcacacgtgggtacatttggtggtaaaagcacatagggattagctatgtatttatcgttaattttttaagatttttaaaagttacaaataaattataaattataagttaacgatataatttatatgtaacttttaaaaatcttgtgataacatattatttccgtgaaacagatgtgtcataacggaatcctatatgcacgctatgatttttaaagtaaactaggaatgcgtcatacgccaagtttgaggtatttataaaagcgagatattaaccggagaacatctgccacgatttctccataaattctttttgtcagtattaattaattgtttaataatattttaacctattagcttcatattatatcatacataagtaatatctataagcaatcatttataatcttcttcatcatttgaaaagaaggcagatgtattttcttaagaaaacatgtcaacgaaagtaaagtaagtataaaatagaagcaatgtgtttttttaattgtataatatattatcataatatgttaaaagataaattgagtgggacatgaagctccacgaaatacatgggtttatatagcctaatattattgatatattttgagaggcgatatatctatgaacatttcatgtagagtggatgagggactccacgcaacctagtaggaatacgataacgacgaagtatcattgcacagtaatattttttaaaatgtcatgtaccataaataaacacttttttatatataagatagatctaacagatagaaatactggttctaccggtttaagaggcataggagtattttaaaaatgtagcttaaaaattatggttgtttttatatccaacataataaagtgagcgtagttcaactggttagatttcttgttgtgaaacttgcccacccatgttattaatcaaaaggtttaaactctattatgattttttcttaaaaatgcatggataagtgaacaatagctatagttcgtaaaatatatatgactaaaagtaatgaatttctttaataatatagttaatttggatcttcaattttaaattttatagtaaataatctaatagtgtgcacaaataaaaattatctatatgatttagataatataattgtttaaaatttgttatcataaaatattttttccatataactaaaagaggaaaacaggagagaagaaatatgtggggaggtaagtacacacatgcatactggactggacaggcggagaggatataggggccctttttttatcattttgtatttggataaatcataaaatattttttccatctaactaaaaaggaaaatagaagagaaaggaaatatatgggagaggcacataggcatgtacgcaagcatacgtactggatgggaggggtgggatatgtgggcccttctttttatccctttctatttggataaataaatctaatggtagaaaataatgggtccatagtatattagtaaaaatcgacggctaggtgattaaatgtcacgtggcagtataagagcgattgtaggagtgctatgtggcggcgatggtcggatttctcttatttattagagtgccacttggtgacttgagagcatttacaaggtgccacttggtggattgggagcgtttgtaggaagtttaatgggctcttagtatataatagataataaataaattagaaaggtagcccgcgcacatgcgcggacaccttcttatataatgtgagtgaaattttattatgaatatttatgtgtgggtggatttttattaaaatattttttattatattctaaactaaaatgaaactcattttgtgtgctttgaacgctggttattttttttataactaaccatgcaacatataaattctaaaataaaattatttgagataatgcggttttgaattggtgagaaaatattgcgttgaaacaatgcatgtggtttctatgagaaaattttgggtattttaactcgctagaaggatatcttacaacccaaaagaaatcaaataataacatttttttattggattgtattttaaaatttttctattaagtatgggttttaaatccagcaacgtttgtccaattttcaatttatttcatgtccatttttattttttttcttttggagattttcattctattaatcatccttgaaatgatttgatctttacaatttgggacgaaaatacaagtgcatataacctggtatggggtaaaggcatactttctaaattttctctcataaaatattaaagtaatggtcatagtgtttttagtgaatatcactaaagtggattgtcttgtaacaaatacacatttttagattgttctaagtcaagactttacaatggactgtagcaagttttacaaaaaataaaaaaatggacatggtctttaatttctatatggaattgaattgatttattgctaaggccactgcacccatatgcttatcggtatgatgttcaaccaaccacacctttattttcaacatattgtctatattgctatatgaatatttgttatgattagtgacttcatagatgatatgtgtaattcggacgctatgatcatctttcttaataatatttattgttctcctaaaagatcatcttaaaagtatcaaggtcaatttctataggtacgtagccctcatatgcatgttaagagaaatcaattaagttgataaagagtcgttagatgcctaatgggatataagtaatagatagaggtccatttgtgttttttgtttgcccatataaataactttaattttaattgtcaaggagataaaaaaaatagagagaaaagaatggtgcatgctgtacacgggcgggagggcgggaggtttgggatatttttataaatgattaatctaacaacctaaaataatgtgttagatttgctaaaaaaataatgtgtcagatgtttatgtcgaaaccgatggtcgaatgttttgttttctggtcagaaattttacaattttatctgatttaagagaatgatgtaacatcttaagagtgtttataacatgtgtgaccgtctattaacaccacatgccgcaaagaaggatggagggatggatgtttggggtgttcttcttttaaacaatagatctaataacctaaaataacgtgtccatctttttttatgtcaaatccgatggttggattattttttttttgcaaaaattctaagatttttctctaatttaagaatgtcatatagcagcttagaagcatttataagatgcttaatggattttaatgctgcaaggagatggggatggagggagagaggttttttcgtattagaaaactaacaaatcaatagccgaatgctttgttcttttttaagattttctagtattttctttaatttaattgcaccacctagcagcctagaagcattcgtaggatgtttagagtgacagagtgagagttgctagatctagcaggtggaggtctatttgtggttttttaatgtaaaaataattttgattttaatttctcatgaagatagctcgttggtgcgtacgtgacggggaagttccggatgcatgtatttaagaaaaagatctaaccttctaaaataaaataatggatccaccgatttaaatgaaaatcgatggtcggagccactcgacgacctaggagcgtttgtaaggtgtcgcttggtggattaggagtatttataggatgtttaatggagttttagtatataatattatttttctgaaatttctaagattttttttgatttaataatgtcatatagtagctagattagaggtgtttataaaatgtttaacggattttaacactacacgggggtggagagggatggagagaggtctaggattttttattaaaaaatctaacgacctaaatccatcaatttaagtagaaatcgatgatcgggtgcttagaattttttaatattttctagtactttttctaatttaatagcaccatgtaatgatttaaaagcttttgtaagatctttaatgtgacggagggagagctgctagacttagtagttggtctattttgtgatttttgactgtaaaagtaattttgattttagtttctcattaaatagaaaataaaaggaaggaactgaaagggaaactcacgtacgtacgttcggcaatatgatgccaaaaatattaggtatgttggttccagaggttttttttttttggcaaaatagttctaaccatccaaaataatgggtccaccaatttaaatgaaaatagattgtcggatttctcttatttattagagtgtcacttggcgacttgagagcgtttatagggtgccacttggcggtttgggagcgtttgtagaaagtttaatggacttttagtatataatagatagatagatagatataacgattcaaaaactatgtaaaagttacgtgcaaatttacctgtaattacattacaattatactatatttacatccgagaaactttttttaaaaaaataacgataaatatatagcaaaatcgaagcggtatccatgagacacgagggctatatatgcccctaatatcttagagtgcgctagaacgtatcaaccaaaattttttatgatttaaccatttgaaaaacttgttttaaatagaaactgcacaaaaactcgattgaaaatacatagcaagctctcagaccgattagcggacatgtgtgtgggtgagatgtgacgcatgactctctcttcatgtttttttaataaagataatggaaagttacatgtctccttcctcccttgcgtcgcatgagtaaccattgcatgattagcagtagtagcgtggagagagagagagatttaccaggtcattcatctctatttggatcggcacagctactacttcggttgattcaagggggaaacaataacttggattagtttctgaacctttttggcttttactgcatgtggctctgtcatgcaggtattcatgccataagttaatcctaatttaaaaaggcactagtgtcaatcattgtccgtataccgatattaaaactctaatctgattttaataataatacatgctccttctctttcaagcttttctggtgtgagcggatgcttttccataatttatccgcagtgtacttgtctgatcttgcatatctgtgcctcccagggtactaattgaattagagtataaatcagtgcttttcggtgattaatatttgtaatgccatagctccccaccatatcgttcatttgttccaacatcaaatttcttccttttctccactcagcaacactggagtgaaagaaaaaacatgcacgtcatgtcaagcaagtactacacacggctctcgctctagtatttctgcaggcattctttctctcttttctttttaatctttaatgacttaatatttcaattcgccaaacgataattgcatttctagtagtatttaaatattatcttatgaagagtgtacttttgaatactatattttttaagtactatagtacttgctctcatttattttttttctccttttatcccaaacaccctcctattcccaacagttccacctttaacgaggaccatgtaaatatttttttttcttccatgataattgtttttaaattctagaattgcacttattataggatagagtgtatcatggtatgttgcgagctctcctttttagtatctacactggctaatttagcttcctactttgtggctgtttttttaaggtagcatattctaaataaattattcatggataaaatctgatagattatctacttgattgtagggaaaaaactatatgatatgttataatcctaatatatagcttaaattaagtgatctaagtagaatcgtcgaataaataatccgtggtatagtccgatgtataaacataaaagaacaggactcttgaatgaatgagcgaagtgtagatattgtacattggtcttgatattcttacccaagttatatcttggatcaccgactcgacgaacaattttttcacttaagaccagtttttacaacaaatatttttagtttagactgatggttcacatgtcattcagtttagaccgatggttcacatgttagtgagattaggggataaatcggagagcagttaggagaatgctggcaagctgctgcttcttcttctaggcttctatgctggtctatatactcgagcggtttctttctcccactgtttgtcatatcccccaattttatatatgccaatcgactatcagatcaggatatttgtatccctaacgttgttagatagaacttgatgtcaccggcagtggtggacccaggtcctaggccatagcaaagggcctaggacctaggcatgagaaatgctccggtgcaatctacttgaagtattctactccgagtagaattaatctggaccgtttattttatagggtagattagtaatctcctaatatagtttaggggtaatttgcataggatgttttcttcgcttcttcgcatcaggtccgacgcatcgcatctcgccccaacgtaggcaccgatctctccccgatgtagtcgcttcctcccggcaggcagcggcgcgacaaaaatcgctggcggctcggccggcggcgctgccagcagctcggcgtggcgaaatcctcagtttgcagacgtgtttgatttggtaattgaggaatatagtcttaggaaagcatactagtaggctgcctgatttctctgttcagacagatgcttatatttctaatctgatttcactttacaggctgcgattgatctcaacaagaacgatctttccgatgaatgccatctgaacgatatttgagagatgatatagctttagttagtcaccttagcgacggacgggtgaaatagagtaatgtcaggaacaagtttgattgtcaggaacaacctagctttatactctctctttggatcagaccgtaatactatgcaaagtgagactggttacgtcgcagacaactgtttaatcacggtgcgattagggctaatcttttgcatctttttggtgatccgtagcttcgtggttttgcgattcaatagtgtctaccagatctttcccgtttccagatcgtcttgatggcttgttggtgtgtgcaatgatcaaatatttgctgtcaaaatatcacgtgactgaaaatgcagccaactctgattgctaacattacatcatctctgattagcaacaaagtgtgcagtttgtgacatcagtgtccatgaaagcttccaggctttcccctggttattgccaaaaatatagtcctatttctccttatctctagaataattttggtaagtttacaacgtttggcaggaggaacgcacaaagactgcatgagtgtgcaaaaaatctgtccatattttctctgaatttgtactttgtgttaggtactacatttgtgggcatcccaaatggccaaatgagattaatataaggtgtggtatttcttgtagcaggaaacacacaccaagtcaaaccaaacagcaaaccaacatgcttgtgctatattcagaggtgcagtatttgtgcactgaacaaaaggcatctcacatcgctgtcccttgataattcatggatgtcaacagtatttcacatctgaacatccgcgcgtgctcctccacggccatcacctccgcgccacgctgccgtacccacagcggctcgccggcgctgcacatcctggcgagctggtccgcctccgtgggggcaaggtggaccaccaactgcttgtcctgctcctgcaagggcgccatgatggcgcccatgtacgccaccgagccgttcgcggctatctgcagtggcacgacgggtggcgggatgaggtcgccgcagcccatgcgcggtgcatgctcggcgagggagataggacggcgacggaggcggggatggaggggaatagcgtcggtatggagagaaatgacgacgatacgataggataggaagagggtgagtaagatactaataaattacgataatacccctatgcgaattattatttctggacaaaaatgcctctccacatttatacttccactaatcctagtgggagtagaactaaatctcaaccctacaattaaagatgatcaacggctcagattactttctactccgagtacaaagcaccggagtaggactagcgtttttttgacaaattggtccttgcagaaaacttatttcgaaactagtccctaccaaaaactatatccagaaataggccgtcggatcagcgccaaagcggttggcgctgaggttgttcttatctgcgccaacgggactggcgctgacatcgcgccagcgtggcgggcgaggcgcgatgtggcagggcctcagcgccaatgcacttggcgctgacaccttgcacaccctaaatagaccgatgtgcggcaatgaattaacggtgtcgctcgtggtgcaacggtaagtttctttcttgctatatctgaggactagggttcgaatcccaggtcagccatttttgttttttttaaaatcatcaatctacgtgcgtacatattaatgatgatctccattttcgcttttgtcttcaaatcttcaatgtactttttttgtttaaattaatttttattaaaaagaaatatcacatttagtacaaatttaaaaagtagaagaatggattaaaaaaagtttagagacaacttttaaaagaaatatcacttttttataaaaaagaaattagaagaatggatttaaaaaaacttgagttttttttttaaaaataaacaacaagttgagaactaagggtaagttttattctaaaatgtcacgtgtttttttaaaattaaaacaacacttgagcttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaacaagtttagtaaaaacataaaggagagggttcgaaccctggtcactgtaacgccacctttcaaatacctaccactgagctaagccaaacctaattgttgcttttgcttttgcttttatttagccagtataaaggccagcgccgctgtagaacatatattctgatatttatatttatatatatatatttaaaaaacagagagcatcattaatcatttatatgtactaatgtacgcacgtagattgaagatttgaagaaaaaaaaagaacgaacaaggctgccgtgatagggagtcgaaccatggtgctagggtacacaagcaaatggtcataccattgcaccacaagtgcattgcttattaatggccgcgcatccttttaattagcctgtacaaggggtcagcgccaaatacattggcgctgaggccctgccacgtcgcgtctcgcccgccacgctggcgcgatgtcagcgccagtcccattggcgctgatatgaacaacctcagcgctaaagaggttggcgctgagccgacggcctatttctagatatagtttttggtatggactagtttcgaaataagttttctataaggaccaatttgtcaaaaaaacgggtaggactaaggcatcaaaccccattcagaagtcagaacaattcattttcaccatgtaaagacatgcgtcaaaccgcatttagatcaattcatttttagtgttgggtacgtttggttgtttgctaacctaagctatagcccagttgggcaagccacttcattgctgctttgctaggcttgccttgcctagctgtttagttcttttgcttctaacggtaataccgattgtcagatgttcgttttttccaccaagagattagcttaaaacaacaaaatatattcattttacagtatattgttacaacgtgatcacgggtaggcttgccttaccaactttggcaaaggtgcggaataaatctgtgactgtgattgcggtgaagcgaacgagaagtgttatgtgcggaggaatagggaaggcatgcaggcgacgataacataacgaaacatcgttggagagtgaaaattgttggagtcgctgatttacagcggcgcgcgcgtgaagcttgtcgtcgatggcgagccgaattcgctctccctggctagcgagctttttctcgctgcttcgggttagcttgcctgcaagagctaggaaattttgatagttccaaatggctggcctcaccaagttaggctagctgttccaagccttagatataaacataccgtaactagcctagctcagttcacaagcttaggtttctaatcctaaagcatcgctaaatatctatctatctattatatactaaaagcctatgaaacatccttaaaacgccctaagtcgacacatggcacccctaaaaacgctcctaagctgccaagtggcgctctaataaattagataaacatctaaccattgattttcccttaactcggtggacccatcagttttgaccattagattaaatttccatctctccaccctaatatacgatgcttgcatgctttggtcccaccaaaataattagttaagagtaaacaaacgtaaagaatcagttatttctctccccaaaaaatcaccgtggtattaattcttggaaagaaaaccgacgttgtagatttaatgcaggagcctgggtgtgtgcttccatcatccaaaaaattataccaacgaaaactttttaagtgaatatcacctttgcgtcaaaaaagtgaatatcactaactgctctaaactatttacagagtaaggttcagattcatgaatattgccctcaatagttagtttctgaattttcatgtttttgtttgattaccagggcctgatgaaattttcacggatgctaaatctcactacattaaattctcatctctcctccgtaatatatgacggtttcatgctttggtcccaccaaaataattaattaggagtaaacaaatgcagagaatcagttgtttctcacccaaaaaaaaaatcaacaaataaattttcagatgcaaagccataggaaaagaaagcaatgcgcctctagcttactttttcgaccaatatcaacgacatccatctacattttttcaggaacgagcagcaacaaccaaggttgaaacaatcctaatcgtatcaatcaggtgagtggtgcaagcagcaacttccatctttttattgtttgatctcttaacatagccttccacttctctatttttttaagcatataatttcgcttttttacctacaattttatactactccttggtgatgttgttcgtattctgatctgttgctactagcttctacaacaaagcgatatatcaaagttcttgcctcttggacaatatattcactaattaacatcgggtatttgggtgatgtcagtttatttttgagcacttagtcaagacgtcttgatgctgtgtgctttgccaccagaaatttgttaattgattttttagataatcattttggaagggtaatgcatgccgcttttttaggagaaacatattacaaacacatgagtttatatacatacgcgtacacttatccatagaaaacatattcgagagactgagccaatgatatatcttcaaattagtgaagtcatcataaacgcctcgctattgataggaacgttgcctactacaagaataattagccataaatataaggcccatgtcaagtctagatcttaaacctaggtgggtaagttcaccataggtaactaaccagccacactcactaattgcagataatgtggagcccctcttccctctccttaactccttttttccatatattatttgagataaatgtagtatataaataataaataaactattgtattttttaaattatatatagaatttttttattcgaccacaattatattctttagaattaaatcagttcatatcgatttgaccaattgcgttatatctcacagacaaaaaaaacacgaaaacatatgttatagtgtcatatatcacattataatcataaataactaaaattagctctaatatgtttgaaaataaagtttactaaattatattatttaccattaacttaatttatgatctatattaactatactttaatctgtaaaatataaattttaggtcatatttttattcttggtctgtaatccaaacggacatgaaaattataaaaaaagatgacagtatggagtatatatcactatatattctttatcggttataataatatgtaccattaaattagatttacaatataacaagaaatatgtcatatctttgcgctttacatggcatttgagaattataacaaaacgtgaaaaaacaatttaatgatatgggtaatatcatcacataaatatgcttactaggtagggtgcctctatttggcccatatcagttcacaaatatacgcgactgaattagatttacaatatcaacaagtagctagtcacatccgaggccttgcatggcaatcgagaattatgacaaatcatgataaaaaataacaatatggattatatgatcatataaataactatcatgtggattccatctattcggactatacggggataatctaaaatgtcaattcaatttaccaaatcatgtataagttgtacgttttgtagactacaccctaaatattaagtaaaataacggatggagtacacatcgtgttttctcacctttgatttctattaaatacgtatggtgtgtgggtattttgtatatactaagttttgttaattaggggacataaacaatactaaagttatatatgagaattcaagcattaaaaatacacttcataacatgaacgtacttaacaaaaatgtactttagtctatggtgcttaaatatttataaattctctaaacatactaattatttctgctcttatttcaaactaaattcattttctccacataatataagagatcatatgagaaaaaaagaggagggagaagaagtaaatagaagtctgccattaaacagatagaataaagacatctataacatacaagaaaatttgttgattaaggtttataaactccaaatgtaagatatgctaatttctaaaaaaacacacacatggtacacataatagttccatatgaagcaacactattgttgtgaaacaatagtttctcgtaaattaaaaaccacatggtttaaataaatttgatttagaatttatataatgaaaaggtaattagaagaaaattaaaagcgacgttcacaacaatctcaaataaattattgataaaaaacatgttcagaatagagtaaaaaaatattttaagaaatactcatccacacataagtatttataattaaaattcaagcaacattaaataaggtgtcccgcgcatgtgcgcgggctacctttctcgtctagtgaataaccgacagctcctataagatttataatccaattccctttttcaaaaccaattgggactacctaaaaaaactgtcgtaagttttttgagaggaaaactttcaagagttatattgtaacttgcatataactatgttgtacctcctccgtttcatattacaagactttctagcattccttacattcatatatatgttaatgaatctaaacatatatatgtgtctagattcattaacatatatatgaatatggataatgttaagggttataatatgaaacgaaagaagcaactcatatgtaacttagagtatatctatgaaagacttacagctagcacagtggtacaactccggtctgcaaactgaagatcgtgggatcgaatcccagccacacgcttgctttgtttttcctcatccttgctcttgcacgaatctcggagcaagatctaatggttaaaaaacgcaagttttctctcctaaaaaccgtcgacaacaatgtagcaattccgaaccaattaagcacatataagaagatgtactttgcattgaaggagtaaaatctgaaacatgtgcttgattatgttgacatgttgaagaagtagatctatattagcaccttgcattggagatacatagggccaatcccacgtgaagaattttttttccacaactagtcaatgtattacaaatctagaaaatcagaaattgcgtcgacatcacacttagctgtgttggggtagcctgtatccaaagattttccttaaaattgattgtgctccaaaatggtttatccccctccagccctgcagcttgattagtccacaacttgtccagcacagcaataggccccaaaagtgtatagatgctcatgctctcgagtctcgatcacacacggacacagagtctccgccgcattttcttcttccccaacctccacactttcgtcctcccccctttctcctcccccttccccaacccacacccacacacacttccaagctagccgtctccaacaaccctccccccaccatcctccccatgtcctcctccctcc

SEQ ID NO: 60956 - DNA, 8031 bp, Oryza sativa
tgcagtccgctcgcctcctcctcgcgctccacctcgccgccacaggatccttcgtcctcccggctaactcctcctgcctcccgccgctccgcgccgagctccccttcgcgctcccgtcgccctccgcctgcggcctccaggggctcgacgcgctcctcgcgtccccggggtgcgccaacgtttccactctcggggacttcgacgccgccgtgccgccgtcctcgcgggcggacatgaacgccagctgcaaccgggacctcaccccggtccccgactgtacctcctgcaccacctcgctcagcaaggccgcggcggcctacctcctcccgggctcccccaacgacggtgggaacaacgtcaccggctgcgtccagtaccccttcatctacgccggcgccgccgccagcccgcgcggcgccgacgacccagccacggccaactgcctctacctcctcaaggtgaactctgcttccaaggccagctccagcgtccctggttgggtctacggcgtcgtgtttggctgcgtcgccatggttctgctcgttgccgcggcggctgcctcttggttcctggtgcggcggcggcggaggcgggccgccgccgcggcgctggccaaggccgcggccgacagcaggagcaagcgctcgcaggcgatggagtcaatcagcgcgagcaccacgctagtccagttcacctacgacgagatcaaggcggccactgggggattcgcaagggagagcatcattggccgcggtgggttcggcaatgtgtacaagggcgtgctcccggacggcgcggaggtggccgtgaagcggttcaagaactgctccgcggctggggatgccgcgttcgcgcacgaggtggaggtcgtggccagcgtccgccatgtcaacctggtcgccatccgtgggtactgcatcgctaccactgagagagaaggccaccagcgaatgattgtgtgtgacctgatgcacaatggcagcctgcacgatcacctgttcggtgccggggaatgccagatgacgtggccggtgaggcagaggattgccatagggatggcgcgcggcctggcctatctgcaccgcggggcgcagcccgccatcattcacagggatatcaaagcgagcaatatcttgcttgatgacgactttgaggccatggtggctgatttcggattggccaagtttgcaccggaagggatgacgcatgtgagcacaagggttgctggcacgctgggttatgtcgctccagagtatgcactgtatggccaattgactgagaagagtgatgtctatagcttcggagttgtacttcttgagcttctaagtggaaagagggcatttatctctcttggtgaaggccagaactttgtgctcagtgaatgggcttggttattggtccggagggggaagacagtggatgtgatccaagaaggaatggttgagcctggtcctactgaggtaatggagaagtatgtacttgtcgcagcactctgcacgcatcctcagctgcacgctaggccaacaatggatcaagtggtgaagatactagaggcagattcagcgtcaggtcctttaattattccggagcggcctcttccggtagtcgcaaacctggctgagattgagagatcagccagtagcagtggctcaggtcagctgtttagtccctctggtttccggtcttttactcatataaatgaagatgctgctttggagtctcctaaagaagaatgacacttttcttagctgagtagagaaaagtttatttctagattctctgtgtaccatattttttttgttagcttgatttctcttaatggaattactcaattgtgtagatagaaattgtacttttgcccccacccaggaaatgtaagattctttggtgacagttgaattcatttaaaacatatctgcttttttatttctttatcatatatttgacatttaaatatcattgattcattagtgtggactgtttttttctattggatcgtcaagatgagaaacaggaagattaaaacaattccctgttataaatttagtttgcatattgtagaacaaattgtgctatggagttcaaaggtacctttcacttctagagtcagataataagaataaatacattatatattcatattcttctattgaattgtctcgtatcttgaaatcggtaggcatagaaattctgaaatttttacattttggtcctttttgaaaacttattttacaaatagacccctgggaaaacttaaaccggaaatggtcctttttgggacgccagagtggctggcgccgtaccccaacatggcggcgccagccacactggcgccgtgcccgtgccaccgtggcaatagggctgtcgtggaggtgctgactaggccgaagggggcgccagccaaagtggcgctgcccctcatagcacggcgccagcatggctggcgcgcccctcctctgcgggccccaccaactttctctcccccccccccaaattttcgccaagtctgttctgcctccaggcaacggctggcgccccccctcccgaccgcggcgccagagtggctggcgcccccctcctccccccatcgaagcccttctgcctccgggcctcggctggcgccgccctcatggaccacggcgccagggtagctggcgccgccctcccccagcccgaaacccttctgcctcgcggcactggctggcgccgcccttcccaacctcggcgccagggtggttggcgccgccctctgcctccctgcaaattgaagatccatattgcacagatgtaccaattcacagttcgcaattcaaatcacaattcacagattcgtacagactaaaacaggttccaattgcacaaatcacaatgccaaaagtccatcacatagtcctcagatagtccatcacatattccacacatcaaacaatgccaaaagtccatcacatatcccacacatcaaacaatgcaaaaagtccatcctatattccacacatgaaacaatgtcaaaagtccatcacatagtcctcacatagtccatcacattttatatcacatagtgcaccacatatgtcatactaccaaccaatagattaacttcatacaaattacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcgcaagttgtattgcgtgggttgcgtcccctgaggcgcgtcgggaagctgtgacatgtctatcttctcggcgtctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatagagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacattgcggagcgtgttctccgtgtcctcatcacccctcggagcttggagggcatgccccatttcattcacactcctgaggagctctctcgactgaaagcgtgaaaagatatatgttagggtctagggtgcaaatggaagtaactttgacaaatgcaagaaaacttacgactctgtctctaagtggggcgtgctccatttgatatccaactctagtccggacatcatagggattccgtccctcatcggagtcgcggtcatcctctatgtcggcttccgtccaagtagggcggaggaacagtctatatgtcctatgcagccaacgaaggtactctgagaaaagatgattttggtgtatagtctcgatgtacctatcgttccttccggctgttctccattcatcaatgtatctattatgctctagcccccagtctttcaccttctttgttctcaccctgtcatacctagacaagtagaaggtgatgaaacagtagtgagcatcgacaatggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgtggaaggtggtactcaactgcccagaaacaaatcaatgggcactggtacatgaaatagtcagagtctcgattgcacatcgagttcagggtcaggcttgaagcctcatttgtgtggtatggtaaccacttaatctgcaaaagttgaagagatgtcgttggttagtatctcaattaaagaagtaaatgtctatctagaagtaatattggaagtacttacatgttgaggctgcaagcagtccatctcattgacataatgcttgtatgccacatcccggtgagcatgtgcagtgtcagtactctcaaaaaggtaggccactgtcttctccatgtctggctcattgtagggccaaggagtgaagctttgcctccacttaggccttccaaccggtagtcttaaccacatccacatctgaatcaacgagcatctattttgcaccggcgcagcatcaagttgaacgcatgaaggtggtttccttccagaaccacctagacccgagtccatttcgttcttgaatcgtttcgatctcctcttccctcttgttttaatcttcagataaacgtgtataagatgtgagcaaggcatatggtagagcaatggcctttggcaagaacatgagttcccctcacctttaactttgaaggctcttgcgccgaatctaacaccaccacacgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaatgtagtcattgcacttcatgaacgtaaatgatacgatggccgtcactggaagcttacgaacaccaactagcacgctattgaactgttcggccatgttggttgtcatgtaaccccaccagcggccatttctatcgtatgcacgagaccacttatctttatccaacaactcatcttcaagccatttacgaggaccttcgggaatacgctgccttagtgcctcaacatccctctcaaatatccacttctcgtcaatctgacatattcttaggagctcttttgtctgatgcttgtccgcaccggccttgtggaaattagcactgaagtgcctcatgcaccaccggtggtgaaccgatggcaatcctggaacaggagtcatcatggcattcattataccagcatgtcgatctgagataatacaaacctccctatgcggcccaaccacaacccgtcggacaagatcgataaaccagcaccaatctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgcttaaaagcctcaatggaaggaccaaagcaccagaatgcacgcataaaaattttcttggtcactccatcaacgttgacaaccctatcaggatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacacagaagcagagagtgtaggttgcagttttatggcattgcataacctatttgctatgaactttgatgtcagttgccggtggctccctgaaccttcggcagtagcacaactatgttccttacctacccgtgatatcctccacgtgccactagacctcttagttgcatggaccttccatttgcaccgtgggttttcacatttaacagtgtacctcctatttgcggcagaattgacaacacggtatggacgatggtgcacgatggcgtactcctggagccatagcttcaatgcgaccatggatgggaactctaaaccctttctgagaccatccacctggaatggttctggcaactgatctaggttgatgccgccatctagtagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcgacatcaaagtaatcatctggattcacatattggcatgctacttctgtcgggtattcagggttgactccgtacgacgaccaatgaacactcgccgacaaatgttcacttagatcaagcccctcttgtactaactcccttttcatcaccctcgctgcatccacatcatcagtaccgcaatgtctctttgatggtcctgcctcccataaatcttttccaagcaaaggtctcttcttctctccttccccctccaagtcttctcgtaccaactcactcttacttgcaccccctccacgacgagaataatatgtcacaaaattcttctcaacgtaatgataagaaggagatttgtttagatccaaattttctacggtacgaactaactttgatgcaaacacctctattgatctaaactgagactcttttaccaaatcaaagtaaacttcccattccaactgacctatcacatttaatatatacttatgcccttgaccaacatcgtatcttccataaaaacgaatctccacattatcctcggtccatccaagaacttctttcactcgtgaccttagttcatctagagttgggtgggtgggaaacaaaatggtcttcaatgacatatcctcaaactcaacatgtccaccaacataaggttccaccactctaccaccgtagtaaacacgaacaagtctatccatctacaccaaaaaatcaaatgtaactttgcaacaaaaattaaatcttcattcctaaacgtagtccaaaccgacatattataaccaatgcataacttaaattgtcccaaagctactactccaaaaaaatatttaatccacctacaactatcaacaagtttactactacattacacatcgaaatattacaaatactctatcatacaacccaaacctccatcatgcctcaaccataatttttcatccatccatccaaccaaaccatccaaaaattaacattaccacatatatggttaaaaaaatcatgacaccaatgagtacattgcaaacatgtagcactacaacaagccaatcctaagaacaaatgctaaaaatcacaaatttgggtaaaaaaggggttctagggttacccaccgatctacaaattcaaccaataaaaatgaaaaaaaagaagggggaatgaaggagtctacctttctcttcgatttccacaacaaatcccgcgaaaaacggcttcaaattgagtggatttgaggtggagaggtgagggggagagagagggagaagaacagcagctcgctgctcgggctgggaatggcgaaaatgggagtggggaggagaaaggtggtggggcccacggggtttaagg

SEQ ID NO: 60957 - DNA, 3413 bp, Oryza sativa
  unsure (1)..(3413): unsure at all n locations
agtcaggaaaatttaacttttcaagctgttgcacggatgaacaaggaccatggtattccagacatacatatatagacacacattaggtcctgttcttttctccaacaagagttggatgaaaattaagattttcgtggtacgcgtttcaaactgctaaacggtgcgtttcgtgcgaaaactttctatataaaagttgctctaaaatatcatattaatctatttttcaagtttgtaataattaaaactcaatcaatcatacgttaataccacctcgttttgtgtaaaaaacttaatcttcatcttcatcttcattttcagaagaaaagaagagttagcgatagcgacgctcctaattcttacggtgctaacggttgacggtcgttaagtgtaaactttaaccatcaactgctatataaaagaatataaaatatatcatcaaacttacttgtaggggtttactactaaccattatcactcgtattggtaaatatgagtatgcaggtgatttctaaatgaaaacacacccgtcttgcgacgaaatgcatctccgaccaatcgtacacgagcgctaggattggagggtccacatgacagtcaaaaccgatataaaatgggcttatccacgatgcactaatatagggacccgccagtcggcctcctagccgaagaagcagctcggaagtggggcccacagtttggccaaactaggggctcagccgaatcttcactgccacctcccatcctgaccttccttatgtaggctccagatgcactcctagtggtggttatgttggtaaccttcatagcacactataaaaggacaagaaactctcatttccaatacaagacttaagtggagtataactcacatccatattttaaggcatcaccttagtatgtggaattaggtagaaagtgatgggaagctctggaagaaatgcccccaaatatcggagttctctttgggaagttcagaaggagtgtcaggtttgttgacattcttccactcgagttccggagaagcattggagttgtcagccttcttctgttgcttgacctcagcgaatgcttgttttaataaagtaagtatttgagatctccatatagtatttaattatttgcttgagtgagatatagttacatcgttacgggttcgtcgcttagttcaattattatgtgctctagtattaggactctgagtaaagaatgaagtttctgcgcgaggctagagtaattatcaataacttaggcgcggtgtctaggttagtggtttcctttatttgttgtgtgctccatgcaaagtgaggtatgcggcaggtggtgacaaccttgtccatcttttatatccctccatgtttacgtacattgactcagtttgtcaaaccaggagagtgctagtgctcaaagcaattgatagagttttacctttaactcaagtatagtacattaacccgtaagaatcttctttagccttagcctaccattaggtgctgtccttggatagaatcctattattagatatgcacacaatccctatgatttgatacctttggaatactctaagttgaagtgctacagcggtatctgtgcgcttccgatttttattttactatatcaaatactaacaagcatttctgacgctgttgccatggaacggttgctatatcatcttcaaacctgattcatcctcatatcttttctttgttgtccttcctttctcttcttacctagcacggagcacctttctattcaaaacctttatgctccaaggaccgagttctgtgagccacctttttcttcaaacatatctgttcatctggtatgaactccgtcctagcttaagagccatggttcgggaataatccttctcaggatgtgaaagcgaaaatccctaccatcatttgcgtgagtttgagcaattgtgcttatgcctgacaataacggacatgacataagaaaccttaaagtggaaattgtttcacttctctcttacagagggggcgaagcaatggtatactcataccatgagaaaactgcatattgatgggacaaattaaaaagcatattatgccttgctttcttcctgttaacccgtgtagtctctctacgtggaggttcacgcgaaagaatccattggtgcagcctatgctcgtttctccttgttaactcaagacgacacagacttttctttaccgatcatgtgttgttacaacacttccactcgggtttagacaagatgtctgccatgtatctcgatacttctgctgtaggttcgtgcgcacacaaaacgatgtctgtggacaccccgagtattataccatccagtgtccaacgcgaacaccacatactattggagaagtgggatccatacacgcataaatagccactcatcctcaatgtgtccatgatcgcggttgacaaccttctgttataataactggaatgccaagtagtgaacacaagagataatcataagatagcttgccagtctactccgtcatatgtccgtcaaccactcgaaggtggcgaccaaaagcataccccagtgactcgatccaaggcactatccccgattatctcaagcgatcaaaacccgttactcatgcttagctagtccgtaggaatgcgactagcctcacactttcatcgcaagcaattaataaacatagcaagtaccataatagggttaaagtgcagcaggtacatgacacataatagggtccaagatcccaacatacaacacataaatatagcagcagaagtctcaattagagttcataggcaaaagataaaatcggtggtgccacaaccccactagggcaaaccaaccgggcaagagccaagctgcaagagatcactcattgccctcgccaccctcagcagagcaatgaccacacaagaagcataactcataaccggaatcctctcctgaaattgcagacaccgggttaagtacaagattgtactcgcaagtcttacccaaaattatatatacataagggagagagaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgc

SEQ ID NO: 60958 - DNA, 20755 bp, Oryza sativa
  unsure (1)..(20755): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccatgtgtttctcatttatatgacccaagcgacaatgccaaataaaagtgggattcaaatcattagacgttgcctttttgcattaatgttatagactaaacatccatcaagattcacaatgtataagccattcatcatgggtgcatggaaatagaaaatgtcattataatagactgaacaaccattgtccacagatctaaaaccataaccctcttcttgcaaacaagaagcagagataacgttcttacacaaagctggaatgcaataacaattatttaattccaaaactaatcctgacggtaaagataatggcatagtgccgaccgcaatagcagcaactcttgctccattgcccacgcgaatgtccacttcgcctcttgctaagctcctacttcttttcagcccctgcaacgatttgcatatgtgagcaactgacccggtatcaaatacccaagaatcagtagaggaagtagcaagattaatttctataacattaatacctgaggtggaactctttccatcctgctgcttctgcttgagctgctctaggtatttcatacagtttctcttccaatgacatgtctccttgcaaaagaagcactctgcatccttagcgggccctgtcttttgaaccttggtcttagagttgctagtacttgtgatctcatcagagtttagctttctcttttgaccacttttcttgttgttgggcttgcacttatgcataaccatcacatggttggagtttttcttaatgctttcctcggcagtctttagcatcccatgcaattctgccaaggtcctgttcaggttgttcatgttgaaattcattatgaatggctcaaaactgggagggagcgactggagaatcaaatcagtagtcaactctcggctaaggggaaagccaagcttatccagactctcggtgtaaccaatcattttgatcacatgtgggctcactggattaccttctgcaagcatgcacgcaaacaaggactttgaggtattaaacctctcagctcttgcttggtcctcaaacatgttacgtagtttcgtgattatcgtatgagcatccaatgcctcatattgcctttgaaactcaggggacatagtagcaagcatgagacagcttatatcaaggtattcattgcatcacctttcatgctccctacgttgagcagcaggagcattgttgggcaagtcagctagaaaaggctgtgtaagcataaactctttgtgctcttgcctgagaacaattctcaggttgcgataccaatccatgaagtttattccagtcaacttctctttctcaagaatagaccacaagttaaaattggatggtgcaggagctgccatgatctataatagaaatatatgcatgcaaaatcagcaccatgtttacatttaacctttcattaaacaatttaacaaaagatactcccactatgtattgtgaaataaaattccctctagtaacatagtgagtcaagatcctcattttattagtgtctagtaagctttggcatcacagctagacaactatcaaaataggtaagcaacaccttgctaatcacatcatatgtgactcttgtgctattggggtgacatctccatgtccaacccaacctatgccccaaggtccaaaactgttttgataaccttgtcaagtaaaccaatgatctccgcatatagatgtccgatatctatcctattttatcatgataaaaagtgacactttgctatggcaaacccatcacttatgatcacaaccgtaataggtgcaattattggaagagcataaattacttaatttttctgagggaatctatcctaccatatcatatcaaatatataacagcaataaagtaagatagatataataaaacccaagcgaaatctaaggggcaacgcacacggcggtcccgctagccggttagcgggcagggggtcgaggggagagccgtcccccgcgggtgaaaaccttaacggcgtaatcaaattatgccgaaaccgagtcaatctcattggcttgtttttctcattggcgtgcggttccagtggacatcggactatccgatgaacacactcgcgctcggcgttggtgagtactaaacattctagtgaagtcaccaacatacataccgattgatctcatcaacccatgtggctatcggttcatctcatgttccgatcacctaagaactcatatacaacataatacatctcatctactacatccgcatatcaattatatgcaatgatctagatcataaactatacaaggcggctctgataccactgttgggatacgcgtaggctacgatagcataaatcaaaattttctatcgcgtaaaccaggaaccatgcaagtattagatcatagatcgttaccactcgatgcgctgtgcagcggaagaagacgctgagaagtcgaaggaactctcgcgaagtagcgcgtgtcgatgtagaggaagtagtcgatcgcaccggctcggccttctcctcctcgtgcgttctcctcgccgtgcagatgtgctagcacccgcgcgcggctagggttttgctcgggtagggaagtgacggctagggtttctcacctccaccggtcacacccctcacgaatatataggatccatcactcgggcctccaaggcccgtaggactactattcggatccctatccgaattaagctcatattggatctctatccaatcctcttattccggcccattaagtgtgcgaccctgtaggttcatgtatacttggctgtaacctgaaaactccttttcggtccacgcgtcaacagtggctcgtagcagaacttattgacccatcgggcatacataaagatcatatcggctgaacctctagtatatacttgtatgaacccctttgcctcacgatatcgattaagctcaaggctagatatgtgccatcctctaatagctcaatcattcactcgaacctgttgatagactatataacttatgattgactcctcaatcacctttggcatggccatacacttccataatctacaacatcgaggggtccagagatatctctccataggaggggcaaatcccatcttgattattcatatcccactacatgtttcatagcatacccgaaaactacttttataactacccaattacggagtagcgtttagcagtccctaagtaagctattacacatgttgagaaccatgataatctcaggtctaaggattcaacaccaatactcaatgagatcactgatgacacaacacatatggctcttgcagtgtctcatgttgggtctatccaacatgttcatcaacatgtgtccacattattaatttggtatctctataccatgatccatgagacatgatcatgaattaatacatgtgctgatcatataaacatatttattccacatatgatatttgatcagggatcccacttgggtctgcttttcacaaggcacaatctgtttttatggttttagacacatagtcatatcatttgtagttccagaacaatttctgagcacaatctgatagtactatgaccatttgtttactaaaggttgttagcttaactatgttagtatccccgcaataaaaagcttaactagttagtagattattactgcttttagtggtgtatcgagaaaagatcaatttctctcttactattaattagtgaagaattggaatcgtaatatcagtacaagcatcaagcatctacaaattcaaaagttggagtcttacactgatgaagggatgcaacgtctgctaaactcgtgttcatatactaaaacaagaaagctggagaacctgtggcagcatcaggaacaccttcttcttcaagtaagtgatcttacttgcattatccagcaaacaattaattttagtatctttctattgtcaacaagagttaatttcatgtaatctttaccattgaatattgttttaatcatcacagcttactagccttccaagtagtacaatgtcttaatgatcttaactaaagagaaccctaaaaaacaatagtggtataaaatttattgagcagcaaatgcttcatcatgtaaaaactattatgcaagataagatgacaagatttataccatgaaggtgggttgtgaggtgagctagttgagtcattagcttcagataaattcatagctcaatggcttttctactgaggatcttagtagcaattgggacaactcaagtttttagggaagctgaaagtttgacatacgtgctgctactttgaccaaattgactatattccagtctagtgtggtgaagaactatgatggtcatccgatgtaatcattgaaacaaaacagaatctcatctttcttatgaatttgagtcaacttttctgtctcaccaataatctccacaggaacagcttccatcgctgaaacaatggaaccgatgtgcatctctaacagtaatctgtctgaaagttatggcagagatgattatgatggcattatgacagtctccacgtgtccttagatttttcatcacaagtataggttctccttctactgtattaatcaaaccaaatgctagtgcaagcttcttgctattgtgccttagccttgtctcccctccggcagcatgatcctttgccaaggcccatatcttatctggaacataccctgcaagcttcatcttctctgacatcacctccaagaatttgtacacgtctttgatcctaggatgtgagatatcattggcaacgaaaatatgtactattctgccaagatctatccagctgcagccaggcttctttctgattccccgatttctcaatagtttccggatttgtgcagcctcctcccatttgccaacagtggcataaatatttgagagcaccacatgtgttgatgcactgtaaggagtcaaattgagaatctctttggctgctcttgctctaagatccatgattccatgtgtcctacaagcactcagcgaggaagtccaaccaattgaactaaggttaaaaggcatttctttagtcaactcctcagccttctcaaagttcttggcacgggcaagtacgtcaaccatgcaagagtagtgttcttcgcaaggttcgatgccatatttgtgcttcatttagtaaaaatactcccaacattcaccgactttcctagtgtgggcacatgctgacagcactgaaagggaggtgcgacttggcgtaccgcgtgtgcatggcggcgccgaggaacaggtcgcctgcggccgcgctgtcgctcaggacggcgatgaactgagccgcggccgcggtgcacagaccggaagtggattttgatcctcgttgtttggatgtagggggtgtttagaaacaagggtgaaaagtcttggcgtgtcatatcggatatacggaacgtagtctaataacaaaacaaattacatattctgtctataaactacgagacgaatttattaagcctaattaatccatcattagcaaatgtttactgtaccaccacattgtcaaatcatggagcaattaggcttaaaaattttgtctcgcaaattagtcgtaatctgtgcaattagttatttttttaagcctatatttaatacttcatgcatgtgttcaaacgttcgatgtgacagggtgaaaaattttaaggtgatatcaaaattttagggtgggatctaaatggctatgaaaaaattgagaagatatatttacacgtgatatatcactccacaaacatgcatgtaaaaatttaacttttacatctcgcaacgaaaaaaacaaatttgactctgaatatacgttaactagttgcggttaatttgttttttttgttacgagatatagaagttgaatttgagcttgcatgtttgtggagcgttatatcacagaccacgggagcagccaaaagcccatcattgcatcgccaagttgccgctagcccgcgacacactgtcgtggcatggcacgtccactgtttgtagtgtagcacgcctacgggcactgaagccaggatttggcgattggatttgggggtgttgaccatgagacgtgagaactcgctaatggcttgatggacagtgatgtggggaacgagatccagtgatgtgctattcatcagtagcgttggatgcttgggggacggtggatcgaagagctactgccctctgacgtagttttcccaacgtcagaggatcgtgacgtggacgtgaggtcggtatcatgtcacaataattagcaactagagaaagaacacaaaatctacgggcaagtctttctagatcatactaatatatgcaattgtgcatctctactccttaaaaattctggattggtgatggtgaaaccaaagcaaacataggatccaacgtacgtcgacatgattggagcgagagcgacgaaaaaaaaaaaaagtacatgcgatccggaacggaaaaaagcgtaaaaagcgtcgacgccccgcgacccgcgccccgtcccgcgagtcccgcgtcccacgcgtccctcgaccgcaccgcctcctagccgccgtcgccccttcctccgcgcgccctccatcgctgctgccccaagcaccctcctcgccccctcatcgccgccctcgaccgccgacgccccgcgcgccctccaccgccaccgccctggaccgccgccgcctcctcgccgccatcgaacgccgacgcccctcgccgccctcgaccgccgctgcctcctcgccgccctcgaccgccgacgaatcctagacccacgcccggcgtcccgcgtcgcgcgccgccctcgaccgtcgacgctgcgacccgtgccgcctcctcgccgccgtcgtcgcgccccgcgccgccctcaattgccgacgaaccctagacccgcgccccgcgccgccctcgaccgccaccgttgcgcctcgccgccgatatctcccacccgcgtcgctgctcgccggctgcttcgtcgatctgctccgcgccgcccgaacaactacgactgcgccaccgggagaccaacagccgccgttggctgcttcgccgatctcctccgcgtcgtcgggagaccgatgcccgctgctcttggctcactctccccaatccgcgccacctccgccggtcacgatcgccacggaggtctatccgtcgcctccgcctccgtcctcgacgccacagtctccctctataggtacaggtcccctcctgcctcaccccaacctccccccccctccctcttctctctctacccaaccctaattactcggcccgcagtccattgccggggtaggcctcgccgccaggccccctcccttctgccacatgaaaatctgctcaattttttttaccagtgaagcatgtatatcataaaggtgctgaatatagtagagaatcagatatcataattagtggaaaatcatacattggcctaatatatacagcagaggtcccaaattaacttttcagtcaaacaattgcaataatcgagtaccatcgctcattatctggagtggtttggcgatgtagaggccgggtttatcccattttctaaaaaaaaaatgtctggagtggtgcaatcttccccgaagcactataatgcttgcctggtgaattatgtgaagaatcctctgaagtagtggcacatcaaccttcttcgcttaactggaacaataaaacagcaatgggattttgtcagtttcttcagacatcggccaacattgttcacttctgtaaaattgctaatcatggtttattttaagtttattacttaggattagcagaagttaatttattggactgcttcaaagtgagtctgcctggtgtgtacaaatttgcataaaactgaatatgaaggagcgcaagtcatgaactgattgatgctccaggaaaacaataacagcaattaacagtttcactctccctaaaaaaatacagcaactaacagtttcagaggccctcctttatgttcatgaatcaaatcaaattgattatttatacaatttatatatctgcataatttgtctcacaatgatcatgacattcaagttattgctacttatttcagtatatttaaactgttgtcgcagataaaaatcagactttttgctctcatcatgcaaagaataatttcttttattctttactgctccaatgatacttcggttatttttctacttagtcaagttcttataaaatttgggagtgcatctctgttgaacccggccgacccgaccctgcaacaacgcctcaccaaccgtcgcccatctctgcttggacaacatagtcaactgccatctgctcatttcacggtataacccagcatttttcccatccttatttattttcctcctctcttctgatcttgtgagatttttttcttcatctttattgtgggtatgtctctgcaatattctttgagtacatctagattcacatagacctttgatccagtgtcctgtgacatgtccaattatatattttgggtaccatgtagatcagttattaattctacgatgccagaaaattactgggcttcacattgaaaggctataaatattattctatttcttccctctcatcttaattgtgtgtgacaaatactttgtgtcatgactggtccttagctagatataattaatgcatggaatgcttgattggttcatgaactggccttaaattgcagtcaagatccatccatgtgttacaagcagatgtttcgtgaatacttttgctaagctctgtactgttcttagctcgaagacttttgctatgctctgaatactttcactgtttgcatatacactatcgctaggagaggatcaactgtatctattgtttgcggaacagatatggcatagcgtgtagattttgatgctatcacatttcgtcttcagtttgattaattaaccattcccctgggaccattgctgactgtcctataaataactgtactgacatattctctgttgctgaaaagaaaaaaaattcttgctgatatggtcttctttgcaacctggaatggtcagtttaggaacctggaatgttgtccttgcacaactaacgaagtaatgatatggtcttgatttgcaggataaggagactaggagagtgattgggaggatctgctacttctttgtcggatctgccacttcttgcaatcagcaaacatacgtaagaaagtgcctttagctaattgatctcttcaaactcctatctaaacatgaacaataagtcctcggccttgagtgattagggaatgtcatatatatatagcatttgaatgaacttagcttcagtcttaagactcttggtgcgattacaaactctgaactcaaatggagaacacctctctttttaggtcaacattctgaatctgcattggcaacatgcaggcatctttgaagggtttctcaatgggtctatgagggcaccaattacacactaataatttagcatttaagctgtaggaagcctgtcgatctcctgtcatgtatacagaaataggagctttgaagtcttgtgcatctgaagcccagaatacatgaagctcctatgctgagtttttatcatcactatgaatttctaaagatgccctgtacacttgaaagtttactgctgaattttcgagcttttactattgttctaaaattcttgagatgtactatcaggactcgaaagttgagtgtctcactccattgcatcttgtttttaagatacttaaatagaggagcaattagaacaatgagatgccattcaatcgtttgaactattttgtcacgtgaggaaacctggggagtagtttgatattcttttttgttcactattttctctctatttttgatctatcaaacagatgcataataagatgctagcctcgtcatcaatgaaacgtgtgcactgcatatttctgttggttgtttcacaaattcataatatttgatctatcatctcatttattttcagaaatggttaagattgttgggggctccacaccatcaagtacaaaatcaggttagccatgtgcatgttattgactcaaatgatgcactctttgcatgctaatttcgcccatgtcttcctttcttatgccctcttgcaaatatataatttttttgagaaatttaatgatttactattaacaaacgcccgattattttttctttttttaaaacgtgatcattttgctcataaaatgtgacctattttaagcaagccatgctttagttcctttttaaaaaattgcattcaaataacagtgcattagcacaaaaatgtgccgttgtttgctgggctatttttctctcaaaggtttagaagtgacaaattaaaaatcttggactattgaagtcatatacttggaggatgatcccctggtcaacgacgtagtaatatgcccgtgcatcttgttctttagatacagatcttagctaggatttgggatgaaagcaaaaaaatatgcgttcacatgtataagggtcacagaggaccaattagaacaatcagatttatatccctgggattcatgttctgggcagaaattctgtttaaatctgcaaatattattttataccatattttgaaattagataggatgtggaacttcctgctactattggtgtttcagtaatctgtattggcaatacagttgttctcatggaattaatatgtttgcatctattcatataatctcttgtccaataattttctgtacctttctgcgatatattgtgatgtaactatagcagttgttcactgattaatacaccttctaggtctgcactttgaatctttatgtggagttccaccaactgaacttggccactaactgactaactatgattttgaatggtattgattggatgtgtgatggaatcggttcacatttttgtcctgtacaatatgagtgtgatgtgtgaactgttagatttctgtgatttgattactggcacaatgtgatgaaatcggttgaacttctttgtcatgtgtggaaacctggggagaatttgtttgtctatattttatacactcttgtaaaatttaattgtgaattgagattgtaaatatggtgctctggaaaaaaaaactacagttagctatggatttaaattaatactctcttcgtttcatattagaagtcgttttgattttctgcagtcaaacttcttaaaagtttaattaagtttatagaaaagtctatgtacttagtagctattcagcatttatttaataaaaaaatgtgggacccacctatcatactcttcttcccctcttcctctctctctcctctctcgctcttcctctctctctcttgcagcgcgcacggcaaggacgggcggtgggcgtgggcggtcggtgaggatggcgcagggacgggcgatcggtgaggacggcggtgcggatgtcggcactcaagacagcacgcacggtgcggcggcaggaaggcgtttggcgttgtggtccggaagggagcagcggcggcaagggacacggaggcagcgaccacacgggacgcagaggcggcggcggcgaactccgcctccagccgccgcctccgcctccgccactggtcgggatggcgctcgggatgagggtggtggctggtggcggaggaggctggaggcggagctcgggatgaggcgaggctacggcagcgaggtcggcttcgcaagcacgacagaggaggcgaggcgacaatggaagagcgtggctgcggaggaagcgaggcgaggcggcggcggcgatggcgtcgacttcttcattgacaacggcccgatcgaccactacgacgacctcgccaatcgcatccatgaccccaatggatctccgatgccgttgcccctgtccaggagcatctccgatggcttccccgtgctgtagaacacgaagtagagcacgaactggatccacgtcactcggtgcagtcgctcaccgtcacgttgagctccgggaaggtgtcggccatggcggcgacgaggccggcgcgtgtgccgaggtacaggggcacaacgacgcggaggaaggtgtcgttgggaagggacggcgccacgcgctgccacttgatgaggaggttggtggcagactagtttcttgagcggtggacggtgaacaccgtgacggtggccggaacggggacaagccggagcttccaggacaagacgatcccgaagtttccgccgcctccgcctcggatggcctagaagaggtcctcctccatggcggcctgtcgaggagccttcccttggtgtccaccatggtggcgtcgtggacgtggtcgaaggcgaggccgtgtgcttccgcagcatcaggtcaaagccaccgccgctgaggtacccgctgatgccgaccgtcaggctgacactttcggggaacccgaggcgggaggtcttgttggcgatggcgtagtacacctcgtcgagcatcgtgccggagccgacccatgctgtctggccacggacgtcgaccacccgctgccgccgccgctcgacccgcgccgacggcccgagagagagggggcgagagagagacaagtgatagagtatatatgaatttatataaatatttcccattgcaacgcatgggtacctaactagtaaatttaatatgtccaatgaccttttataattataaggattatatgatgtttcttgatgtggttctggacgtctttcaacacacattttctgttcatatatgtctatatgaacagtagaatatatctaaaaaataccattttaaaataaggtcgctatattacaccaatttaattgactaatcaatttaaacaagtaatctaagtaagaactattgggcagcttgtcaatgacatttattagatttttctcttaattaataatgtaaacaagtaatctaaggaagaaatattgggcagctagctagctgctttattttgcagctaatcccatgacattatatgctaaactggtggctaattacccagggtggggtggcattggggtgccatgccaacccaacaccctcgatggcttcaccactgtttacaggctacttgaacactctgatttttttttctcacaaatcagatgctcttccctgcaagatatgcatacgcacggtgagtgcccttagcgctattatgctcatacaaactcccataccatatattgtttagtagttatacccctacgtgatatactcctatctctctatcaactttctaaacaagcttttgaatcattttttttcttctaaagtatttatctaatatatattctgattgtacccattatatttattgtaaataaatctttacaacaaaatatcacatgattatattttgataaaaaaatatcaaacattataaaatacttactaaaacatcaaaaacatcgagtgcaacttttgtaaatgcattagtgaaacatcagaaagtgctattgaaacatcatcgaaacacatagagggttgttgaaagttgaaacatttctctctaacgtatgaaacatcaaattttaacatatgaagcatgtaattttctttgattagaatataataatgtgaggtcttgttataaaaatttaattataataaatataataatgtaattcgattgcacatcagataaatattttaagagaaaaaattatataaaccatactagcaagtagcaacttacatgcatgtatgcagaaagagagagtggttgtggctctgtgcatgcaaagaaagagagggagagggatggatgcatggcttttaatgctaacagaaagatgcttcgtgacctcgctccaagggcagcacccgatttattctccgggaatcaggcgtccgatagaaagcattgtcctcgagaaaaagggagaaatagttaaaaacatacgattgaattcaagctcaaaacagaagattgtttgattggattggaaaaatgtagcaattggatgggacagatagagtcataggaaactttccgtgaggtgggaccttatgttaaaaatcttataaaacttgtatggattgcggtattcctgaggaattttataggattcaatagttttcaagtttcaaaggatcatatagaaaaaagatgaatcttaaaaagaatcctatgttttccgttcaaattaaaggggcacgtattgttttgctggggtagtatcgttctgcaagaacaatgatggtgaggaaggagaaggatgactccgttttcaagtagtagaaaaataaaaaaaaatagaaataaaaaaaatctctctcacatcagatttggtggttgtagcaatttggactcatcctttccccttgccaaattttcgtaattggttactatacttgttttttaatataggacattgtcaacttttattcaaatttgactaataatatttattcaatcacttaattaataagtaactaaactggaaaagtatcactaaatttgccatcaaaagtattataaatgtgcattatatatttgtttatttgcataaatatttcaaagagaattaatcaaatgaattaaaaaatcaacttgcattatatgttaaaaacggaggtagtatcatttagagaaaaaaaatgtatagtatttcaattacaagtacaaccctggaaagtaaggaggggtaaatttacgaatacttgtttgagtagtcttacctctaaaacaaaatatttacattttccaattaagtaaactagtagagcattaatctaagtctttcaaacaatagtactatccaagaagttcacccacaactttttacagtaacacatcgtcctaaatgtctttcatttactgcacagacacatctttcatttacccctcgaatatttccagcaatcgagcctcaaggtgctcaacattgaacctcgcagacttttgcttcttgtccgagtagctctccaagtacattcggtacaatgggataaccttctgggtgatcttctcacgcagcttctgtcgaatcacaggatccgtgaccttccatgtcttctgcacattgtaggtcatctcaaaacgagaattgaacttatcgaacaattgctggggccataaaattttaggaattcgagttattatgaatgatgacatcacaggtgtccaagaagcttcgacatagcttgccaagaactgatcaagttggacatggcgttgcaagcaccagctttctcctagaatcagcttcagatcagtataattgttagcttgctcaagcacgaagtttatattgttcagaaggaacaccagttgctgcccttggagtgccaaactcctagagttcatgtccaacataaactccaaggatgagatcagttgagtcactacttgaccaaatttatctggattatcgtttagcatcatatggactttgtccttttgttcaaccagcaaccgcataagacccataatatgctgtgtaacatgatggacacccgtgttagaaatgaccaaatgttgtgacctgagcaaaccatttagttcaaccaacagcacaagaaaaactgctgacaatccatttgtaagcctttcaatttccattaaaatgggacccttagtttgacccaagaacaaatctaagatttccatcttggcatactccaatgcctggaacataatcaacagattgaccattttggatggaaaatgcttaactgatgcatgagtatccctgcaggaaggatcatttggacccacctgaatgcagattgcattagcatagttaagcagcttcatgactgattccttagcgattgcagagaagtagtccacctttagtgaactgaatgttccatggtctttctgattcaactgcgttcgcatctcatctagaacactaaagacagtccgcattgtcgatgtccagaccttcaatagcaattctgtggattcctccatgtggttacccaaaattttatcaatgtcaagaatttcaatgtacctgttccatattagtcaagatcacaaacgaaataaagtttacaaaacgtataaataatcaagttaaagaaataggtagtacaatttaattactgtatttgcctaggtacaattatttggggctgcaagaacttgtgcaggacaaacgattgctgcaatcaatcagctagcagaaacaaaaagatcaagcaaccgatcaacagaaatactgaatcaataaatatacgaacctgaccagatgctcactgtgttgatcgaaagctcctcggagcatctgttcgtgtccgaccccaatcatgaaatcagcaatcttgttgaggatggacactgacttgaggtcaatgtgactggccgtaactgacgaagcttggccacttcgcactgttctctcctcactgagtgccatgtaatatccgtcaaagctcacaccgtttgggccgctgctaccgccggagcaggagcgagaggtactcatccatgaggctgacgaggcagagccagaaccgtcgccgcctccgcggcagctggacctcgcgagctcccagatagatgtaggtgtgcaaccgagataacttgccagagcgtcaggtttccagatcttgaggtggcacaactccactgcaagggagcccatggccgtgacgaggagggattttgcgcggttgtgcagatcaccgtacgccaagacggggtgctccaacatctgcagcaggttcttggcggcggcgaagtagtcgtcgagccgtcgccggtggtcccggaagaactccgttgtttcggggttcttgcagattccgaagacgattgatctctcgatgtcttggaggaataagcgcagcgtctgctcctgctcgcgcgtcgccgccgccgcagacacctcttcgctaaattttcacgcgcagttgatttcagtgtttctagaacgtagtaatctgcagttttgcacgttggagttaggatcacgggaaaacctgctgtgctgcggcggcagatgggaggaggaggaaccatggaagcatggcgagaaggcgccgagaagagcggctccatggacgcggcgctccagatcgcagcggggggccgccgcgccgagcccgccaagatcatcagggaatacatggtagtcgagtcgtcggtggtcttgctgcgctggagaaccgcgtgacgaggctcgttcggctccccggcgccggctggtcgccgcggcgaggcctcgcctggttttcgcgtccgttgacatgtcaatctctcatgatctcatcgagcccagccttggtgatttttatttctgttacttgcacaagctgaatgcttccaccatagtttagccgtttagcacctactccgtccatttcatattatataagtcacttttatagtcggccatatgggccgtccgacacagcatggtctaggcccgcctgggccgaggttaattgggctagcacggcccaaccgacatgccgggccatgctgtgccagcccacgtgctgcacacatggcccagtcacggcccaatacgactccagccgtgctaggccggcccgaaggcacgacagtatatcgtgcttctccatacaataagtctaattttcatccctaaactctatgggctatgttcatatagctggaaaataagtttattttgtattcctcttttatttgggccatgccttctatggttatttaagtatatttttcgtccctatactattttcttctatcgtgccataccgggccggcccaccatgctgagggtgtagcctaggcacgccccgactgtcgggccgggtcagcacgggcgcgaccccagtcaggccgtgtcatgcttgggccgggccaaaatggcgtgccttgggataggccacggatctcgggccatatggccatctatagtcactttgatttttttttcccagttaatttttttaagtttaactaattttgtagaaaaaaactagtaacatccacaatataaaattaggttcaataaatgtaacatgaatatgttttaatagtatatatatggacctgcacaccaggaagggagagatgtttttttggcgaaaatgggggatgaaatttctcaatgattgtaccctttcttgatgggaggtgattttaacatatacatatatagctcagataaatctaatgggattgtagatgagagaaggatggaaatgtttaataagttcatcaatgatcatagtcttcaagagtttcatagggttggtggcaagtttacctggacaaataaacaaaattgtccagttatggtggtccttgacagagtctttgcttctaattcatgggataaaaaaaaatccactcaccttagtttgttctttattaagggtggggtctgatcaccgtcccattttgctggacaccagagaggaagacagatgcaaaagcaattcttttagatatgatatgggctggttccaacaatagggttttagggatcagctgaaggggtgctggcctatgagacttcagaaaggggttttagattactggcatctcctgatgccttgcatgaggagatggttaagagggtggggtgccaacatgttgagtgatacaaaaaagagaagaaaaaagattgagcagagactgattgaaattgattcaaaggctgatgaaagggatctatttgaacaggaatggatagaaaggtatgatctggaaaaaagaagtagagaagatttatttctaggaggagatttagtggcagttaagatgggggagagaaatggatcttacaggggatgctaacacactgttctttcatggggtggctaatgggagaaaaaaaggaagaaacatttttttttcacttcagaatggggaagatataatttctgagttctctcaaattcagaaacatatatgactattataagaatctgtttggaagggaaggatgcaggaatgtgcatttgagtgaacatgtatgggagacgggactgaaactttcggaggaggagaaaacaaacatgataagacctttcacaatgcaggaggttgatgaagtgattaagggaactaggggcgaacgcgcgcgttgcgcgcagcacttgtttggcagtgctggacagaactgaatgtgcagccactatgttgtatagtatgttgctagcgaaaggatgatggcctacctgcgactgcgcagacaattaggagagaggtgcatgggctttatgggcctgcgagtatggacatagaggctgtatatgggctttttaggtttctgttttgggatgccctatttctgccttttttgtacggctgatattcattcgttccattgttctcatcggaagttccgctgcctttgctccgctgtttggtggtgactggtgcgtgcaccgatgcgtgtagatccgaaggatttttgttgctggagcgtgatctagggcagttgaaggtggaggttaggctgcgattttggggaacgtacagggaggagtggaatctggggtgtcgcatcaccgcgtcaaggtttgtaaggtttttcactgccagtgaatgggatgataggatcgtttggtgttttcatgtagtttatttgcaacataatgtctcggtatgtagtatggctgatgtgtgtgttttttttaatttatttcatcgactgtagagagcaacttggattcacatagctctagcgctatggtactgactgtagcaacactagtgcgatgcgagtattagaaaaatgtaaatgcatttaaccaatcctatatccttttgtttaagtcacaagatggtgcgaagttgtttggtactaaggaggggtcagttccatacacaaaagattgccttcttagatgtagcaatgttgagtgataagtttgcactcaatagcagaggaaagattgaaggcatatggttttaaaatgtaatccggaactgtggctgggttataaatggctagatagatgttggtattttataagaagtgtttgttgatatgattggctatgtcttgtatgggctattgaattttatttatctatgatatcattgccggtagaatggagaatgcttcagttgttaatgctgatgtggagtggcgcgatgagtacggcatagacactgaagattggatgtccctgagcatgcgagccacccaacgaaaatggagagtctggtgtcatcgttctgcgatgcacaaacctataggtttgatgcagagaaaaaaaagaatattgcatttgtgggtttgcacgcagcatagaatcaatcccaagatataaatatcttaagctgaagtatgaaactgctgatggggttcgaatcaaattgttcatgctggagctagaagcatgtttatatgctgaaccacagatgggccttggcaacgaaggttagactaccatcaaactgtgaagctaatgcatatctaaatcaattgttaatagatctgtttatgcttttagaagtaatctgttgaaattataggtgaagaccatgagctatacgaagatccggatgttgtaagagaagcctttgaaaggcaagctagactgcaacatattgcaagtattattgatttgttcatttgccagctgatttacatctgaaatttcgaaatgtgaatcta

SEQ ID NO: 60959 - DNA, 1967 bp, Oryza sativa
acgacattttcctgatgtcccatagtttaatagtttgatccttgcaatttgaaataaaataatgcccatctccacggctatcaataaatgtaatcccatctaaatgacctgtcaaaacaccaacttgttttcctctcttgttgcagcgcctatcccagacctgaagattggataacagtgtcagtcaaagaaagcctccatgggtgacttatcagaacttcgatatgataggaagcccttcacagatttcacatctcctaggcaagcaaaaagactgatcatgcattaataccaaacagactggtgttagagtttgcactactgaacaatagttcctctagcggctacacaaatcggtcctctagaggctgaactcattgctcatgtttcatattggttagtgacttagtgacttagtgtagacagtgtatttacaccaaatattcaagcactgctggacttctggcacgatcagccagataaacctgcaatgttgctgtctgacttaaaccagcaaatgcaaatagaatcatctttaaagaaagagtaaatgaaattgggaaatattagtctcaccttacagaggctatcatcacttccagagtataaaacatcactaccttcatcagcaaaggtgactgcattgacatcagcctttaaagaccaaaagttgagaaaataagatttagtaagaaacataactttttttttctaatacaatggctaccacaaaagagaaatgaaaaatatattatcaagaaaggttccaaacctaagttaatccaacaatataaaatgtagcacatacgttacattgtcttgttacagatagtcccatctactgtttgagatctcactatcaaggtggtttctggacaagggcaagttttcaagttcactcaacatccctgaaatgtttgatttcatatttctagttgtttatgtcagtatatgtttcgaacatactgggctgagtccactactactttcaggaaactggcaggaattgatgcagtgcctaactctactgcttcaataactccacatttatgacatgtgacaaaaataaattttagcaagacatctgctcctagctgatgatatttttgcctgctgaagcatgttcattaacttgtctattatacccagaatgagaatttttagtacaccagatgatttgataaacatgcaaattttgattcttttgtgcaaatttccagttttgttggatcaaagcttcctaaatatatcatcattcttcagaataaaatggcagaaacctttgtcagtgaccttgacctacaatcccttttgtcttaaattcctcccatatgtatatactgtgttagtgtgacgcatcaagctacactaagaacctaatcttatcaagttatctaagaaagaaacaaatggtgttattctaattacattgtaaataccacttgttcaaaatggtaatgatgcacggaagaaaagataatgtgcagatatcaattggtgggacagaaaacagtcatacattgacaataaaagcatgtagctcagtcatgcatctgtttcataccgaatgagcgtgaatgcgttctgttactttgtttgatccaatatcgtaaatacatattgattcattgttgtttccaacaacaagttctcggccatcttttgaaaacttaacagaaaatatggcaaaggagaacccatcatcatcattcgaaaactccaagccttcgtgaacttgctgcattataaataaaaacagaatatgtaaaaacgtacataaggacaattatttccaaaaagaaaacagtagaaatagaagtcacaaccatcaataaatatgctaacaactagtacatactattttgacaaggaaaaagtctacttaacgccctcgaatattatggtcagcctacttaatctcctaagtatgaaaccaggcgttcttcctcctatggtggttttcaggg

SEQ ID NO: 60960 - DNA, 9472 bp, Oryza sativa
tttgaaggggtagaatagagtaatttttgtgacaacctgaatgggctggcaggtctgtataatagtgttgatttatttttcatgtttgcacactaaccataatgcgccccaactccaaaggttatagtttttaattatgtataaatgtttcttatcaaataaaaacgcctctagaatttttaaatataagtaaaaccatggtatgttttttcaagtgcctctggagtcagcacatgctgcaacacaatacaaatagactccaaatttcctatttttgttatcatcagaggatataccgtaatattggcatgtgattctctcatgccattctggatatctaccatatgaacgataggtgacagactggaataagcctgcaaaaagaacgagtaacacttagttaatgatataaaacaaatatacaaaaagacctgaactagtctcaagtgtaacttcatgaatagaacttagggagacatctaaaggtagcttgttaggaattataggaagaactcttgtaaatacttctaagctagtgaaagaaaataaagaagtgcaaagttgaaaaattacatgtagaaattagtctatctaatcttactcagttctcaaagaacacatgtatcataagttctgtagggacaggctactagaaaaggtccagaagatacaaacataagcaacaattatttgatgagatatatgaagtgcaataacagtttgttgtataatcatagtggactgtaataattaaagctatggtccatatagtacagtcttagtacccaggggaactgacaatccatatggtccatgatttgttttggaatttataaatctatcatgatatatccctaaagaggctgtcagttccctggtcaatttttcatggtctatatttctatttaccacattttttttagaaaaaaggggaatcaaatgttgagttactcagagtccaccttgcttatagggtacataacatggacagcaatggagccaaaatgcttataaaaatatgcagattgcatggattttgaaggtggtaatctgcaaattttagtatatctaggaatcaaatatgttattctaactcagagaacactcatattttcttcatgcacaataggttcaaacttgcattacccaaacaaagggctcaaatccatgtatgaaggggaaaaaagaaacacactatggaactaaaaatagtcagactgtaataaatattattcaagcacattgatgcgaatttttatttacaaaaaatggaatcatatatgttatcctgaaaagagtgagttcactagatgtcaatgagtaaacagcacacaaaagaaaagaaagaatgagaacaatgcataagagtcttactaggtatcgttgatcaggtgaaagagcaatatctgaaactgtccaacgtagctttttgcaggttatgtccttatgtatcgtccactttttctcagcattgtagattctgatatggctaccctgattaattgttggcataaaggattgtcagtcacccatatcacaacattttgtgcagccaaggtatctaaacaaaagctaaactcatgtggtaatggttataattttccctataatagcacaacgacatacccggaacccaccaatgagaagggaaccatctgcggagaattgagatatgtaggcttcactgtccatgtcatcaacacaccatgggccttttactggtaggtgtttacgaagagcataagagcaatcagctgaagagaacctaccaatccctaagcagttggattctctccctgacaacaacttgaatgttgagatatgcctcttttttccagcatgaagggatgcacgagtcctctcacatggctcggatttaagcctcgtaagatgggaaacctcctcatctatcgcagacaattcattaccatgtgaaggacaggattgttgttgatgacatgatcctccatgatgtgtcttccttttccagcccatgtttggatactgaaattatgagcatgatgaagtttgtcacttctgacaataatcaaacaactttcctatgctaaatattcactgaatacctaacacctccaaagaatgatcaattgatatactagtacagcagtctgcatgacagaaagacagctactgtgcttaacttcaaaagtaactccaagaaaattatagttataaaaggttgtaatcgtttattatattatatttctaggatattaatgatactcttccgctgcatctttcattacagaataaaaacgggacatgcatgcttgtagaggtaaatcagttttttattattaatttaataatacaaaaaaggaaatggctgagtagctcagcaacaccaatatgaccacgaaaatagtattcaaaatgagcatcactacaaaacaatactagaaaaacagttcagtttggaaatgacacaactcaaaatgaacagaataaagccttcgtccatctcaattaaagaagccatgttctcgatgggaggggcaagagtcaaaatcaaacttggccttagtgaaaatgaaacaatgaacaaatacctaagggtattctggtcgtttttaaaaacctcttcttttttttctttttttttttggcaatgcacaatcgctgatgggtggtgatgagctaatttcccccaaaaaaggatatctgacatacactttgtacagatgattacaactaaatctgttcaaataggaactgaaaggaggagggaaaaaaacaaatataaatttcgcattcacctcgaaaagaacaagactttaacgtggacacaagcttgcaatccagctatccaggcaactccaagcagggcagtaaagctgatagccggaggcttggactcttctacagccagtcattccctacacgatttaaaaaataatttaataacctgaagggaaggaaacggacaaatatgcgtgtgcagcgtatccctatcgcctttatgatctctaccatggcgttagattcttaagcggacgattggtccatagcaaagttggtagtaactgcaaacgaagtaccgacgattccagcataaaatcctaagacgtactactaaggaactccgaactcgctataatctgtgccggctcatgaagcgacccggatgaggagggagggaaaggagaggctaacctgtaccttcaattcgactcaacccgagacggaggacgaccgccgcgcccctcaaaacctgctcgccggcggcgcgagcgaggatgccgaaaaggggggagaaggctagggcaagaggccgtacacgccgtgcctacggggcccgggaattaggggcagagggcgccgaggtctcgccgcacgcgcggggcggtggaattggggaggaggcgaagctgccgaggaagaggaaggagcaggagacggggggaggcgatagctgggagaggcgggagccggtttaaaataccccaacatggaaggggaccgcgcgtgaaaaacaccaccctccctgccacatgtcgccgacgcgtgggcccagtagaccggctttggaggttggtgggctgcgaatgaccggtgaggcggggcgggtcggggatgtccaggtcctgcacacgtggcgggtcgcgagtgggtggcgggcgggtgatgcgtgtggtggtgcggcgcgctggattagagccggggtcgcttgcagccgttgctgccaatggagtttgtgtcgcacgccgtgatgtaatatcggatccgatgacgtcagcaccacgcgaagcatcgctacttgtaatccttcgatcgatggtgtcctagtcatcgtggattatccaggatgttggcgggtaagtgcaagtgctctacgctggagaagggatttttgtcggaccatgcgaaaatcacattagccctggttcaaataggggtcataactaaagatcagctttagcccagtttaaaagcccaatggcactttctgattttaatttaggttggtgagaactaaagatcatttttagttccagtttaatagctgtctggccgtgtcaggccctcaacgagtaaaagatcacacgtctcacggcccccaacaagtaaagatcacacgtctcacacatccttatccactctcgcctctctctgtgtctctctagctctcttgagaagcggaagcggcagccgggcgggagaagcagcggcggcggccgagcgacggaagtggtggcggaggcaccctccccctcagccagatccaccgggaggagaggccacgggatgggagcccaggtggcggtggagcgacggtagatcgacggcgtcggcacagccgtgcggcggcgtgacgggcagccgtgcggcagatggaggaagaagttcattcttctttttttgagattttgtgatatatttgatctgtgagactgtgatctgtgatgtatttcttcttgagaatttatgatgtattttgtcgacgtttgatgttgcggttctggtatttgcatggtgtggggatcgtcggtgctagggtatacgcgagactgaggtaaaagagacggagacggggatttttatacaggtttaggcccctgaacggtcaggtaataaccctacatcctgttggccgaagccagtattgctcttattcatgataatcacaccagtacaatacttggggtagcctatctaactgttgtcgacatggcggtctgacgatctgactcgtagtcgacaacagggtagccttccacctcgaatccgtgcccggcgagatcagagatagcgctttcatctctcctgacagtatccggagacaccgtagggtactagccgtgtttatccctgaagttgatatccgacggcgtgtcttggcgtatgtaggcttctatgttgtggcttctatgtcgattgtgttgggtgttgattgaagtggtcgtgtgttgattgtcccccctctcctcctaggggagcttgtatttatacacataggtgtcctcttgtccaagtagaacttgggaaaccaatatggatacaattcgagtagtccttgtcgtttccatgtagaactctggttgtctttccttatccggaactcctcctatatccacaggttgtttccgtataggacatggtatgtggtggatcctaccgagatttagtcaactactattagatatgtggtacccataaccctgacagtagcccctgacttcgatgcaaatgaacgaattcatattctcaaccgcgcgcagacattggagtaactgttatcgaactcatgtgaccgttctcggtgagtttaaagataacgttagacttcctttgttagcctcgtgcgggcacctaaagggtttgtctgagtcaatctctgatgtcaaccaagaaagtacagagcatacgactaagtctctcgtcttgctgtaatcgagaatttggattgaagtcaagaaattttatctcggcgggtacaccatttcttcattccgtattccttgtcgatatccaccaaccgttctcgagcgatcgagaaggcgcagagtctgcgacggagccttgtcaatatttgtcgtacccgccttagtcgatcttggtgtagaaccatagagacatggagtctttgataatgtcaaatagaattttcctaaaatcaatactcataaaagaatattagatagaaatagtccccgagcgaacgctcgaagggtgacatgttataatatgtctggaaaaattgaagatgaattaaatttataaaccagtgttttgtatatgagcgtcttctcttttaccgactccgatcagtcagtttgtagagttatacactctccctagcccccagccttgtcatcggagaattgttctcggaagataaggctcttggacctttgacctgcctcagttgaacaagcactgatcctaacccccagccgtgaagttggaaaatccaatttccgattacacggcttgattaacacgcacggcgagaactcttacatgaccagatcttacatggtctttcgtctctgaaggatccgacaaagccttatccgctttgggcgtccacagccgaagttcccttaagttcctcagaggctttgtcaagacagcgtgggacgttaggataggtttcaacgctaggtgtcttttatggtaagggatctctgggtaaaacactaggcgatactgtgcacctgatatcaactttgttggagtagaggtaatgggagaatcgctacaccactggtcgagaaccaggtagtagtcgtaactcgaccacttaaagtggagatagtgggagaatcgctacaccgctggtcgaggaccaggtagtagtcgtaactcgaccacttgaagtggaaatagtgggagaatcgctacaccgctggtcgaggaccaggtaatagtcgtaactcgaccacttgaagtggaaatagtgggagaatcgctacaccgctggtcgagaaccaggtgtagtctaaactcgaccactagaagtaaaggtagtgggagaatcgctacaccgctggtcgagaaccagatgtagtctaaactcgaccactagaagaggaaatagtgggagaatcgctacaccgctggtcgagaaccaggtagtagtcgtaactcgaccacttaaagtgaagatagtgggagaatcgcaacaccgctggtcgagaactaggtagtagtcgtaactcgaccacttaaagtgaagatagtgggagaatcgctacaccgctggttgagaaccaggtgtagtctaaactcgaccactagaagtaaaggtagtgggagaatcgctacacctctgatcggggaccaggtagtagtcgtaactcaaccactagaagcaaatgtacgagagttcgctatgattgactggttgagaaccagtgagtaggtgtctctcgatcatttgaagtcgtggtgcgaggaccgctgcgttattgttgtagtcgtaccttgaccatccgaagttaaggtgcgagagattgctacgttttactagttcgagaaccagcgagcgagtagaattatctctcgaacaccaatggatgttgcggtgcgagagattgctacgtgctggttggagaaccagcgagcgagtagagttatctctcggacaccgatggaagttggcggtgcgagagattgctacgtacttgttcgagaaccagcgagcgtgtagaattatctcttgaacaccgatggaagttggtggtgcgagagattgctacgtgctggttggagaaccagcgagcgagtagagttatctctcggacaccaatggaagtttgcggtgcgagagattgctacgtgctggttcgagaaccagcgagcgtgtagaattatctctcgaacaccgatggaagttggcggtacgagagattgctacgtgctggttcgagaaccagcgagcaagtagagttatctctcggacaccaatggaagtttgcggtgcaagagattgctacgtgctggttcgagaaccagcgagcgtgtagaattatctctcgaacaccgatgaaagttggcggtgcgagagattgctacgtactggttcgagaaccagcgagcgtgtagaattatctctcgaacaccgatggaagttggcggtgcgagagattgctacgtgctggttggagaaccagcgagcgagtagagttatctctcggacaccaatggaagtttgcggtgcgagagattgctacgtgctggttcgagaaccagcgagtgtgtagaattatctctcgaacaccaacggaggtgctaaagttggtttattacatgtgcgtctcatgtggccagcatgactcacacacccaacttgtagcatatctgaatgttcgttcgcaatcatgtcgggtgatcaagccgacgacgttcgcgaggtattatccgttaacaaccttttctcgagtagtccagcgatggccggcgctatgagataggtcgtcggtcttctttggtaggttgggcatgacgactctgcatttgtcgagatcgttctcgataatgcggtgtacttgaccacgacctactcgagtgctcaattgttcctgaaaaatattttctagaaggcaagatatatagcagataatatcgagtatgtactcaaaaaactacatagatcttctggtattatcaggatataacaagcagatgtaaatatcatgcattatgtaaactgtaagcaagcatgatttatatagaagagaacagagcgagcccccagcgttagaccgtagtcgatttaacatcggggacattcgcgcaatagatattgtataaaagacatgctctaggaaaacataataaatcatggatctgacaatgttgtatgatctgaataggtacgataagttgcatatgaaatattgcgtacttttgtagatacatgccggatgtatccacgaaattagtagatcaatttaaaaaaccaatctaccaattaccttgctgcgtactcgttcgatatcatgtgatctgacatcttttggtacaccgcggagcttgaggcttggatgatctcgatagaccaagttgtcgatgacgatgatggttccgatctagtcgcaagatgtacttggacaggttggatctccccaaagccgaagtcgtcgagtagcttgttgatggagaatccatctctcaaacccatctcgtcgaaaccttgaagcaccaaaatccccctacctggcgcgccactgtcgacgtttgatgtcacggttctagtatttgcatggtatgaggatcgtcggtgctagggtatacgcgagactgaggtaaaagagatggagacagggatttttatacaggttcgggcccctgaacggtcaggtaataaccctacatcctgttggccgaagccggtattgctcttattcatgataatcacaccaatacaatatttggggtagcctatctaactgttgtcgacatggcggtctgacgatctgactcgtagtcgacaacagggtagccttccacctcgaatccgtgcccggcgagatcagagatagcgctttcgtctctcctgacagtatccggagacaccgtagggtactagccgtgcttatccctgaagtcgatatccgacggcgtgtcttggcgtatgtaggcttctatgttgtggcttctatgtcgattgtattgggtgttgattgaggtggtcgtgtgttgattgtcccccctctcctcttaggggggcttgtatttatacccataggtgtccccctgtccaagtagaactagggaaaccaatatggatacaatccgagtagtccttgtcgtttccatgtagaactctggttgtctttccttatccggaactcctcctatatccacaggttgtttccgtataggacatggtatgtggtggatcctaccgagatttagtcaactactattaggtatgtggtatccataaccctgtcatatttgatctatgatgtgaatctgtgaatttttttatgtatttgatatg

SEQ ID NO: 60961 - DNA, 30787 bp, Oryza sativa
tatgttattatgtaaatctgtgaatttgtgatgttatctgtgatatgtggtgttatatgtgacttggggatgtagggagcaactcaatttgaggaaatcaatatgcaagcagtaaaaaccaatgaaaaaaaagaaaaaaaaacctttagtctcggttgataacaccaactgggactaaagatggtagcgcaaaacacgtggtgctgccatctttagttccggattgggcgtcccggtttgtaacccgggactaaaggaggggttgtaaaccgggactaaagaccacttccctagcagtgattataatgcttgatgtggtgcctctaaaattgccacatataattggatgatgaggtgtaagaaataagtgatgaaagagaagacgacccatcccttatgcaaggggcaacctctaacaaacccaaagaaaaaaagatgaaagaaagaagggattggacacacgaataaaataaaaccatttggattagtatgctagaagtagtatagatgtggtgtattgtatatatcacctcatatcctacatggataaaattattggcaactacccctactataaaacttgccattaggcacccatgtagattttcgatctactaaaacatatgctaatcctgtagatcaccctaatgtggaattagggtttaactgactgttgtttgaagccattgcattgttctagcttgaaccggagtaaatgtaaaggatgcagaaccacctcgcgtattgtcggtgcaggagaagtagtaatagcagtgaggacgccgacttcatcctacagaggtcgccgacgatcacttgcggatagcggtggccttccggtcgtcacctactctatctcgagcatgctgctagaagtgaacaatattcgctgggaaaatagtactccaaaaatgcttacacttctaaataaattgttaaacgctagaaataaatcatacttatggacagagcgtggggggctgaagatagtgagaaacagaggcgaaactttgaatctactatagctgccgctgacgaaacagaggtgaaactttgaatctactatagctgccgctgacgcggacgcaagctgtacgtacaatgctcctcacctaaaaatgaaaacagaacggatgtagacggataatgtttatatcatattcgtttttataattttttttgccgaatatgaaaacgaatacgaacaactcagatgcagaaataaatacaatttatttaaatatgaataaggaacaaatataattggacacaaatacggaaaccattttttcagaacacggaaacaaatatcatcatatataattatatataattagcttgttttatataaaaatataaaatattttatataaaatatttaaattttaaataatattaatgttgtggactagtgtcaaaatctataaagtaggtcgaattagaattatgaaaaatagggtatgtttcagcagatatccgtacccgaaaaatgaactgaaaacgcgacaacgacctcagaggtgccgacctgccgggcgcgtgcaagtgccaaacgtgtgtgtggccacgagcgtgacgaacgcgatgacggttgagctcgccggtccgtggcgggcctcccgcgctgactgcacatgcttttctgccgcccttttgggtcccgcgcgttaagatccgcttcccctgcacgcctgcgcgcgtggcctgaaaatctataaaccgaccggccgaattcgatcggtctcactcacgcgactcggtctctgcagccggtgcagcccaaagtcttgcggactttttgtttcggtctcttctgctgatttttgcctgaacttctagaacggtggattaattaattaattagctcatctaaggccattttcaacccaataactagaatggtgtctatagcattaaataagctgccagttagaatgaaaaatgatgtgtcaagtgaataaatgagaaaatagaaggaaaccatatcttgcatgagacatagtttctacacaatatttaaaacatcatgtgatataagtagcattaaatttaagtatggaataatgctgtttgtattaaaagagtagtgtatagtactagtttcttgatatagagtttatgaaaactatgtctagtgtcttagatagggaatgggctaaagaagacgagtgtttagttaaccttcccctggtgtctggtgcagatctcccctatgccactgatcaacgtcgtctggcggaccaccaccacgaacactgaggtggtgaaacacggcaccgttcttcgtgctcccatttgtttggtaagcaacgtcggccgcagctacttcgtccgttccggtccggacggacagagcgactgcaacaggaaacgacaatgaacaggcgtggctcggcccatcccaacaaatttggcccacagacgaactggcggccgctgcattctccgatggccgctgcccgctacccgcttgctcagcaggtcaaatgaagggaaacttgcaggctatttcgttgcctgcacgagggctggctcgcacccgccgtgcaggcaccaccttgttttttttttaataatggaatataatatcccagcctttactcaaaagagttacagccaattattacatagtagttttcatgaacatagtgtaaatctaaatgaatagaacacaccgaagatcactattattgaaaccagcctaacgtaaggagatcataattattgaagtctatttgtaaatctccaaccataattggcaaatagttgcataaccgtggtctccaacttttggtatgcaaccttcagaaactcttcatcttcatcacacctttgtagttgtgcctaaaaccggagccaatgagttgccctgaaaataacctgcatataggaaaatgatggtgatttgtcaaaaaccatatcgttcctactcagccatattgcccaacaaatggcagaagctccaacaagtatcagtttactcattttcttatcaactcccaaaagccacccattaaaaatatgagatatgctaactagaagattaaaaccaaaagagaactgaactgctctccatagaaatttcgcaaaatgacaatccataaagagatgttgaatagactcattcttcaaaaaaaagaacacctcaagctgccattccagttacaccttgccaaattatccttagttaacacaacccctttaagcaggtaccacatgaaaattttaatcttaagtgtcaacttaagcttccaaatacacttgtttctctcgatatagccattattaattaaagctaggtacatagacctcaccgagaacaagccattctgatggaaattccatctaaaactatcagacaaatcattcaactgaatatgtactataaaggcacacaactgatgccaacaaacaagattctgaccaactaaagctctcctgaaagatacattaagcggaacatatcccataacagtggcaatagaagatgttttcctccgaacaattgcgtacaaagatggatatttatccttaaaagccaagttaccaatccatctatcttcccaaaatctgatttgttccccattattgacaatccaagaacccatatttaagaaagtacttttgacattcataagaccagaccaaaaatgggaatcaccttgtttcctgtcaacttgggttatagatttattataaagatatttcctcttcaataaatcatgccaaaccctatcctcattaattaacttaaacaaccatttacttaaaagatatttattttgtatctccaaattatgaatcgcaagaccccctggtccttgggttgacaaacaacatcccacctagtgagcctgtattttttcttatggtcatccccttgccaaaaaaaccgtgatctataataatcaattttacgaagaacccctttcggcacctcaaaaaaagatatcataaacatggctaaacttgaaagaacataattaatcaacaccagtctaccaccaacagataaatgcttgcctttccaactactaagctttttctcaattctctcttcaatacgtttccaatctttattagaaagcttcctaaaatgcatcggaattccaaggtatttaaaaggaaaggtacctaactaacaaccaaaaatattagaatagtgttcataacattcctttgcctgaccaacgcaaaataattcactcttgtgaaaatttatttttaggccagataacttttcaaataccgataaaatcagtttcaaattctttgcctgttgcaagtcatgctccaaaaagataatagtatcatctgcgtattgcaagatagacacaccatcatcaacaagatgaggaataaccccattcaagagtcccgcctctttagccctcttaatcaatagagtaagcatgtcagctactatattaaaaagaataggggataaaggatccccttgcctaagttggtagcctgtactaccctctcagcctgtttcaccttgtgcaatttttttttaacgactcacacgagacgatgcgaagttttattgatagagaagggaaaaattataagattacaaccctgaagggtcgtaaccaggaaaaagaaaaaaaatataccaccacccacacaccgacatctccaacacacaagcccaggagaaggctagcaccggaccggccgtcactaagcgtgaccaatcgccactagaccaacaaagggacacatacgagatttaggagatgccaaaacgacgtcttcaagaagagaagcgacggaaatccgccgctgccgtccgttgggactcaaaggagacaagaccgggctttcgcccggtaatcacccttgaggggtgagacagcacgacaacgccctcaggagggggaacatcgttgtcggtccggccaaggccggactgggttttcacccgctgctcaccacctgcgaatccacggctgacgcaccgaggctccaccaccacacaagctctgccgacatgtgggacccctgcaccagcgtcccccgccggtcagccttcgtgcgccgaagaccgcgccacacccaccggcaactccttctcacatctaggttgtctcctccactgccggccgcgcctctcgcgccaatccggccttcctccatcggccgcgcctctcgcgccaagccggcctccatctccgccgcccacgtctctcgcgccgagccggcctccgttgccatcggctgcgcttctctgcgccaagcctgtctccgacccctccaccaaacgatgccacgacggtcagatggagccgtctcccacgccctcgggtagccgtccgaggccgtcatgcctctggtgaccgcagtcacggtcaccaccaccacagctgctgctgccgaacgcccagccacctcgccgttgccatcctcacctcgcacccgactccttccccgccgccgatgtcgccaccgcctccacagtcacgaccaccgtcgccgctgccactgacgctagccatcgcctccgcagaccgccgccttgtgaaaattgcatcaccatagtcaggatgagagaaacgcgagaatcgagctttgctcacgagcctggcccgctcgatgcaacgcgtttgcatccgcgcaagcagtgctgcacccgcggctacagctcgttggttggggtaaccagggccgtacctacgaattcgaggccccggtgtgaaacacaatttaacgctaatataagtaggaaagacacaaaaataaattagcagtggagctctatctcagtgagaagaaaattttaaataaatgttagaaaaatattatgttatgatgtagtaatttatttttattatatggaaaaatggaatctttaatgcttagaacgcatgttcatatcatcgtcatgagctatagctctttgagttagccatgattgccatcgaacacttatcggagctaaaaaaaataagcctgttctagccaatgaacaaatgagtaaaagtgaaactttataaaaatggaacaagaggccttcaaatatattggaacgcattggcgtagattaaagaataaaaaaattagggcccctaaattttggggtgttcggtcgctcattttgcacaccctcatcgacggccttgggggtaaccactccaccccaagaaccctctctcatttgtcctcctcgttgctactgctatcctccgcctcttctcctcctcgggctcgggtggctagaggtatcagtgaggctcgtcctcttctcctccttgcgctcggccaagtagacgcggcaacaagcgaccaagcggcgtggagctcgctgccggatagatctggcaggaggagcacccagaggacagcggctgcaattgcatatgtgaaaatcacacggcccgacggtctttaccactgccgccacctttgttgtagtccgagtcattgccaagatcctctctcccttcatcagcagctggatctggccaccaatgacagtgtcacagcctgaattttcgtttcggatttataaattattaatagaatttatattaaatgttcattaaaatacaagtgaagttaaatgtgggaaataaaatttcctaaatataaagcatggctggatttaatttttattaaattctccatgattaattatactatctggatttttttcagattttttagagcttaaatcctaattgtaataatacaaagaagagttcagcaattatttaaatattaaattaatcattaaatgagctggtttcatttttttaagtactttgagtgcccaatattttcaggatttttcttgaaattatttgagcatcggaagtatttttaacaattcaaagatcatttcagtgattaactagctggttggcccgcgcaattgcaaggctagcacccaaacaaaatcatatattcttttagtatgattttacttaaaatttattaaatagctatctcattgtcttaagactttgaatgaccaaatcttatcatcctcgtgtttctagttatatagtttttaaaagtcacaccagttgctaccccttatgtcatcttcttctttatttgcttactcgatctatcactatttctattcattcttcttggaacctttaaaaattggattttatagtttttagagtttattgtcatgctgggtttcgtttttgtaatttctagatgtcccgttgaacattgccattatactcctctacggtctgttcactgtctcttctttttattgtcattgagattttaaaaatcaaagattattatcatttgggttcatttttactttctaaaagtcccgccaaattgtcagcagctttgccattgtactcctctacggctcgcccactgcctcccttctttattgtcattaagattttaaaattgaacgtgattatcattgtttttttcttttactttttaaaagttctaaacctttaaaaattggacttgtagttttattttttataatttttagaagtcccatcaaacgatgccactatgtccctctacagctcgtctcatgcctaccttttattgtcattgtgattctaaaaattgagcataactatcgttgtaattcattttttattttctagaagtcccatcaaccgtcggtggctctgcaactatactcttatacaccccgcccgctgcttctcctttttattatcactgagattttaaaaatcgaatatgattataaatggtttttttaattttctagaagtcccagcaaccgtcttacttatttgctttacggcatgcctgacgtccctccttttaatcgtcattaggattctatttagtgttttattaacaatttttatatatcgtatcaaccgccaccactttactcctttataggcctgttacttaattttatctcatcatgtgttttatatggtattttctttcaatagtctttatttttatcacaaagtttagttatttataaattgtattcctaattgaaatcttatttttcttttttctaatttcagaatttatttttttaaaaaagttaataccctattgtgttcttttaatgtttttgttttttattttcaatttcagttgtttcaaaattatattcctacttgaactctcttttattttttcaaattttggatattattttattttttattcaaaattttaattaatctcgtattgggttcttatatggattcttatttcaatattgcttatttttaattccgaatttcagctaattttaaattgtattcctacttgcactcttcttttattttcttgttctaatttcggatttttttattctgaattttaattaatctcgtatttggttcttatatgtactcttcttttaatattccttatttttaattccgcatttcagctatttttaaattgtatttctacttagactctcctttccttttctaattttggattttattttatttttattttgaattttgattaatctcgtattgggtttttatatagaaatttctttcaatattgcttatttttaattccgaatttcagttatttttaaattgtatttctacttggactctcctttccttttcaagttttggattttattttatttttatttcgaattatgattaatctcgtattgggttcttatatggaaacttcttttaatattgcttatttttaattccgaatttccgatatttttaaatcatatttttacttggactctctttttcttttttttttctttttctctgattaatgtggtaatttctagccccacagtgaacgcggtgccttctttcaaaactgttttaataatataattttaaaaaagttaataccctattgtgtttttttaatgtttttattttttattttcaatttcagttgtttcaaaattatattcctacttaaactctcttttaatttttcaaaattttgatattatattattttttattcaaaattttaattaatctcgtattggattattatatggattcttctttcaatattgcttatttttaattccgaatttcagctaattttaaattgtattcctacttgaactcttcttttattttcttgttctaatttcggattttttttattctgaattttaattaatctcatatttggttcttatatgtactcttcttttaatattccttatttttaattctgcatttcagctatttttaaattgtatttctacttagactctcctttccttttctaattttggattttattttatttttattttgaattttgattaatctcgtattgggtttttatatagaaacttctttcaatattgcctatttttaattccgaatttcagttatttttaaatcgtatttctacttggactctcctttccttttctagttttggattttattttatttttattttgaattatgattaatctcgtattgggttcttatatggaaacttcttttaatattgcttatttttaattccgaatttccgatatttttaaatcgtatttttacttggactctccttttctttttttttctttttctccgattaatgtgggattttctagcccccacagtgaacgtggtgtcttatttcaaagctgttttaataatagatagatagatagatagatttaaaagaaaaagaagttcttttcctcttcctagtattgggccgaatttggcccattcccttttctttcctcctcagcctacagcccgtgctgctccctcagccgaagtctgtttttgctccctcgcttcagtgcatcttcaacctccagccgcctctgtcccgtgcgcatgcactggcgcctcctccttccaaatccggcctccccgttactcctcattccaaattagttgcgggaatggaatcctctcaatctcctctacaaaatccccaagaaatccccaaaagtttttatggaaatcctttccgatttcgcggttcaacctttccttttcccggcgaggatcctaaactttcccaagtttttcccgtcgatgtgggctcgatcctgggctcccatggctatatatagagccccctccagctcctctttcggccgccacctctccctctctccgccgtcgccggaaaccttctccccgcgagcgccttctctctccgtcgccggtagccgctccagccgccgtgcgctgccgcctcggtcgtcgccgctctgcgccgccacctctcttggctccgcaaatcccagccgctggttattttgtgccaaatcccaccggaggtagcccgtcgtcgtgaaccggagcgccgccgtcgtcgctgtgcctccagccgcacgttcgtcgtcatccgtcgtcgccttcggtcgccgtcgactccattgggttcgcaggaacaaggtgaagcccggccactggtttttcttcatcgaggaacgctgaaacgccgccgccatcgctgacccgaccccgtcaccgcctctacctcgctgccggccgtctgcggtcgtcatccatcgtcacgccacccctcagtgagctttcctctctcccacgtcgttcaccggtgtagtttatcactagggtcttaatcccatctaatctaatcttgtttggccctagcgtcgtcatcgtctccgtgtgttgtcgtcggaccgttgtcgtggcctcttcttctcccgtcgccaccgtttcctggtgaggccttctctccgattcctagggtagatgtttgtgtaagccacatgtgtgtcgttgtcgctgtgccgttatcctaaccctagccgcgtgcctccgccgagccgccgccgcctagctgagcaaagtcgctttactgtcgctgtgtcgcagctgtgtgccgctttaacctagctaccgctttagcccgttgctcggtagtcgagttgtctagccgtaggtgcaaccctaggtttcaaccggcctatcatttgccgtatcggggctttaccgtgaatcgtgtctagcccaccggttttgtcgcagccgttgttgagtcgttcgttcgttcgttcgaacaaggtgttccccatgttcgttcgttcatccgtgttgagtggtcctttagttcagagccgccggttctgtttgccggtttcggttgatcatttgggtgatcctgtgtcacgtaaaattgactcgttgagtttgtatgtcgtgaggctcgctttccagatcaatccaagtcatccgatcttggtcgactcggtcaagattaatctcagccgtccaaaatcgatataaatccgttctctcttttcagtggcatattatttctgtttaatatatgtcatctaccaaatataatctaatctatttctagaggatgtttccaatcttttatcttagttataaattatttgtaaatcgtttaattaatttggaatagtgttttctttaatagatttaattggaattaaatattgtaaaattcataattaattcatatgaaaccggaatgaggccgttcaagtctcataattcatcttaaattatgatctacttgtttatttactttatatgtactgtttatttgttttttattagtctttttccttgttttgcgtgttaacttgtcgtttccgtcgtttcgaaggatcgtgagtgcgtcggaagttttcaagaagacttattgaagacccattgttgcaagtcacacagatcccaaacacaaatcctttgaacatgttgattctctatttattttaaatgtgtatttattttcgaatgtcaccgggtggtgtgaacttattcctttgttatggccaatttgcattgattactctttctttttttttcggggaatgattaccgtatttcttgattaccttgggttataatttgactagttggatttatatattggttcaactgttttagatataattgcttagccatgcttagaaacattagcacacgattgggataactaatgattcactattacttaatgatggatatttaatggtagctcacgatggttaatcgtgattgattaattaattaatttgccaactaattaaaacttgataatggtgggttgtgagcacatggttttgatggtcgtgctcatgacaattaaggacaggttcacgagtttcggttgtgaaacattaaccgtgccaaccacaagctagcatgggcaacggctttattttttgtatagcatggttcattgcggggcaccagactgagaagtggtggagataagcccacggggatcgttggggagtccatgccttgttttataagggggtgattatgatccaggaacgacgcattgctttgagttgtgttgtgcgaagggtactgtcacgatttccccctttgcagtgccatggtggtacttcggagcatggtaacatgtgtggaatcatgtcttgtgggtacagtggtacacatctggccagagtaaaactattcgaatagccgtgcccgcggttatgggcaggtctaacaatgtctttcgtgattagtctcacacttctcaccataataaatgatgctataactggtaataatttgattagctcctggtttggaatggtacattcctggtttggagatagatctgtacagccgggtatggttgttcaggtttggttgggcctgtgcagcatgggtgtgctgttcagtgttgattaatattgatgattaattactttactggtttacaattctcaaatgtttgctaaatgctgcttttgcaaatgagccctatattatgccattctttggtattcttgtgtacttgcatacttactgtgtggcttgcggagtattccatgtaatcatcttgtaataatcaatcaaacctcagttgaagagaagtcccaaggagaagacgtttggcttataccccagttgagctgcctgtgggagtggagccggagtttcgctagatcgtttatccgttgctgttttctcttttcttttgtaagtatgtaacgttactattatgatgaatctgtatattaaattgtcagtttgtgtacctcggctgatttctggacgaggattttatgcataaataagttaaaaattactagtgaatttctaggtgtgacaaacagcaagcagcagagcagtggagggatggatggagcagtgaagcaacggaggggatggagcggcatggctggggcctggggatggggatagaggggatgtggaagaagatggcagcacggtagacgggaaggtcgccgaccggcgtcaatggcgatggggatcgatgatgacatccacgaaaatatttctttttctttttcttttttgtcctaacctgttagcatgtacgtgtataaaggtgattaatgaaagagtaatcatgtgattaatttagccagtttttccccacatttagacgtgtaaaacgattttataaaatttagtcaattgaacattttttttttgaaatagatcaaattttcattgacccggctttggaagaaagcccaaacagtatacagagtcttatacaaacacagaaaacaaagctacgaaacaaaagacttaaaaaaaaagtcggcacataacactggttctctcagaagcattccataccttgataacacctcacattcccccaggcactaacccctggtacaaaagacagcaaaaaactgaagccaaaagtagactcaaattgtcacaggaagacgacatggcttcaattgttgcagtttggccatcagcagctcacaccatcctttcatagtagcttgatctccttcctttagcatgatacaccactgctgaataaaagacaaagctttataagtgatttgcaaaggagactttgccaaaatatttgagaaaacccagtcattcctaattagccaaagtgcccagcacacactagcaaagagcatcacccacaccccctggacattttttcttttcattaaccccaaacaatctcttatattcataggactaatggttagacccaaaacatctctcaccacacaccagtaaagacaacaagaagacatttaaacaagatatggttagtagattcaatcttgccacacagtttacagaattcatcccctccctgccattttctcttaatcaactgggatgcacaaggaagcctgcctctgtctgccatataaagaaaatctttgatttttaaaggaattttacttctccaaatcttcatcttttcaacatctcttataccccaaaagtaatcaccctatacatagatctagctgagaagatctttttgttattgtatggccatattaaaatatctttgccctcccctagggcatgtttattcaatagatttcttaaatccttcagatctgcctccctggtagtgtccaaatttctcctaaaattagaacaaagccccaggatttacagaaaataatggagttttaaaattccaagggcgtatatgtgtttcagataaaaaggaaatcaaggataaaatattagaagaagcacatgattctttattttctatccaccctgggagtacaaaaatgtatcaggatttgaagaaaatattttggtggtctaatatgaagaaagaaattgcagaatatgtcaatttatgtgaagtatgtcaaaaggtaaaagcagatcattaaagaccagtaggattaatgcaacctttgcccctgcctgaatgaaaatgggatgaaattggaatggattttattataggtctaccaaagactaaaggaggttatgatgctatatgggttatagttgacagattaactaaggtagcatatttcttgccagttaagcaaacatatgatggaaacaagcttgctgagttgtacctcacaaggattgttatattgcatggagtacaaaaagaattgtctctgatagaggaacccaatttacatcaagattttggaggagttttcatgaagctatgggtacaaagttgggattcagctcagcatatcatccacaaactggggacagactgagagttaatcaaatacttgaagacatgctgagagtatgtgttttggtttatggcctagtttgggaaatttgtttgccattcgcccaattttcttacaataatagttatcagtcaagtcttgggatggcaccatttgaagtcttgggatggcaccatttgaagctttatatggtagaaaatgtaggacaccacttaattggactaaaacaggagaaggacagttgattggtccacaaattgcacatgatgctgaagcacatgttaggattattcgagaaaaactcaaaacaacacagaatcgacaaaagaattacaacaataatcaaagaagagacttaagttttgaagttggagattttgtttatttaaaggttatgccacttaaaggagttcaaagatttcaaatgaaaggaaaattagcacctcgatatattggaccttatagaattgtgcaaagaagaggtgaagtatcatatcagttgcaactaccagcagaattaaccggaattcatcctgtttttcatgtctcacagctcaagaaatgcttaagaaaaccaacagaacaagtacctctggatgacattgctttacagacggacataacatatgaagaagaacctgagaaaatattggaggtcactgaaaggaggttaagaaatagaggaattgaattttgcaaagtacagtggaaaaatcactcagaagatgaggcaacctaggaaagaaagtctgagctggaaaagaaatatccgcacctatttgctaactggtaaatctcgaggacgagattcctttaaggggggtagaactgtaacagccctaaaatttgacaactttttaaaaccaatttagtttgctttgattctctaaaaatatgaccgtcgagttagacatttatttaaaatattattttccatgcttatttttttatgtttcttttctcgtttaattttgtcgcaaagtgcatcttacacttcaaataactcctttgtatccaaatttaattctatcccgaatgtcggactatctaaattccgcatcaattcaaatcctatctattttaatcttcctcatgtttttcttttctctgtttccaccttaattttctttttccctatattttttccctttctctgttttctttctttcgtctcctctactcggctaggccgagccagggcctgtgtcaccccgtgttgtcacgcgccgatcccgcaccatgctcgcgcacgctcacgcccagctcgtgccagcccgcgtatgccacacgctcgcacgcgcgcacacgaggacgaacgacgaacgaatgcccagatgacacctccagcttcccgcctccgtaactccttcgtccctcaactagaaggctcaagaccggaggcaaaagaaccgaaatttcgacctctttcacctcctcaaatccgccccaactcccactgcctcaatcgtcgtcaccggaggaaaaatccccaaaaccctaattttgcgccattgattgagctccaaaattcgtcgcatacgttgcaaatcttctgaaattgaaggtacaaatggattctccatgccgagtactccctttcccctctctttccccttcaaatccatcgccggaacatcgccggcgccgcctcccgacgtcgccgctctgttcggccgtcgccagccgtacggcgtgccgccgctgccggccgccccaggccgagccgccgccaccaccgcgctccccttgctccactgatgctcaccatggccgccgcccttaccggagttcgccagaatcaccgccgccatggccgccgccgcctccagctcctagccgccgtcgccagcctcgccgccgccatccacgggaacggagtcgctgtatcctgtagatcgcaaaaccggtgcctccttgcccaaaatcggccatctccacaatcggccagggtgttgccggccgttccggtgcagagcgagagagaaaaatcctttttctctttctatcaagttaataaatcataaaaatttaccatccgtttgacctcgaaatcgaaatccgagacctactccaaactcctagaattattccgaatccatccgtctcagtttcgttgcaatccgagcacccgttgtcgcgaccctaattttagccctagggtttgccgtttactgaaattccaaaaatccctaaaattatttctttaaatccttttcacccattgttgcactttgtgataccatttgttttgtttatttttgtttttctattatttattgtggtgatgattgttgcataaatagaaaacgctgacgttggtccggtagtcgaaacgagtgaaatctccacgccagaaggagacggtttgtacgactacatcaagcccgaaggttgcaagacatgcaccctcccttgaacaatttaatcccggtagatagagttattttagtagcgtacttgtcctttggagtacgatagactgcacaaattcttttaaattaattatattgctattattgcattatattttcagttgttgttataaataccttaatgagccttaaagtctaacaagcttaggataaaatttgataaacatttaaacaaaatgttaattatttagcatgctatcgatttaatatggatattattatcattgcatatgaaaacatgcttatggaactatttatggctatatgctaagaattgttgacaccgcatatgagcgggtggaacacatgatagagttcatgtgtttggtttcatggacctgtttatggtcataatgggtatatcgatatatttatggttatttcttatttaaaattgatataataattaacccccttgtgtcaagaagaatgacatagtttcgcccatccacacaatcgatttgtcgaacctggccgtatattgctccaattgattaaacttctgcatgcctttcggtgtattggccattagctttcaagtgtgtgaagcaaagtgacatgtttcatgtttatatgatttatatatgtgggctcgatgggccccgagagttcagaactgccctatgggcccatgaagttctgggctgcccatcgagtaacgaacaatgataagtggatgcggaggtaggttggtacacacctcggaccggatcactccgagcaacatcccgagcatcctttaacttactggtagaagggagagatatatggagcaatattacaccttgttacttttcagcctagccagctgtgggtatcatgtgggtaaagctgggcaggcactgcagagtcgttgagtattcgaatatgccgtgctcccggttaatggagatgtgtctatgggtgattccagattatgggcacaagttaaactaaatggctattaattaatatggttaacttatttattacttgacgttctattcaagttatttataagtaacatttatattgttatgctcgttattattgtttaaattaaatgttcaatagtgttgtttatatcaaatgtttattaagttaggctctatgaaataactgttaaggttagggtttaaaccttctagctctcgatactgcatgttttatattgcaattattgtatttattatcataagcatgtcttgctgagtaccttttgtactcataaatgggttcagatcatgaggaagatgcttgtggagaacctgctgatctgttagagtgggatagctatggtttctaggtcatcctacgctcaggcagttcctggggtggagtctagcaatttatctgtttgtagaaataaggctttataggccatatatgtaatggtttgtatttatgttgtgttgtgaactaagtattgtataatcgaagtttatgcttttatatcatttcatgcgtaactgaacatcctgtgcagttacgtattcgtggggcaccatgactttatcgggtgtccccacaacaagttcattgttttagtatccataaaccccaagccaccataatcctttggtctgatcaaaccttcccatttcatcatatgatacttcttttttcccccaaggccttgtcaatagaatctccccctcaaagaatctattttcttatgaaactccctaggtaattgatataaccctataacatacattggggcacttgacagacatgaattgattttaatttctctcccaccatagatgagttaaccactcttccaagactgcaatctcttttccacattttgagttatttgtctgaactccctcatccctattttctctgtatgcataggcaaacccaaataagtgaaaggcatgtttcccactttgcagttaaacatgttggtaattcttaactcctcatctttctctacacccatcacatagatctcacttttctgataatttatcttcattcctaacatctcttcaaagcagaacaacaagaacttcaacaccctcaaagcagaacaacaagaacttcaacaccctgacatttgaaactccttccttaatactccctccatctacttttgatagtcatatttcatcttagtacacagaccaaggataagtaattctacttatcatccatttaaacatgttactagtcatttctcgtaaacatgcgattcattaatatttacattttcaatggccatgtagccaatctagtgtggaagaatggagagtcatgcattaaatccgagaaagtcattatgatgataggttgttggattgaaatatgcttatcaaaaataaaattttcatatttggaaatatgactatcaaaagtagatggagggagtagtaaataagatggtatcatctgcatactgtaagtgagtcagacctctaggaattagctcaggaatcaaaccttctaaaaccctacttgtttttgcctttttcaggatagctgccaaagcatcccccaccaaattaaacagcaaaggggaaaggaggtccccttgcctcaagcccctgaaagtcttgaaaaaagggccttgatccccattcatattaatgctgacattacccccccccccccgagattttcttcacccaaccaatgaactcactgctgaagttcttcttcctcgtaacctcatatagaaagttccaattaaccctgccataagccttttcaacgtcaattttgaagattatccctttttctttttttcttttcttcagctcatgcaaagtttcatgtaagatcacataaccttccaaaatatttttaccaggaataaaagcagtctgagtccagcttattatcttctcggccaccttagccaccctctcatttatagcctttatcaagatcttaaggataacattctgaagacagattggcatgtattgtttaatgttgtttgcatctgctaattttggtaaaagagtgataaccccataatttaatctgtcagtatccagattccctttatgcaattcatccaacatttccttaactatccccctaaattcaggccacatctcttatagaaacccacagggaagccatctggccctggagcagtgtttgccttcatctaaagtattaaaagtcaccccggtctgctcctcgctcagcgatttggcctggcgtggccacggccgcgttgcggcacgtcagcgtggctgcaatgaggagggttttggcgactgctcgtgaggccgcgtcggcgctggaatttttgcaataaaaccctcctctttgtgcgtttttccttgttcatccttggtgtgctgtttttggctcagcaatgtttcgtttagccccttcattttatgtgaaatctgatgcgggcgaggaggagacgaggaaaaaggggcgcgccctaaatcgtgcaggctgggggtgtattccccaaacttgtctttgcacagcgctccctctccccttcgcgagagcgccgccgcgtgagaggggaaaaaacgcggccgctacgctccttccatctttctcgtcggatgctgcttgtctcctggatttggggcttctccggccgctgcctgctctgctgcctgtggcgctactgtttgccgtttgtgggggctattctgcgtgcgccgtgttgtcggacaggattcgcggccggcgctcttcttgttgcgccgccgtcggcgcccccctcgaaggggatgcggtgggtgctggatggcgcggtcgcggtttggcgctgtcgttgttggggcgctgccgacgcccgctggaaggtagcctgtacgtgctggatgggtcgggcgccgtttgcttgccggcggatctgctcgcttagagccgacggctggtgctatcagggaggatggcggatggtgtcgtcccttgttgttcttccatggtggttagctccacaggttgcctgtctctctttcttcacctttttcctctgtctctgatctctgctttagagctgatggccaactctgatgtgctgcgtgcaggttgggctcggtggtggcggccgcggcggatggatgccgatggaaaggtatatatgcaacgcggccgcccgttcatgtttgctcttcttccccagatatgttcaatgtgttctacaggctgaatttgcctttcgcatgcttgtctcgcactgttcaccgccggctttcatgctgctcaatacctaggtcaaccgcgactacgatcctgatgactttgactgtttgtgcttcttgctgccctgcccgtttgatgttgatcgtgtggccgcgcttgctgatggttcatggcactgctcggtgcgcctcttctggctgtgtttggattccagtgatgggaactaattcctctcgcacggaaaacagagcggttcattagcgcgtgatcaattaagtattagctaactttttttaaaaaaattgattaatttgattttttaagcagctttcgtatagaaacttttttgcaaaaaacgcatcgtttagtagtttgaaaagcgtgcgcgtggaaaacgagggagatgggttgggaacatggggatgcaaacagtcagatatcgatttgctatcgctgacatgtggcccttaccgtcggcgttcgtctcatccacaatatgagctgtgtctatgtagggaaacacaactatgcatgcctactcttgtgcaccgatcggcgggagtggggctgtcaggttagcttgcaagtgcggttgtcaggttcaaatagttggggcggtgtgctgtgattgggtggggttttctcggctccatcgatctgtattggtgcgtgtggtctatatgctcctggtgactgaattgtggggtctaattggatgtggtgttagatggttctctcatggtgtatgatccagcctacttccttcatcgtggaagatgtgttaggatgtctgactttcaggtggggttgggtgccatggggtccatgtatactcctttcgtattggtaggtgcgcttgctgctcttagatgtgctgtggttttagtttgtcctttcttctctgctatatttgtttgcaggtgctagcagccatcttcttttctcctcttccttctcaagctttcatcgtcgtttccactgctctatcgttttcattgcttctttcgttggttcgatctacacgtgtagtccgcatctgtttgctgtgatctttgatcgttcagtatggcagggtagggtgtgaggaggctctcattttgttctcatctttattcgatgtttctcctgtttttatgcctcctgatcattctttggtttttctcttggtttttagcctatgggatctgcatgagctggatcgatccttcaagggttcttgattggttttgccaaggaacgttggtgctgctccttcgatcgaggaggttagcttcttcatcctgtgtatgctttccatcatatagactgccctattcactgtattcatcgtgcattttctttagcatgcatgtatgctaatggtcgtcttctcttgcgcagggtcagccaggctctctctttccgttctttcttctatttcttagccgacagctttgtcctctgtggatactcttggtcagcttgtttctgttgcgttctttgctgattgggtgttcgttcatacaaggtattttcatctgtcgtgtgctccctctcactatttcttttttcatcttattcattgttactcttctacattgtcttttggttctttttgatatcgttccttcgtgcttgtttgtatcttgctgtgtcggttctttggttgtcagatgtctaggacgttgcatgtctgctgtcgctatcatcagttattgtaccgataagggacacctcgatggcttttgttacttctgcataactaactccgcaggcttctcttccatgctttctttctttatattctgtcctttacagcctgtagtcatgtcgtttccctctgcctcacttttgattctgctgcattcgttctcatctttagttaatttgcagttgctgttccagggttccctctttctgtctttatatatttgatgctgttagctcgcttcatccccttgtagatattgctgcactatggtgcgttcttgtggcctgatcttttattgagactcaaactaggcttaccgttgcatggttcgcacatgatatgtgtgccctttgtttattttttggtttgagatagataattgttttcagggtgaggtagccatgcaagattttaaaaacttgatatctgctgttaattattggttttttatttttggtttgagattactaattgttttcaagctggattaaccatgcaagattttaaagacatgatatgcattgttaggttttgattttgtctggcgaaaaaagaagtatgcctgattaatctctgcagtgcgatctgggagcagcatatttggtgcctctatgttctcttctgtatagcgcagggtagttttccggcgaattaacgagtatttaatttgttattgcgggtaccagatacgttgctttcctgctttcatcactccttcgtgttatatgtcgattatggtcggtgcctttgttttgctattcattcatactgatatttctcatcctatgtttttgccagcgcatctgccctgttttgtaaacaaagagttcgcgcgtactttcttaaactattaaatgacctttatgcttacatggcatggccattgtctgtttaggttattaggtttttcctccgtccttgtgatttggcttgtctgtttatgatattgtggatgatggccgatcatatgtggcttagatctgatactattttgcagcttattgtgtagattaataccatgtatctgctttatcaattgtttggtctgtatatgactcctgattgtgtttctttacatcctgcagggctaattgtcatattctgttgttgtctctgggcctacactggatcgcagtcttcttttccactgttccgtgcaaggtaactatctccttgctataattggatttttgttcctgtatatgaatatatgaatttatgtgcttcctttttagctcgtgcatggattgtgtgtgtaagtgcttgttttgtatgcctggcaatctgtgctaatgatctgtgatagaatgtgcttagactttatgcatatgtgttgtctctgttggggcatgtaacaaaaatgacagtcagcgcatcatcttttggtagcaatcgcacacgttagcttgcacatggctatctttctgctctctttcctcatatttcaaacattgctgcctgtaacgaatttcttttccctgttctctctaggctttatagggctaaggtagttttctgctctcttcttctccatctcatcttttctgtcttccctgtgctattccttctgcctctgttgcacactttacttccagattatctctttgcagtgttttagggatgccatgaaactctttatttattcctattagtctgcgtatattgctccatcagtctcggcaaataccagaccaccgtatggacagggttcagagagttcgcgcgagtcgagagaaacgagccgcgaacattttgttgcgctcatctgcgatgcgcatagaaagcgccataccgttgccagcccaacctccccagattcatcgagccaaaaagccacgttcgttgatggactttactccagagctatccaagctacatagacagcaccggtctttgctgcgttcaaagatgcctcctctccttgcaccacagaatggtaatactgtactgaaagcacacctaacagcgttcattaccctatatatgagaagctacggcactaaaatatgattgcaatgttcgttaattgcagctttaaacagcagagcctccggtagttcatcaaggacagataaggaatacatccaatcattgaaaggtccgtgttttctgataaaaaaaataaaacaatttatattggccggttaaaagaaatacattctcagatatgtattgtgcagcatcatacccaggacggtcgtactatggccctccaacacatgagtgcccctactgtggtgcagtcttctggtttcaggagagaattaagactctatctgctgtgtcaaagaggaagaaagtttacaacctatgttgtaagggtggcaaaatacagctgcatgctttcaggccaccacctgaacctctcgctaccctattgaaatttgatggcgatgcacgatccaaaagatttctgaggcagattcgatcatacaattcaatgtttgctttcacttcaatgggagcgactattgataaatcgatcaatactggaaatgcgccttatgttttcaaaattaacggtgttgtgcaccacagaattggtactcttctaccatcgcatggtgcacgccctaagtttgcacagctttatatctatgatcctgagaatgaaacccaaaatcgactcaatatttttgaccgtgaccgtgatgacaacgataggccagaccctgaaatcattgctgccttatcacgcatgcttgatagcaacaatagacttgttcaaaatttcagatacgttagagaccttctttctcagcatggtgatgagaaaataactcttcgcttattaggctgtaatgctagagatgatgtccagtataaccttccaacaagtactgaaataactaccataatagttggtgactttgatgcgaaagaatacaaatttgatctgctcgtgcacgatagagaccacggaatgcgtcaagtttcttccttgcatccatcatacctatctttgcaatatcctttgctatttccctatggtgaatctggtttccatctaggcatcgaatatagtaattatgatgggactggtagaaaatatctcacgatgctggagtttcatagatatctaatgcattataggctaaatgaacctaatcctttcacatgctatggccgactgagtgaccaagctgttgttgatgttttttctactatcgaagctaatagactacagtttataatcgatcatcaaaaggaattacgtgctgaatctgtagaagaaattgtagatgtgatagatagaggtgttaccgatggagattcagttgggaaacgccaaatacttcctgctagctttactggaggcaggaggtatatggtcatgaattatcaggacgcaatggcaatctgtcgcgtctatggttcgccttacctatttgtgacattcacatgtaattctaagtggcaagaaatcgctgaagcaatccgatttgaacccggccagcagtcatctgatagagcagatgtaattgttcgcgtgtttaacatgaaagtcaatgatttcatcactgatattagagagggaaggacttttgggaaatttcttgcaggtagcagccaaaatttattttctgtttagtgtttcaccaatattttccttatagttcctgttctttaaacctttttagttctgtacactgtcgagttccagaagcgcgagctgccacatatacactgcttggtttggcttgcagcatcaactgctgacatctcagcatctgtgatagatggcttcatctctgctgagattcctgacattgaaaccgatcgactaggatatgaattggtaagcgagtttatgatgcatggtccttgtggcgatgcaaacaaaaaatgtgcttgcatgaaaaacgacaaatgctcaaaacattatccaaaagactttcaagatgagaccattattgatgaatctggcttcacaatatacagacgacgaaacaatggacggtttataattaaaaatggaattcctttggacaatagatcagttgttccatacaacctgaagttgcttaaaacatacgaggcacacataaatgttgaatggtgtaacaagtcaaacttaattaaatatttattcaagtatattacaaagggacaagaccgtgcaaaatatactttgagacaactgcgaagacatgaaatatgtcaccaaatcatgacctcgctcctcctaatgaaatactagaatacatggatggtagatttctttcgacatgtgaggcgtttcatcgagtatttgagtttgacatacactctagagtgccaccagttgagcgtctagctgtgcatttgcctgggaaaaactatgttagatatgagccaggttctgatttgcgagcggtgctgaatagccctggtgcgaaacaatcaatgctaactgcatggtttgaggctaatgcaaaatatctaagtgcacgttcattaacatactgtgactttccaaaggaatggtcatgggactcatcatctaaaacatggcgtgcacgaacaccagctgcgaagataggtaggatatattatgtgcacccaacctgtggagagctatattatctgagaatgttattaatgatcgttaaaggcgcgcaaaattatgctgatgtacgcacgtataatggcaatgtgtgactgtcattctttattgctctgttggtaacgtacgatcattgtttgataagtattggctttacatgactgatgacatccataacaggctaaagaaagcactagataatccacaatgcatcattccacatgagcacttgctcaatctcctcctgcgtgaacttacaactgtttttgcaaacagtggcggtaatataaaagattttgacttgccagtacctacatctaccgcacacatgcccgacagtaatagattaatcgatgaagagcttgcagctgatccacttatgatgtccatgcatgctgactctctgatagcgcagctaaatgatgaccaaagaaagatctttcacgctatagtctcctcagtgactgcaaaccagcctagctgttattttgtaagcggtcatggtggaactggcaagacatttctatggaatgctatcattgcaaaacttagatcacagaacagagttgtgcttgctgttgcctcatcaggagtagcatcactgctgcttccaagaggtagaacagctcactcttgattcaagattccaattgacattgatgaaactagcatctgtaatataaaacgaggaactatgttagctaacctcctcattgaaactgcgcttattatatgggatgaagctccaatgacacataggcgctgttttgaagcattagatcgcacactccgtgacattctctctgaaacttctccagcgaattcgatcataccttttgggggaatgcctgttgttttaggtggtgacttccgacagatattacctgttgtccctaaaggttcacgtgccgctgttgtaaacgcatcaattacaaattcaactctatggaaacatgtcacgctattaaacttgaatataaatatgaggttgctcaatcctaccctttcacagaacaaaaaggatgaaatgcatgaatttagtcagtgggttttgtctgttgggaacggaacattgcctatgactgcgagggaggatgatgctcagcccacgtggataacaattcctgatgatcttctcattatgaccaacgacgataaaattgcagctattgtgaccgaggtataccccaactttcttacatcatatagagacccaacataccttgcttcatgtgcaattgtttgccctaccaatgcagtagttgatgagttaaatgattatgttgttggtttagttccaggaaattcaacaacgtacttaagctgcgatacaatatcaaaatgctctgagcaaataccggactttgacatgttatacccacttgaattccttaattctattaacgcaacaaactttcctacacacaaacttgtcttgaaagaaggtgttgtcgttatgctcctccgaaacctgaaccagtcagctggcctctgcaatggaacaaggctgttagttactagcttaggtcagagaatcttgcagtgtatcatactgactggatcaaacatcggtgaaactgtttacataccgagaatcacattaagcacatcaaaactgaaatggccttttacactgcaaagaaggcaatttccagttcgggtttgttatgcaatgactatcaacaaaagccagggacaaaccctcgaccaggttggcatataccttacaaaacctgttttcacacatggccagctttatgttgctgtttcaagggcaacaagtcgatcaaggctcaagatattgatccagaatgatgatggatcatgtggaaaccaaacaagaaatgttgtttatgttgagatacttgcagcggtgcatcaagcggtcatactctcgctatgtttgtgcatttcttgtgtctttgctccacttgtcttgtgctgttcatgtgatagtggacattctttcttgctgcaggctatgccgcttcagatgtagcctgcttttcctcgcaagcaaaacattgttcctcttgtatatacattttggaatagcttttttgctcacatatataccatatactatgttatggctgcatagcctgcccgttacacttaagtacacttcatcttgacttcctgtctcattccactgatgttccctgtttatatacactcagtatctttagtgtttcatcttccagatttccaatggcgtatgtgcatatttcaagccttttctgtggggacaccaacaagcaaataaaagctcgcgtatccaggctatggattttccatgatatgaatgatgagacaaagatctaccacaccaaccttgtcctgctggatgaaatggttgttgtctacttactgcttctttggtttactttcactcttgtatatatcttgtggcacactaacaaagtattttgggttaaaaatatgcagggcagcagcatacatgttcagatttatccatctgtgatgaataggtttaagtctgtcctacatgaaggaaaggtttactacattgactccttctctgtcaaatatgcaaacaggacatacagaccagtcaccaatcttttaatgatcttatttaccaaatggacaactttagaagaatgcattgatgttcttggtgactaccctggcataacattttcattgacaccttttcaagatatcccatctcttatcgacaaaaatactttctacattggtatgctcactttacatcatgtattcttgctatgtttctttcacatccttgtgtccctttattaaacttatttgctttcaaaccagatgtcatgggtgtgataactaagattagtgacacagctactgtgcgccctagatcaagcaacactaatagcttgaaacgaacaattcaaatctgtgaagcaaggtcagttacgctatacgcttactttccttttgatataagctgtcctagcctcataacatgcacggtagtcatcctgccaagctcacagtatctaagctgaagaactttttggccacttataaaaacagcaattcaacactccatatcacgctctggggaa

SEQ ID NO: 60962 - DNA, 21067 bp, Oryza sativa
  unsure (1)..(21067): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaatgaatatatatttcagaatgagtgaagcccacaatgatataactaactcgagtggtgatcagcataacaataagagcggttgtagttttgatcactaattaataatagtgatacacatgtgtcgtacacaacataatagcatatgtcatacatatgtatatataccattgcataatgacacacgcagatactaataatactaataagcttatttctttcctgtccataccaattagcaatttgcttcaccggtagggatcttggcgtatgcataatccatggcctctcccttgctgtccattgcttggcagtagtacaccgtggctgctgcaaagtagaacagctgctctgcaccagacagcagagcatagacgaccaagaggcatagccccagtaccatgttcttcgtgtacgcagcagcgaccaggttcaccgggctgacagctatcgacaagaggcagatggccaccaccagcacgaggccctccttcctcctcacccgcgtcatcagccgccacgcctgccggagcgcccggatcccgcggcgctccgtgtcgcccaccgacacggcgacgctcaccatgccaacgacgttgaagtagaggaaggcgaggaaacagaggacgaagaggaggacttgcacggagagcaccttgatcaagtagtgccgttgcacttgcatgacggaatagattagaacaccgaggagcgccatgtatgtgacccggagtacggtgaccatggcgatggttatgagaggacccttgagattccccttcatcgccttgcggaggagctccgggagcgagtagcggtcgccggagtaggtggaggaggccgcgaagaagccgacgcactgattgacgaagccaagcaccaaagcgacgagctcgacggcgacgacgacgaggatgagctgtgtaacgtcatgtttcagctcctccaggatcatgcggtactcggcgctggaagggtcggtggtctggagcttgattgcaagttcggccatgtccatggagagtggctggacgaataggacattggtagagaggacaaggaagctaggaagcgcgatcaggaggaagacaggtgtgaagagcttggggttctgagttgggaggactagggcttccttcaggaaggtaaagcatgatgagaagttagcgcttgttctggctgccatagcttacagtctgccacgaagctcgatggatctaccagttgggaggatggattggttattctaatatacaggattgctactaactggactacccaacaagggagacttggaaaattcagtctcaagtcattgttgccttaaattttacgctatgaagacgtggattatcttttgtgctgatagctcaatggctgaataaataaattattatttataataattatgcgaggatgcaacactactgcacaaatgatatttgcaaatggctaaaacctaattttgcaaacggctgggtggtcccacatccgccaacacgtatgtaaaagtcggtatttttccaagcgggcaacacaaccatacgtgaaaacaaattaagtcgcgtgcctaaaataaattgccaaaaaataaaaattccaaaaatcaaaaccctatctcgtagccattacaggatccactatgaggccacttgagtggacaccccaggtaatataccgtcgagtgtccaatatgaccaacacacgtatttggatgtgtgatccatacacgcataaatagccacccaaccttggagagcgctatcgcgcggctagtcgtgcgccacccgacacacacttgctagacgacaaaacaacctcctctagtctctcctctctttacacacacacacactttatatacatactttgtatactctacaaagtttatatatacgtatgtagtatatacatacatatatggcaaaatttgctacgggacacccaaaaaacgtgtaattagctgtgggacatcgtaaaactttgatttagctctaggacactcaaaaaaaggtgtaatttgctagaggacattgaaaccattattttattaattttaggtcaaatggagagagaaacaaccaaaaaagacgagtttgccctttagagccgaattgtttccccatctagcacttgcggcgacaatgtagatggcgctatgcagaggacagatccatggcggagcagtggagactgcatcatgcgtcgatgtccatctcctcgtctcctctcgtcgccggcagattcattgccatccaccacttgctgagccaccgcccccactggaggagctggagaggggctctcggggtgagcagccggccaaaatcctcggccttttgcccccctcaaatctctgacccgagattggaagttgcggcagagccagccatgcaatgtccctcatgcttgtcgtgctccagcttaggctcctcttcctcctctccagcctcatcatcaacaccatcctggcgtgccctccctccatcccgaatcctcagctggattggtagcaaaatcttttgttgttctcaatttatcaatagggtgttttaggcgatctgatgcagccacatgcttgcatagctcatcagaggagatcatgcgaatgccgccatcgttgccctcgccacggtggtcctccatggaggacaccacatcactgttgtatgttgttgtgtgggtcatgtgaaacgacggcttgtttctttttctttctcttttttacctgcagacaagaggaaggagagaggtctgaggggcattatcgtcttttaaaaaattgctctctccatttgatccaagaaataataaagtaatggcttcagtatcctttagcaaattacatcttttttaaagtgtcctaaagccaagtcacgtttttatgatgtcccacagctaattacatattttttgagtgtcctgtagcaaattttgcctatatatatatatatatatatatatatatatatatatatatatatatatatatatatatatatatatagcgctaaaccgcaccagagtgcattataagtaaaacgctccccacctctatcctccccacgcgcccaccctctcccacgcccacgttctttttcccgcgcaacaacctccctccgttccttttttacccaacgccgttccattttctttttttcttttttcgttacgccatattccctccgttccttttttttctccgtttcatttttttcttttttccgcactccgcattccctccgttcctttttttcttgttttttttctctttttttttctcatgcactctgctgttttccttttctttggagtaaaaaatttactaacaaattactttctcacctaatcttcttttagtaaataaactattagctttcagtcacactataactttaccagtaaatcaattactcacgtatacattattatagccaaatatatatatatttcggtgttatctcgagaaagaaattacttccgatagaaaaatctactctggtcttcactcagtaaataatttacttcacagaaaatctgctacatccactcagagaataatttacttcacacaaaatctactacatcccttatcacagtaaattaattattcctcgtaaaatttactcctatcttctttcagtaaatggattactttagaatggccattaatttttctggcttttcctcactcataaaataatgcctcctgccttttccaaataaatagattagttttaatctcgccacaccaacaagattgactctggtattctcttagaaaataaatttctcctagactgctctacccacaaaatttactacaatcttctctcattgaaataagttagtccctgactattagagtaaaatatttaccaacaaatcgatatagccaaaataaattacaaccacatttttgtctagtaaaaaactacagacatgtttacaaagattcagggacacagatacattgattctacaattaacaaaagtagactcgctattcctattgcatcggcagaggacaaatagtagccgatgatgaagcctgcaccggcaaccttagaagttctgatgggcaggacttgttggcagccacagcagattagctacaggtagaaatcgatggagaaggccaatgacggttggcggcagctagctcgtgcacaagcgatccccatcaagagagggatctgaaaaaaaacaatgaaccacaggggcttagaatgcgcacaacaatgaaccatgattacaaaaactaaattcaaacatgatcggtagaaatggtgaagtagtgagacttggatcttatcgacaacaacaatggttcgatccagtagacaatgctaggattttagaaagaagaaaaaatgggatttgtttaccatgctattcttcagctgtgcaaccaagtttgtactcctagcctgcaatcaatgacattgtgcaataattgtatatagaatctcctcttgttccagttccaaattcctcaacattgcacagaccaattgacaactaaaatataaaattcagaccggaaaagtaaggaggtgttgaatgcatcctgcaggaatttcattgtggtgagaaccgagcgttgctcggttggctagcatcgctggtgagcgagcagcccgcacgggttcgatccctgggatcgtcacccgcgcgtctcaccgggatttattcccaaataaataaatttccagctctcccgtgccagcgccacaatagcgcacaagatccttaggtggctttgtgtatctcattagcacgtgtgtgtgtatagttgataggtctagcatgcgtgtaggggtgtgtgtgtgtggagtgcgacgtatgttcagatactacagcttgtactcaaagtggagagctctcaaaaaaaaaaaagaatttcattgtggtcaggcttgttgctagactgctggtaggaagtcagagataaattcatttttttacagtgattgattggttccatatatggactgcacgtcatagctacggcaaataactattcatatattcatattagcatataactaagcaaatgcactatcatgcggaacatattcagacggatggttgtgatggcgtgttgaataaaattacctcttgatagcaccaagcaattttcgattttgaatcaaactaaaaataggtaaaaatcatatctcttcaaagcaccaagcaatttttagttctgaaccaaactaaaacaaggtaaaacgggttgctcttacctggcaacttgatagtcgtgccgaaagagatccttgcaacctgaaattataatccaagtttgtggcaatcttactagcataatagggcgctctctagcacaaagaatcaaaattgcagcaatgttaaatctagatgagagcataatcaaatcgtacaatgtttagaaaactgctcttgtcttttttttttcagtcatgaattggtgtgtgtgaattgtttagaaatctaacagtatatacgggacatatgggagatgtgttcgcaaattcatgtaacgagacagaagcaaattgaagtgtatggcttaatttaacccgtgcaaatcaaagcacagtaaggaagatgcaactagctagacaggggacaaatcgatctacgatggaacatgtatgtatgttatacagcacctgaacgaacacaagcaatcaccacatatccggcgcccgcaaataagctgcaattaactgatcaaacacggcaactatgctttttcaaaaaaacacaacagctatagcctatagatatcgatcgagcagatagatcatggagaaaaataaaacaccagatgaataaaacatcgtgacttccattgaacacatacgagcatccatccatccatcgatccctcaacataccaggtgaatttctttgatgaaagaacatacaaccacgtgaccacctcctcctaccaatccttggcaatcaatcgagtcgagggaagaaaatagacaaggcggcaggggcagttaccagagatgtccaagcaagaagccttaggtgagggccagacctcaccgagccagcggccttgaccgccatcgccaccaccgaccaccgttggggagccatggaggcggccaccatgtcgacgacggggagggggttgcagggcgacgggggccggtggctgagaaccgagcgccccacgaggttggcggagcggcgtcgcggcggcttgggtggagcagatcggcaagggccggcgggaggggggtgggacgagctcgaggcggcgacggcggaagggaagccggtggaggccgtgggcagagaacggcgggcgcccgtcgtcgtcgtggagcctgcttccagatccaggcgggggcaccgagatccgggtagccgagggcgacgacgtcgtcgaggtttctcgatcgatccgtgaaaaccggggtgggacgtggggtggtgggagcgtggatggtcattgttgtgtgtgtggggcctgggggctcggtgggtttttttgggaggggggcatggggaggggggggggttgtttaggatgtgatggggagcatcttagttattacgcatcgtaggtgcggtatagtatatagtgtatatatatatatatatatatatatatatatatatatatatatatatatatatatatatatatatatatatatatgaatgatatctatccatcctgttcttcttgtcttccagtcgaattgctttatcaaccaactcctgaaaatcctcatagtcatgagagatcaacataactgacagctcatcctttaagccttccaaaaacttctcctgcctttcctcgtcagtacgcacatcttctggagcataacgtgccagacgattgaactcatgaagatactctgccacggtacgatccttgtgcttcaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaaagcaaacaacaagtgttctaccctactaactattcttcaaagacactttggcggcataggttctaagatagattccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaacgacaaaacgatttgcaaagaattctagataaggaagaaaggaaaattttcacaaattatgttttcggaagatttgtccttaaggtttgaccatttggcttatcctacagtcaacctggctctgataccaacttgtcacgcccgaaaattcactagtaatttccgaactaatttgtgcataaaatcctcgtccaggaatcagccgaggtacacaaactgacaatttaatatacaaatccatcttaataataacgttacatacttacaaaagaaaagaaaacagcagcggaattaacggtctagcgatggcttcagctccactcccacaggcagctcaactggggtataagccaaacgtcttctccttctggatcctttatcttcaactgaggtttgattgattattgcaagaatgagtatatgacatactcaacaagccacacagcaaatatgcaagtgcacaaggataccaaaggatggcataatataggctcatttgcaaaagcagcatttagcaaagagttaagagtagtaaaacagtagagtaattaattaaaaattttaatcaacactgaacagcacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacagctattcgaatagttttactctggccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgctacacaaaagataaagccgttgcccacgctggcttgtggttagcacgataaatgtttcacaacagtagctcgcgaaccggtccttaattgtcatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcattgctaagcaattatatatataacatttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacaatacatataaagtaaacaaacatgtagatcatgattttagatgaatttagcaacttgaaccactcaaaaccgagttacgatgatttagttatgaatttccgaagatttaatctattagaaaaacgggaaaaagaaaaaccgatgatgtcatgatgacctcatcaatggccggaccaagatggcgacctcgccggagattggatggtcggctgcgactttggaggacatgaacacgtagaggacgacgagacgaacccaacggtactcaccctcgaaccaaacgacgaacgacgacggccggcgacgaggtctattggcggcgcggcttcggtcggcggtggcgacggggctccggtgaccggcgacagcggggagagagcggccgggcttctccacacctcggcgcaccttacggcgatgacggcgaccggcggcgacgacggaggcggcggcgcgacgcggatggagctcggccggcgacgacggcggggtggagcacgtggcggcggcgctacgaggcacgggagaccacgggagaggggcaaacgaaagaggaggactagggggtcctatttatagccttggattgaagagatcggactcctcccgcaagaaatcgatccggaaaatcaaaaactcggttttggagataaactcgaaaacgagttcgattcggataagatactcaacgattagctccgatttttgggggtaaagatagaggaggataagaggaatatttcccctcaactaattttagaaaaacacaaggggaaaggtcagatttggaggagaaaaaccgagccaaatcggtctcagttcggctgctagaggtagaagataaacagtgttgagggaggcaaattagacttttcgtcttgggctggctgaaaacaaagcaaagaaagaaagagaagggggaaactcggctgggccgactagggctgcacggctgtgcacacaaaagaggggggatgggccggaaagggcccaagactaggaagaggattattattacttttccaattaaattaatcaatgaaatgatctttgaattgttaaaaatacttccaatgctcaaataattccaagaaaaatcttgaacatacttggacactcaaagtacttaacaaaattataattagaccatttaatgattaatttaatatgtgggtaattactgaaatgctctttgtatgattaaaaattaggaattgagctccgaaaaaatctgagaaaattccagagagtataattaaccatggagaatttaataaaaattaaatccatccatgtcttaaatttaggaaattttatttcccacatttaacttcacttgtaaattaatgaacatttaatataaattctaataataatttattaaataatttataaatcctgaatcaaaaatcagggtgtgacacctaacaacaaaacaacttaaactcaactttacttcacaattcattattacatacataacgaattatatgtttgaatgttatatacctagaaccaaaatctaacaaaaaaaaagttcaaactcagttcaaacttgtttgaacaagtttgaacttattagtaaagaagttaatgttcatatctaaacattttaaaaaatttcatactcattcaaattgggtatatactcaatttaaatcttggagcctatactccatgtagcaccagttaatatatatatatatatatatatatatatatatatatatatatatatatatatatatatatatatatatatatatatatatatatgacagcgctaaaccatacccagggtgcgtaataactaaaacgctcccctcacaacctacccccaccccaccccccacccccacccaccggtagtaacaatctatcagcctatgagtaaatgagttgctaccactctcgcgcactgttgtttttcttccgacgtggaaccataggtaaaagaattactagcagattgttcacgaccaatattctttttgtaaataggttattggtttgtaccatccttctcttagtaaataatttattgccaacttttggagaacatctgatggagttataaagacttataggttatatatgttagcatatttcggtggataaatggtttgtcattgtaacatgaatagcaatactgtattgatacaaccgtatacacatttaacacgactaaaaacattacaacagggtattttgcgcatttcaccatcgtacagtaaaaatattagaaaaagacaatcacaaataaaaagacaatgggaaaaaatctactgatatgagcccagccccttgcacaggctaattacatcattgctgttagttcctttaactaactagagggcatcgccactggaaaagcatctgaatcagaccgcccacctacagttcagttcatgcatttcaggccagattaaggacggcgaacaagacatcattcctgtggcgccatcaccactggcatccatcaggactcgatcacttaactgtatacaatatatcctcctgttccttttcccagcttcctgaacataatacagtgaattcacgaatcaaaagaaaattcagatgggagcaaagaagggggtgctgattgcatcgtgaaaacaacactatatcaatagacctgatcatgcaaccatggttttgatcactgcgaaaaccatgggcgtgaaagaagtgtagaaaagaaagaagaacaggagaaagggagcagaacatatcgacgctggaggtgatgccgggcgaatggaatcgctcatggtgttgtttgtctagaacctgcacacaagcaacaacacagcaccaacaagcgttatcaaaatgaggaaaaagggtttgagcaaggtgaccttgtcctcggtgaacatggaacggggaaggagtatcttgaaggattcggcatccaccaagaaccgacatggcgctgcatcaataaaacgagaacctcccaggcggccattagttcagatgtgaggaaggaaggaggtgcaagctgaccacatgattaagatctagtccaccaccatcgataccaagaacgcctcgctgcctcgaccatgccggaggcgacgcctggatccggcggcgggggatcacaggcacgcgatgaggtggtcgccccctgccgcgccgccgcctaggctgccgcctcctgttcgacgaagctgatgccgaaggtggatggccgggcggacgatggagaggcctcctgatccagttgttgccgctatcgcttagagaggagctgcattgatgtgcgctcgatccgccgccgaggatgtagcccaatcaacgttgccgtcgaggtcgatgccgccgctcgatctgttgaggcagacctccgcatcggcactgccgaggtcctcgtcacatccggcgacgaggagcggaggatgatgcaacaggaagggggcaagggtggcgcctgatggttggatggcgtccaccgtcctgttgccaactcacaactggacgacgcgcctccacacctccaacgccgacaaccagcccggatctcgcccgccgttcgccgatcctaaaaaaaaggggtggacagcgacaggagtagaaggcgatggtggcggcgctttatggacgggggaggtggcggcaccaagggaggcaccgatgtggacggggagggtcatctcggcggcgtcgaagccagctctacctcaaacccccgccgctggatccaggcggaggacgaccgccgtcgccggatccgggcgagggacagccccgccgagcccgtcgcccaccgttggcgcaggccatcgtcgtcgctcgctgctggcgcaggccgtcgccgtcgcccgccgccggaggaagctggagggaccccgccgcctgccgcccagcacaccgaggaggcccaagccggcgaccgcctgccgcacccgcaggccgtaatcgtcgctgccgatccataaaaagtggagatggaggggaaagtgggtgaacggtttctacgagggagagggagggagtaaatatagttagcagatagagttgataggaaaaaatttaggctgggttcgtttggacgttttcccagcgcgcgctacagtgttttgcccccgcgcacgctttttaaactactacacggtgtactttttttgcaaaaagtttctatacaaaagttgcttaaaaaaatcaaattaatctatttttgaaaaaaaaattagctaatacttaattaatcacgtgttaatgaaccgttccgttttccgtgttactgtagcgcgctgggaaaacgtccaaacgaacacagccttactccgttaagcgtaggtgcacgggaggtaggggtgaaaacggggcgggtattacccgcccgcccggccgtattatttcgggacaattttgggtaaaaaatttgggtacccggaagtttctacggatagcgggttcgaatacgggtattttctatcggatatgagatgggattcgggaggacggtatccgacggatacggattatctggtaaaaatacgggtattacccggttatatatccggataatacccagataacatgcctagcccaataaagcactagtggccaaaaggtccactagtacaatgaccaccatcaaccaggaaaccatgcctaacaacccaacaaccaaaaatactaattactgttcagtgttcactaatcccactaagcaatgacgccgagactacgagcgccactggtgctacggtgcagcacccgtcgcgccaccacctgctgcatccgttgagctgcggccaccgccgctacatgcctttgctgccagctgatcctcatctctttaggaacaggaagtcagcagctcatcacaagtcaggccgagtttagttccaaactttttctttaaacttccaatttttctatcgtataaaactttactacatacacatacttctaacttttccatcacatcgtttcaatttcaaccaaactttcaatttttccagttaaaaatcgattgttccttgtcgtattgctcgtatatcttaaaccctaataatatagtcacattatggatatatggggatggttgaatatatagctattgtctatatagtatagatgatcgttgctttgacgtgatacccgaaaagatatttgtaaccgatagtggtcgtatccatctaggtacgtattcgtctcatatttgtgcccgatattatccgtgcttgtatccgtattcgatactatccgtatccaacccgattccgattataaaatgtgggttaggatatgggaagagtgagatctgaccgaacccgacccgatttcacccctaacgggaggggatttgattgggggggtgttgcatggggggtggggaggggtgggggtagggtgtgagggggtagggtgtgtggggaagggtgggggtatactgatctaaagcagtcttcaagaaacccactaagatttgaaacctgcattaccccgggtacctgggcttctgtccgagacagctgggtcacgccagctagcccttggtggaactcgggctgcctgaaatagcggcacggttctgcttttgcccgtttagctaaatcaggtggagcgggcatgtttgacactcgtccaagacggcaccggtggtaatgactcagcgctagaatggttggggctccccataaacctgtttcatttataaaagagaggactgcttcacaacagcctgtgtagcacgcccatcaccccaactggccctgaggtcgcgccctcgcgctttttgtcatgattcatctattctcagacgagcttctcgaagatgtctttgatgagtagataatgtagttattttgtatgtttcgacactcttctttgtagaagaatgcaaaaactacaaggactaaggcgtgcctggattccaggacgaggctggaatcgaggaagaccttggtttataccttctaatcatatgcctccaccctccactccttgcaaaaagtgtgacttatgaggactaaggtgagctcgggatctagaatatggtcgagtctgaggcagaccttagtctacttcttaagatgtagatcttatatgtctctacgcttctcttactgagtagcgtaggtcttataaggactaaggtgagcccgggacccaggacaagaccgggtccagggcagaccttatgttacattcttaagacatagattttatatatctcaacactcctcttcacaaagcagtgtgtaactagacgagctaactaagctcgagacccagagcaatgccaggttcgaggcggaccttgtgctacatacttatcccataagaagatgaaggtgggcacggtacccaccaagataggacccctagccgcactagtctgggtgtagctttttatttttaagaatggtttgagcatgccatttattttatttgtaattgttttgccggggaaatgggtatagttggccataaggccggaggcccgatggcccggcccacggcacgggattttggcccggcccaagcatggcacggcctggtagcagtcgggcccgtccttgggcctatggctaggcacggtgggctggcccggcacggcacggaccgaggttggcacgatgggccggcccggcacggcacggcccaacggtcggcacgaccacggctcgcaccaacggtaggcacgagcacggcccagcccaacagacagaggcaggccatggcgccgcaccgcgcgcgcccccatatataagcggcgtcccctccccagcccaccctcgctctccgccactccaccctaacccaaaccctagccgccacgccagcggcggcgcggccactgctcagccacctccgccgcagcgccgctccgcctccaccgctcccccgcccaccagttctcctcctccaccgtccgccgctccgcctccgccgatcaggcgctcaccgacaccgagtcgcctcccttccactcttccagatccagccttcctcttcgtctccgatcgatgcctcgcctgacttgcacgaggggcgcatgaggtccactggccatgcatggtcgcctgagtcgccttccttccactcttccagatccatccttcctcttcgtatctttcccttttgttcttctttgtcagatcccttggtcttctcgtggattcgtgagcctatcgtcttcaacggcaactccggtgctccggctgcgcaggtacaagcatgaaacccatccttttttatctttcttccttctccatttccgagccctaactttgagtgtgcttggctgcttgcaggtcgcaagctcgttgcttagcggcagccgccgttgagggaacgtagtgcccgcgatggacgacgatcctagctcaatcaactacgagttgaggactatgtgcgcggtgatgatgattatgatgtggaggaggatcgtgtggaggtgtacggcaatacctctgacagcccgatccgtgtgaatatcgacgacgacaacccaccggttggcggcagtggcaatgggacaccgactggctctagtgccactgctaccaacaagaagaccaaaacctccatggtatgggatgactttgaggaattttatgaaacgaccaatggtaatagggttcgtatatcaagtctctgctaaatgcaattactgtcataaaactttgagtgctcgttcttctgctggcactggacatttgcttaggcatattaagtcatgcaaacctagaaggcttgggtctaatgctttgcctcagtccatgcttagatttaatgcagatggttctgttattccatgggaatatagtcctgaagttgctagggttgaattgtgtagattgatttctagagaggatcttccaatttgttttggtcaatctcctacttttgtgaactatattaaggctgctcataaccctagatttgtttatgtctctagacaaactactaccatagattttcataagttgtttaatgatcgtcgttctattattgttgagcgtctcaagtctgctagctctattgctttgacatctgatatatggtctggtcatgctaaggaagattatttgagtgttgttgctcattttgttaattttgattggcaattagagaagagggtcttgggtcttaggcgcattgatgtgtcacatactagtgctaatattgctgagcatgtgattgcagttgctgaagattatggtatactgataaggttttctctattacattagacaatgcttctgctaattctaaagcaatggaaacccttactcctgctctgtctggttatgttgctgatttatttttgcatcaacgctgtgcgtgtcatatcatcaatttaatagttaaggctggacttgacaagttcaagcccatgctaagtgacattagagctgctatttcattcttgaatgcatctaatcagcgcatagctacatataaaaatgtttgcattgttgcgggttatcatcctcgtatgtttgattgggacatggatgttagatggaattcaacttatataatgcttaagcatctcataccacatagggaaccattcacagtgtttattagtacgcaacatccttttgttaatggccatccattactcacaaacttacattgggcatgtgctgaatctgttttatgtttccttgaacagttttataattcaactgttgttttgtctggtgtttattatccaacatctccattaatcatgcatcacattttagaggttgctggacatctaaacacttatggcaatgttgaaaaccttgcaaatgctggtggtcccatgaaagataagttcatgaactactggtctaaaattccaattctttattcatttgcatttatcttggatcctagggccaagatcagggggtttagtaaagtgcttcagattatggctcaactcattggtgatgattactctgcttatttaactactgttagggctgcattgtctgatacttttgctaagtatgaaagtaagtttggttctgttagattgcatagttccagtattccaggcccttccactggtaagaaaaggactacatgggggaagatttttggttctgttgctgctggtgccagtccaggtgttgggcttggtgctggtgctagtctaggtcctgggcttggtgctggtgccagtccaggtactgggctcggtgctggttcattatctaggatgacatctactactgctttgcttcagacagcttcttcaactactaatctcaatgcttctgaactgtctgcatatcttgacagtgacacagtcaaccaatatgatgatgacttcaatatccttagctggtggcaacagcacaaacaaacttatcctgttctttcaatcttagctaaagatgttatgactgttcttgtttctactatatcgtccgagtctacttttagcttaactagcaggattatcgaggaccgtcggcggcgtctaaaccctaggctggtggaaattctggtagtgctcaaggactgggagctagcagatgcaaaaggtcagcatactactgagaatgtggagcttcaaaatgcttatgagaatatgtatcttgatgatgaaattgatgtaaacccttgaactaaatgattgtaattgatgtgaacattttagctgtgggctgtactcttttcctttctagggttttctcacgaggtgtgagtttttacctagaaaggtttttaatgaggcagccattgcactaaggagcttatataaaccccttttatattctgactttctgagttctgtttgtgattctgtgattctgtaattctgagatggacttgatgaagcatagtagatgacttgatgactttgatgaattgatttgaaatgattgtaaatctgtgacttgatgaagtgaagtgattgtaaatttatttgatgaagtgattgtaagtttgttgaatggttgatatatttgatgaagtggttgtcaatttgatgaattacatgtgaatttcatgaatttgatgtgttatgacaattttttgtattgaattgaactgttgaaggggttttttttgccagggcgtgcctgggccggcatgggcacgatgggctggccgggccgtcgggctagcccggcacggcccgaggctactagggccgtgcctgggctgtggccgtagcccgtgggctggcacggcttgttcgttgggccgtgccagcccgactgacctcagcccaggcccgatcgtgcttgggccatgccatgctgggcggcccatatggccaactatagaaatgggtaccctggttgtaatttcaccaacaatatacaatatatatgtataatttttatatgtattttttatgtataataatatacacgtacataaagtttgtatacgtatgtgtacaatatatatgtacatatttaaaaaaattggaataaaacaagaaaacacgtatacaaactttgtatatatacttatacaaaatttgtatacacgtatattaaaaactgaaaaaaaaaccgtaaaaaaaagaacaaaaaccaaggaaaaactgaaagaaaccaagaaaacaaaaaaagggaaaaaaaacgccacgtgtcgtcaccgcagcgttccgtggcgccatgtggttgcgtcgcacagggggaggcatgcaaccatctgccaaatatctttttcactcatcctcagtgtatccacaatcacggttgacacctttcaatatactaaccacgatgccgcatggtgagtaagagagacattcgatggaatagcttgtctgtcaacttcaacctaatacatgcttgtcaaacaattcgaaggtggcaaacaaatgtgttgcatatctaaggagacttgaccaaaatactacatttcactattatctcaattactcagaaaccttactcacgcttagctagtccccagcaaaagcgaccagcctcgtactttcatcgcaagcaattgttaaacatttttttctgaacgactcgcacgagaaggtgcgaagttccattgatagagcaggaaaaaattacaagattacaaccctggagggtcgtaaccaggaaaaaggaaaaaatataccacgacccacacaccgacatcgccaacacacaagcccaggataagactagcaccagaccggccgctgctaagcatgaccgaccgccactaggggacacagacaagatcacctcctagggatgccaaaacgacgtctttaagaagagaagtgacagaaaaactgccgccatcgtccgtcgggactcaaaggagccaagactggactttcgcccggcaaccaccctcgaggggtgagagagcacgacaacgccctcaggagggggaatgaaccatcgttgtcaatccggccgaggccggactaggttttcacctgccactcaccacctgcgaatccacggctgacgcaccgatgctccaccaccacacaagctctgccgacatgtgggacccctgcaccggcatcccccgctggccagccttcgtgcgccgaagaccacaccacacccaccggcagctcctcctcacacctaggtcgcctcctccactgccggccacgcctctcgtgccaagccggcctcctccaccaagacgcgcctctcgcgccaacccggcctcccccatcggccgcgcctcttgaacgcgctgatgacgcctagagggggggtgaataggctgtccctaaaaacataa

SEQ ID NO: 60963 - DNA, 16645 bp, Oryza sativa
  unsure (1)..(16645): unsure at all n locations
aatcgcagcggtaaaattcaaacagacccggaacttcctggtaaggaactccggaacttccggcctcccaagcccggaacttccgggtaacagaatagaaatgaaattcaaatttcgaaacaagagactaagccaatcttcacaagatggtgcacaggtattctaagcagaggatatatcatagaatcatctacagaaatatcacagaaagagacaagagcaattttttttcccgaagtttggatcttgcgatcctactctccgttgaggagctccaaagagctgggtctcgattaaccccttgcctcacttgtggaaaaaccccagaggaaatccacagccttcaaccccaaacacccctcggcaaatttctagaattgagtgaccaccaagatcaaactcaacctacttctagaattttgacaggcgggtgctggactggagttgcaacaggacgtggagcttggttgcggttgttattgccagcattgttgttgtagaactgacgctgtggacaaacaacatatgaagatcctccctgtgacactgcctgaggtcccatagtgagacgcggcctctgactattcccttgctaagctttgaactgagcaatcctgcgtttcttctgttccattgggttgtacttatcctcctgacgaatggccttatccaccaacttctggaaatcagaataatccccagtcattagcgggtaagaaagctcatcattcagtcctgccaagaaattctcttgacgctcttcatctgtgcgcacatcctccggaacataacgggccagacgattgaactcatgcatgtactcggtgacagaacgggatccctgagtgagcgccctgaactccttcttcttgagagacaccactctcgatggtacacgagtcttcctgaaagcagcagtgaactcaagccaagtgattggttcagcagtagccctgttgagacagaagtgatcccactactcaaaggcagggccatgaagctgatatgaagcaaaggagactttttcttagttagtgcactgaagcaggtccaacttcttttctatggcgtgtagccaatcaccagcctcaactggattggtagtactggaaaaagtaggcggcctcacacgaagaaattctgctaacttgttctggggaggagcatgattgttcccctggttttgttggttctggagttgttgcatcatcatgttcatgagttgcgcctgttgagctaggacttgggcaagcgtgagattctctccattgttgttgttgttgttgttgggcccatttccattgctgcgggtgttcaccatctggcataggcaagagcacaagaagagaaacaagggagaaagctacttaggacagggaattaatttctactaacttgacttttattgatcttaactgagtttcattattacataaaactgaagactctcacaccacttaactcaaacttcctaacactcgaaaccaaacaaacgcatgcatttacatcccaccaatgatgtaaaccacatgcaagacccacacatagccaaacttaaacaagcaaactaacacaacgaactaaggcaacgacttaacaagacatctagatcttcctggcatcggagttgattgaaggctcgttcggctcgttctcatcatcttgagtagcaccccactcaacctttgaatgggtgcgctttgaatcttcttcctcctcatcacttaaattaacgaccggaggatccactgggactgggacagcttctcttgccaccacacgaaccttgggcaccaactggtagcagggaacaaaaagagctctcttccttgcagtaagatgaaccctggccttctgtggtggcgcttctcccttcaattcggctagttccttctccagacgatcaaccttgtcctctagcttgcagatcttaccacggttccgatcttcacaagcttgagcagctgacacaacttcagcgcgggactcatccatggcccacagcatctcgaccaaatgtcttatggtagcatcattctcaattccttcaggatcaacatagctggcacggtcacttccctggggctgacgaggatggcaacgatactcagtgtcggccaacagatcattgtaacggtcacggagctctcctatggcgatccttgccgcctcctgacaagcttgaggatagcttccccctccagcctcgaacatcatcgatgggatgtcttcacgatcactgttcaaggtgaccatgacacggcacttctcttcatcacgatcatgaggaatctgggcatacaaaggggcagtctcgaatcctatggtaaaggacatcatacgcagctcctggacaaatccctcaataccgaacaagtgctcaggcttgaagcgtggcatctaaagacaagtgaaaggagggagttaagacatttatccaattaatagcacaaggttttggattaaattgaataaagttagaaaatcgaagtgaaaggtaaataaagtaaactaagataagttggaacagttgaaaacaggatcacaaatttttgcacttttgaataacaggtttaaaaaaaagctaaaataaaagagagttataaaatcaacatgctaagtttattatattgcaacatgattaaataaaaataatgttgtaaaacctttgctggtaaatgagtcattagtacagtaatagatgtacagtactaacaacacaggaataataagtaaatttttaatgagaacaattaaagagactataatctgcatgtgccattagcttggtttaattaaaagagaaagagagaagaacagttctacttttttaatatttttagagggcttctataggtaaccatttggcataacctagggtcaaggaggctctgataccaacttgtcacgcccagaatttctatccaaaactccaaacacttacatgtgtgtaaaccctcgtccaggaatcagtcgaggcatacaataacaaattgataatagagtgcaattattactctaattaatagacggatataaattcattatagagatagatagttcctcttaaacaataaagatctaagcagcggaaaataaaataaagagcgtaggcgactccatcccacaagcagcttgaccagggctacgcctaatcctccacaccttcagcctcactgtagaactcctctgatgaatggttgcaaggtgagtatatgacacactcaacaagccacgcagcaaatattcaagtgcaggggataacaaaggatggcataatatagtctcatttgcataaatggcaatcaataaatacttcagaatttagaaaaacagtaaagcatttaattaaacaatattaatccaacgctatacaacatacccgttgcataggcccaaccattctgaacaaccattcctggctgcacagttctatctccaaaccaggaatataccattctaaaccaggagctaaacaagttattaccaattacagcatcatttattatggtgaaaggtgtgagactaatcacaaaagacattgttagacccgcccataaccgcgggcacggctattcgaatagttttattctggccagaggtgtaccactgtacccacaagacacaacctcaacatcatgtcaaccatgcgtcgcgatacttaacaagaacccgaatagagattgtgacaataacctccgcaaaacacaattcaaagcagtgcacctttcttggatcataatcacccccttataaaacaaggcatggactccccagcgacccccgtgggcttatctccgccacttctcagtctggttccccacaatgaaccacactatacaaaagttaaagccgttgcccacgctggcttgtggttggcacggttaatgtttcacaaccaaaaatcgtgaaccggtccttaattgtcatgagtacgaccatcaaaaccatgtgctcacaacccaccattaccatgttttagttggcatcttaataaaccatcctatcacgattgaccatcatgagctaccattaatcgatcattaagtaatagtgaatcattagttatcccattcatatgagctagtgtctctaaccatggctaagcatcctaattactttagctaaaaccatataatgttcttgctaatccaatttgtcgacgtttgatgtcgcaattctggtatttgcatagtatggggatcgtcggtgctaggatatatgcgagactgaggtaataaccctacatcctgtattgtcaggtaataaccctacatcctgttggccgaagccggtattgctcttattcatgataatcacaccagtataatatttggggtagcctatctaactgttgtcgacatggcggtctgactcgtagtcgacaacagggtagcctttctcctcgaatccgtgcccggtaagatcagagatagcgctttcgtctctcctgacagtatccggagacaccgtagggtactagccgtgcttatccctgaagtcgatatccggcggcgtgtcttggcgtatgtaggcttccatgttgtggcttctatctcgattatgttgagtgttgatcctccatggtgggtgccgatcgtgttgatcgtctcctctcccctcttctccttgggggcttgtatttatacccacaggtatccccttgtccaagtagaactagtgaaaccaatatagatacaatccgagtagtccttgtcgttttcatgtagaactctggttgtcattccttatccggaactcctcctatatccgaaggtgcttccgtataggatatggtatatagtgggtcctgccgagatttagtcaactactattaggtatgtggtatccataaccctgacagtagcccccgacttcgatgcaaatgaacgagttcatattctcaaccgcagactttggaggaactgttatcgagctcatgtgaccgttctcggtgagtttagagataacgttagacttcctctatcagcctcgtgcgggcaccgaaagggtttgtctaagtcaatctctgatgtcgaccgagaaagtacagagcgtacgactaagtctcccgtcttgctgtaatcgagaatttggattgaagtcaagaaattttatctcggcgggtacaccatctcttcattccgtattcctcaacaatactcagaaaagaatagaattttcctgaaatcaatactcagaaaagaatattagatagaaataacccctgagcgaatgctcaaagggtgacatgttataatatgacagattagtgaattgaatgtacagaccagtgttttgtatatgagcgtcttctctcttaccgactccaatcagtcagtttgcagagtcatacactctcccttgcccctagccttgtcgtcggagaatcgttctcggatgacaaggctcttggacctttgacctgcctcggttgaacaagcactgatcctagcccccagccatgaagttggaaaactcaatttccgattacacggcttggttaatacgcacggcgagaactcttacactaccagatcttacatggtctttcgtctctgaaggatccgacaaggccttattggctctgggcgtccccagccgaagttcccttaggttcctcggaggccttgtcatgacagcgtaaagggacaatatgataggtttcaacgctaggtgtcttttgtgtaagggatctctgggtaaaacacttggcgatcttgtgtacctgatatcaactttgttggagtacaggtaatgggagaatcgctacaccgctggtcgaggaccaagcagtggtcgtaactcgaccacttaaagtggaagtagtgggagaatcgctacaccgctggtcgaggaccaggcagtagtcgtaactcgaccactagaagtggaaatagtgggagaatcgctacacagctggtcgagaaccaggcagtagtcgtaactcaaccactataagtaaatgtacgagagatcgctacgattgactggttgagaaccagtgagtaggtgtccctcgatcatttgaattcgtggtgcgaggaccgttgtgttattgctgtagtcgtacctcgaccatctaagattgcggtgcgagagattgctacgtactggttcgaggaccagcgaacgcgcagaatcatctctcgacactaatggaggttgcggtgcgagagattgctacgtactggtttgaggaccagcgaacgtgtagaatgatctctcgaacaccaatgaaggttgcggtgcgagagattgctacataccggttcgaggaccagcgagcgtgtagagttctctcgaacactaatggaggttgcggtgtgagagattgctacgtgctggttggagaaccagcgagcgagtagagttatctctcggacaccaatggaggttgtggtgcgagagattgctacgtactggttcgaggaccagcaaacgtgtagaattatctctcggacaccgatggaagcttgcggtgcgagagattgctatgtattggttcgaggaccagcgaacgtgtagaatgatctctcgaacaccaatggaagtgctagagttggtttattatgtgcgtctcatgtggccagcatgactcacgcacccaacttgtagcatatccggatgtccgttcacaatcatgtcaggtgatcaagccgacgacgttcgctaggaattatccgttaacaaccttttctcgagtagtccagcgatgcncaatgctatgagataggtcgtcggtcttcgttggtaggttgggcgcgacgactctgcatttgttgagatcgttctcgataatgtggtgtactcgaccacaacttactcgagtgctcaattgttcctgaaaaatattttctagagggcaggatatatagcagagaatatcgagtatgtactcaaaaaactgcatggatcttctagtattatcaggatataacgagcagatgtaaatgtcagggcattatgtaaaccgtaaacaagcatgatttatacagaagaagatagagcgagcccctagcgttagatcgtagtcgatttaacatcggggacacccgcgcaaccgatattattgtataaagaacatgctcttggaaaacataacaaatcatggatctgacaatactgtatgagctgaataggtacgataaattgcagataaaatattgcgtacctttgtagatacatgccggatgtatctacgaaattagtagatcaatttgaaaaaccaatctaccaattaccttattgcgtactcgttcgacatcatatgatctgacatcttttggtacgccgcgtatcttgaggcttgaatgatctcgatagaccaagttgtcaatgacgatgatggtcccgatctagtcggaagatgtacttggacaagttggatcttcccacagccgaagtcgtcgagtagcttgttgttggagaatccatcttttgaacccatctcgtcgaaatcctgaagcaccaaaatccccctacctagcacgccactgtcgacgtttgatgtcgcaattctggtatttgcatagtatggggatcgtcggtgctaggatatatgcgagactgaggtaaaagagatggagacagggatttttatacaggttcgggcccctgaattgtcaggtaataaccctacatcctgttggccgaagccggtattgctcttattcatgataatcacaccagtacaatatttagggtagcctatctaactgttatcgacatggcagtctgactcgtagtcgacaacagggtagcctttctcctcgcatccgtgcctggcaagatcagagatagcactttcgtctctcctgacagtattcggaagtcgtgcttatccctgaagtcgatatccggcggcgtgtcttggcgtatgtaggcttccatgttgtggcttctatgtcgattgtgttgagtgttgatcctccatggtgggtgccgatcgtgttgatcgtctcctctcccctctcctcctaagggggcttgtatttatacccattggcgtccccttgtccaagtagaactagggaaacaaatatggatacaatccgagtagtccttgtcgtttccatgtggaactctggttgtatatatccgaaggttgcttccgtataggatatggtattagtgggtcctgctgagatttagtcaactactattaggtatgtggtaaccataaccctgacacaattattaaccaggtgacaaagtataggtaatcaataacaaaatggctataacaaaggaaataggtcatttccacccgatgtattcaaaaataaatgcaatagttgaatagaaacaatagctttaaacaggattaacatgctccaagggttgtttgggatctgtgtgacttgccttgctagccttggaattcttcaaagtcttctcctgcaaaatcggactctccaagaacgtcggaatctaagcataaaagagtaaaatcaccaaaacagtacacaaacaatcataaacagcacatgtggatatttttaacatgtagatctcaattttagaacaatttagagacttgaaccaactaaatccgagctaagatgaattagttatgaatttttaaagattaaaccggattaaatcatttatatagattttaattggattatgatgcaataaagaattatttttgaaacggaaaaaggatttattgcgtcagcggggctcgggttcatggtggaccgagtgaacagaagcggtctacggaacgaacggctgagatctaatctaaacaaaacgaacggccgagatctaaccgacctaccacgggtctacggctgacgtggcgctgacgtcgacgatgatgtcattgccgacggcggctcggcaccacttgctcgccggcgaacgacggcgcggcggcgcaaacgaactgcacctacgggtagagggcgaagcggcgaactcaccgagggctttgacgatgacggacgacaaacgacggcgacggcggcgagggcgaggcagcgaagatgttcgggtcgacgacgacggcgatgctccggcaatcttcggtggaaacggagtacgggacgaggacggcgacgacttggtgatcccgacggcgaccttcccgagcgacgacgacgaccagagcggcggcggcgcacggctggacttgcggcggcgacgacggcgcacgggctgacgcggaggcggcgctacaagcgacggcgggcttgggtgaaggtggcggtgaacagaggaggtcctgaggatccttttataggggctagggggcggcagctaggcccatggcgtccggcggcggcttgtgcgcggctagggcgcggctggcggtgggagatggaagacgaccccgacaggtgggccccacccgccagcgggagagaagagggagagagggcggattggcttgatgggccgacttgggccgagcgcgagcaagccggagagagagagagagacttgggctgacttttggcccaaaaccaaaagaaggatttttaaacctttttccttttaaattattcatgaaatgcaattccatttattataattactttcttggctcaaataaatccgagaaaaatctaggaactaatcaagtgaagtatttgataaaattttatctagcccacttttatatttgaatttattacttaaaattagatcttttcttctaggcttttaaaatcatttctaataattccatttaaacaacaatttataaatttgggatttttaggatgtgacatctaagctaggtggaaagaaaagagaaagagaatctattcccatacttctaatatacatagtatacatacattctagttaactgatatactagctaataccctctatccgatgccctcctagtacttcgagaagccacccctgactgccgagttccttacgacagcccgtcatgaccatccaaccggggctaaatacggaggaataccctccccaggaaattaacttaggattatatataggcgcggaggaatactcgtagtgagctatcaccatcagcggctcacctcttatccgcaatatgtaaccccaaataatgatatcccgtaatctagacaccacgcctaaactaccagatactactctaatatcatcgtcatgacatagagtaattgcataagcaaacactatacccgcaccaaagcatctcccagattagctagccgtatattcagtataacatgaacataatgtaaagttggtactcatatactcagaaagtatttcaataccagaaatatatttagaagagtattcggataaaagtacaaagcttacaaaagaggaaaggaaagctactagagccatacccgaactcttccgaaggcttccggactcctgattcctattctaattctattccaccagctagataatactaaactaaacttgagaggaatgagagacctcttgcttgaggtgtgtgagtgcagtgagaaggtgaaatccttttatagctgaactatgacagttgtgacagttggaatggtcggtaataccctccaaccgtcattggggcttcatctccaccgtccagccaaaacctggggctggcccaacccagcccaatttcggctggcggcctcctctactgctttacttcgtagactagtgaattttggcctgattcatcgtgtcaagtctgcgttcttcgcccattcatacataagtatggttctcaacatcgtccgattgattcatcgtctgagttgatgtcgattctccttcactttattgtcattctctgcaaaaggttagtagacctaatactagtggaatattattattctaacatatttatgcattgcaagcatcactagttctctcctgttttagtaatattgacagtcgaaactgatcgataacgaccgtcgacaaaaatctccatcccaaacttttccagacaggcaatcaatcccgtccatctcccaaagagctaaatcggcactagcaacgttaattgacctgtcggctggcacgatctcaatcttgtcaccttgccattgaatcaagcactgatgcatggtcaaaggaatacatcaattagcgtgaatccaatcccttccaagcaataggctataagaacccttcccatcgatgacaaaaaatgttgtaggaacggtcttgctactgactgtcagctccacctttggtctccaatggattgccgccaaaatctttgagaaccatgtttgttttgataagatcatctgaatttctgcccagcttcctgaatgtagcctatggcatcaaatttacagcagccccactatcaaccatcatcttagacatcggcttcccattgacaaacccgttaacatacaatggcttgagatgccgattctctgtcccctctggtttctcaaaaattgcttgctctggcgacaaaaccaatctagcagaggcctcttcaacatcatcaacatcggcttatctggcgtcaaattctgcaggtaacataaacaccatgttcactgatgtagatgcgacattctttcctctagccaacctttttgctttgtcggcctcaacttcatcggctgttgcaatcttactcttgacacgccactcatgcctgggttttgtcttttttagccaatgattgatttcttgttctacctcctggaaacgctccctgctcctcatccgttgaaccctcctcttctgattcttcgtgaaaataccagaagagcaccattgcatcttcctatcctcgttctcatcttgatgacaatcttgattgaccggacccaacctctaatgaacaggaaccctcttatcactcagccgattgcttctatcataagatcggcttgaacttcctgcgttgtcattgcagccagggcaatcttcaattgacggcagcctcatcccctcattctagcaaaacctgaagaactcacaaccctaatgaggaccaaaaccaccatcatcttgctcgtagtacttctcctgttgcttatcatgccttttctgatatttattgatgatcttggctgaattcaactgagaacttcgagtttttcctccatcagctgctctgccagctgtgtgcaccatgttgacgagaaaaggaagtctctccaccttcatcggctttttagaatcatcaaacttgatctttcctccttcaatagccgtttggatctgctgcctaaagactttacaatcattggtagagtgggaatcagaattatgccacttgcaatacttccttttccctagctcttcagccgatggtattatgtggctagcaagaagttgtatctgcttctcccgaagtagcaagtcaaaaattttatcagctgtagtaatatcaatgtcatacctctcttcctttctagaactcggcagtccaccgggtaggtttgtttatccttcctttttcgagtgtcttcttggatagttatagtggccgataggcgcagaatctgatatggaaaacagtgctttctgataactaatcactggaagcacccgattctctctactctgtttcacctctctttcttttggcttcttcttgagaatattttcacgttggatgaagggatgggccctatgctttttgcattctagttcaatagtttctttttgatttacagatcaaacaaaagaaaaaacattacagaaactcaaacaaaataaaatcacacatataaggatacacgtgattgatcttcttgaaacttttcttagcctccgcaaacctttgctcatgcatggtcaaactttcaaactcctgcgatgaaaatttctccttgatcggagctatcaaaccctggaacgcgagatcggttaactgggaatctgtcaaagacaagctgtaacacttgttcctcatatctctgaacctctgtatgtaatcttgcacagtttcatcatgcctctgcctaaccgccgttaaatcagagagcttcatctgatgggtcccgttgtagaagtaactatggaattgtttctccaagtcgacccaaccttgaacagaattgcagggcaatgaagaaaaccgtgtgaatgctgatctggacaaagacagaggaaacaaccgaactcttaaagcatcgacagccgatgcttctccacattgagccaagaatcggctgacatgctcgtacatcgaaatgttgttttgccctgagaactttgaaaaatctagcactttgtatcggttcggcagtggaactctctcaaaccactcaggataagggtgctgatacaaatttccaatgtcttttggcttaagcccaaactgctccctcatcacatctgcaatcatatcggcccatggcttctactggggcactccttgcacttgttgctgtggtgatcctccttgctgatactgaatatgaaggaggctagtattgataattcaaattacccccctgataattctggaaatttggctgtatattatgcaccaaatgctcaggaataacttgggctacaaccgattgatttggttgtacactatgtaccaggtgctcaggaataacttgagccacattttgttgcctctgctgattatcaggtgttctcaggccaggtgatatctactgcaccgtctgctactgaatcggctaagccatctgttctcttggtggtgtctactgaattggtgctgactgtactggctcgacaatcggctgagttgttgggaacattgtagcagtctgctcctgagtcagccgattgatgttctgcccaacatgttgcggctggtctctagacaagagacgaggattaaccacctgcctttgagctgacgaaggtgcaaccggtgctggagcataaactgttgccgtcggctggactgatggtgcattggaagcatgctgctgatttcctatcaccaaattcctgtagtttgggaagacaccacctggtaggtagactggccccatgttctgatgctcagctatcgtgccatcaatgacaaatttgatcttattgttagtgtattgacaagcactccagattggttgatcaaggcatgttgtacggcataatcaacttggtcttggaaatttgtgcacctaggaggttcctcccgcacttcagtaccatcttcaccaagatcttcaaccacaccatcttgaagcccatcacctttatcgcccgagccatctgtagtacctttaccaccttgggatgaacttgttccaacttcatcggcagcaaccaccttcaccttgtacttttggataacttttccttgtcgggttgctgcaaacgattccatgaactgctcctgagcgctcttcatcatcagttcatactccttcttttgttctggtgataacttgtctacagtgactaggactcaaccccaattgaaggtagattagtccctggaggtttcggaagcttggtttgaggaggcactggcggcttgcctgttaatggcggtgattgcttttctgctgacattgttattacttgtcggtcccaccaggcatgccaaaagcgtgttgatgcgaaaaacgcacactggcctggaagatctgcttaacttcagtgcagatccaaaatcttgcttttagtttcgtgagcgtgccagttgatttgatcctgcaatcaacaagaaagaaagacaagaaaaaccgcggttaaatccataaacgatagccgatcggccagtcgccgatgacatatcatgtattttgaagccgatgtcatatgtgaatcgatcggcaattataagtaagcaaagtaagactaaatctactcgatcggctgtagatattaacgctatgtaatccttctgttgatgtatatttaaaccaagtgattgggatagatcggtcgccatgctgagacagtataaatcacttagatcgaagtatacattaacacaaagattataaatgcttatagcatagccaatcagatagatctagcatgtatcggctagtactccgataccactctatattaagatattagaacaagtagaatatatcaaacaagtagcttaatatactttattgcaataggatcttaatataaagggcagacttagcatatcaatcaagcacataacgtataaagtagctaaatcaggtaagatcggctgaaaccccgatactatctctcttgataatcataaaacatgctagatatcataattacagatattacttaatagatcgatctcaaccgatgcagcattaagcataaagacaaatataagatctaggcaagatgatgaaaaactctaagagatggtagatacacgatacaatctagattaataacagaacataaccctatcgattgttttctagcaataagaaccagtcgataacaagttatatctcatagatctcactccaaataagcttcatgatgctgaaatctggcttgttgtagcacatgcgactgaggaggagcgcatgcctacctggaagagctgtagcatctcctactttggggagtaaagaccacctgaagatagagtacaacactctataatatggacgcaaccctcgagtagtccccaaacaatccttgggagcatccttctcatacataaaggtagtgctggtcggtgacagagcatcctctacaaagatatgtggacgactcaggtcatcatcatctaaccccaaagctgcagcaaactgtgccatagaaaccctatactgctgcccctgaatggtccacttcacaaaatcaatccccttcttggtggtgccaaagaaagtagtggagtagaactgtccaatcacttcctcattccaggaatactgcaaggccaacaaatctgccacgtgcttgcgctcacacaccttgcgtacctcattgaagactatgttgttttttcaggacatgtactgccagtctagccacttcatgtctactactggatgagatcttcccatgatcacagagttataccaatcaacctgcaccaaggtcctgaatctgtcatcctgagagtcagctggcagagtatcaggactaaccattctgtcctttccacacttgagtagattcttcagatagttcactcttgtgcgtttaggatcaggatcaacagcccttgtcttgtacagcctcaaaggattgctttcagatccaggctcatcctcattgccaccatcatctgactcagatgcagctggagagggagagcggggtgcatcacgaatgacaatgctaccagccctcctggaatggatcggaatctgactcccactgtaaaaatctccaactttttctttgcccaatctccccctaggaccacgaaccagggggctcgagtcagcaggaacatcttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60964 - DNA, 1534 bp, Oryza sativa
agcaagacccctggctgtgcccagggcaatcctgtacctttggctccaacttagcaggctttcgtggcatctctcaccaaagaggtacttgtccaatgactcgttctccacatactcatataccaatagtctgtttgtcccttctgagcaaaacccccacatccttaccaaatttatgtgattgatcctcccaattagagtcacttctgcccagaattcctcctctccttgccgaacgtctgtaagcttctttactgccactattttcttatcttcaagtactcctctataaacaattccagccccacccctcccaagctcttctttgaattttccagtcgcttccttcaattctcggtatgtaaatcgcctgaactggtttgttatcatcttgtatccatcctccatggacttgggtatgttatgcttcttgaaaaaaaggtaccagcctgtcactattacaagcgactctagacctcccaatattgcagcaaaaacatagaagtatgcccactttatattgtccttctttgttccatacatacttgctgagcctagcatgatctcaggagcactgaggttgcaagtgagtctttgttgtttggagattgagggtgttgatttgcttgaattcttaggtactttcatgtagttgtctccggggaaatatgggtacacctgaccattgtagagtaagcctttagtgtaacataaaccatccccacccttgtatgtgaatgataagcaggagctgctgttcaagcaaatattctgacatgcttcaaatgagatggatttatttgatcccagatcgaagccatagaagtctgcatgaggctgtttgacgaacataaagtcctcatgtggtcttttgctatcgattgtaaacgttggttcacatcctttgttccaatctgttggatcaaccatcacatattctggaggacatctacatcttagacctcccgagtagtcacatatcccattcttgccgcatagcccatgaacataacacatctgtatcacggcctgccctgtgatagtccagttgcccgttgactcgttcaagctgtacattctaaaattgccatcataatcaattgtaatccttctcttgatcctaggacctgaatctgtagcctctatcttgaatccatcacttgacacaaaattaccctcatcatcaagaaatgctatcctggtgctgttaaatctagtacgcccatttttttcggcattataatctggacttggccagtagatgcttgtaatctctgggccgtcatataataggcgcaggacattatcgttatcaaagtagaggtgatgataacgagagactaaccttatgtttttggtcaggttctgccatggcagcaaggtatcggtcggtgagtcgaagctctgccacacagtactattgctggaatccttgattacaagattgccggtgtcaagaagggtaactgtagtatgcttgcctgaagatgtcttgctttcccacaccgtcgtgccgctggtatctgtgaggact

SEQ ID NO: 60965 - DNA, 5422 bp, Oryza sativa
  unsure (1)..(5422): unsure at all n locations
aggcaaaaaaactgttgggcatctccacggtgtacacattgcattgtcctactatattgcttgatttagactgcaagacggaatattgtcaacttcatgggggcatccatgtttctttcaatgtgtgaaagaggagtaccgatgaaaccgtgattttgtatattatatatatcagtttttcctcccttctgccccaagctaagttcttttacataagcaactagtgtatgaaagttaaaagtatctttaaagaagaactttatttgggagtaaaaagaggacaatttttggatgaatagtaatagagaaaatctattatatgccattaactttgtcacacttctacaatttaccactgactttatcacgttctacaatataccatcaactttcacttaacttctacgatttactattgccgtccggttagtctcagtgagtactgtacaaatttattgaaatgatcaaaatatccctgggaacaaaaactttcaaattttggacaaaaattctgaaatatcaaatttcatgttttagaccaaattttagatggttacaatcttatgtttataatatgatattttgaaatttttatccaaaatttgaaagtttttgtcgtaggggtattttggtcatttggacaaaattgtacagtgttaacggaggctaaccggacagcgatggtaaatcgtagaagttaagcaaaagtcgatggtatattgtagaatgtgacaaattcaatggtaaatcgtagacatgtgacaaagttagtggcatataatggattctctcatagtaatatggcactattcacctaaaatttatctcttttttttcctctcaaatgaagttgagtttgaacttgtgatttcgtgtgaatgtatgtgatgcctactgctaactccaatattttttttgatgaatttagagaacttttaggtatggttttcacttatgattttcactggatattttctcattatctacccaccagatctgtctctgatgtcatgtttaatatttatcaatttatgatggacaaaacaaatagtatggctgcatcgtatcgtaaaaagtttgtgtacgatcttattttgttcatgacctgaagtcgtcgtcatctctctctcaatatttaaaagtcatttctttggtatttgcccaatataagaagcgccccactgatagcaatttggatgacgaaatcaacgatattaatagtagtttggatcttgacatgatagcttgtggtttgatcaaacgactcttcgtttcagtttgcccattctatctttttatcttgcactaagtctcttctaaagcgcacacagtcatcagcacttaccaatttcgctttccgatttgatgtgtcattagctgatctttctctggtggcgagacattttacctggttttgacctgaccagctgatctcattctgcaggggaaaccatgcacttggtcatactagttctactgcccaaataatgcaaaactgcaagaattacccctcttggctactggctttgtttgacacaatggcacttacactctttcaggatttgatagtacataaccacaaatagtagacgcacatatgcatgtagctggcaatggcatcttcttgacctgccgctccaattgtaattccagtacagtctatagggaagttgaagtatcatattctatagactgtcttaatttaagactaattgcacaaattttgtacgacctagtggcctaagacttcacatcttgcctggtttttttttttttgtgcatctttcagcttctagaaccggctggcctgcgagcacaccagtagtgacttcacatctttaatctgctagtgctagttgtctgaaggtaagggttcatgctcaaccgctcaaactangacctgccatgcaagtgtcgtatttttcttctcacattcttgtaacataacatcagtgcttggacagcatcgaccaactggtctttcttctcccttgcccggtcttggatccatggatcgttttcctgcagctttctgatcgatgcaattaagcttgctttgccttcagctatcgtcagtgcttgactgaccatgcgagtataacgtagctgcctcttcctggtcaatatcgttacctgccatggacaaaatgtaaaatactccagaaaatccattatatatctatatgatacccacaaaaccttatttttgtggtgtactcctaatcttattgtatactccctccgtactcataaaggaagtcgtttaggacagcgacacggtttccaaaacacaactttgacttcttgtttctataaaaatatttattgaaaaatgatatatgtatatttttatgaaagtattttttaaaacaaatctattcatataatttttatattttcaaactcaacaacttgagagttattcatgatttatattctcaaggtttgacttaaacattgttctaaacgacttcctttatgagtacggagggaatatgtacaggatttgagctcttcttttcgcgaaaagagagaatttgagctcttttacagtgctccttggcattggcgttgcaagccatgggacctcactgggctgcaatgctgaagcttcttccctatctgaatagattgacctcagttgtagtgggcaatggtatcagagccagctttcggaaagatcgatggcttatacaaatgccactgcaagagaaattcccagctctattcaccccttccaggcaacaacaagcaacagtggcagtacatgcaaagaatattgttccgtctccaatttgcgcaaaatatgcagcttagcagatgaaacaacaagctacctctttcttcactgtccttttgcctctggtctatgggcttcactccacatcgatccaggtattgacgatgtaaaacaactccatgcattacaaccaccatcagtcatcccgacagcgcacttccgccccttctttctgctctgcctttggggactctggaaccaccgcgccatgatgccatcttcagaaaccaggagccttgtcatcgtcgcctcctccaacgatgtatcgaagacgcaactctctgggcacaccggttaaagagccaggatagaatcgttgtttccacctggaagcaagtactctcccaccccctaaattctgatcaaatggtgcaattggatctcaaatttattaggaagttcttcctctagaatcctcctaaatggatgccccggtaacccaattttacataagagaggtctaagacaaggagacccactttctcctatgctatttattctagctatggaaccactgcatctgatcttcaaagcagccgaggaagccttaattctcaagaaaatagatccgagacgacaaagatttcgttgttccttctacgcggacgacgtggctctcttcatccctccagaggcacaggaactaacaactgtaaagaacattctccacacttttgcaaggatcagcggcctccacacaaatccttccaaaacagaggttttcccgatagcttgtgataatctgaatgttgaaagccttctaaattcattcatggggaatttaaaaaccttcccatgcaattatctcggcataccccttcatacgagaaaactgaggaaaatagatctacagcctctagtagataaggtgggtgcaagaataccaggttggaagggaagattctttacttcagcaggaagggaagtgttagtgaaaacaacacttacggcaacaccaatttaccacctcacggtactgccacaaatgaaatgggttttcaagaaaattgatcgtttcagacgtgcctttctttggaagggagaggaccctgaaaatgtgaatgccggtagcagtttaattaattggcaagaggtatgtaaaccaaagaatttgggaggacttggtattttaaacttagaaaaatttgcaagagcattgcgcctccgttggctttggtataattggaaagatgatacaaaaccgagggtgaatatgtcagttccatgtgatgaaactgatagatgcctattcagagctgggacaaaaattgagatcggggatggaagaaaaacctctttctggttagacaattggttggatggccaaacacccaaggatctagctccgacaatttttaggcttgcaaagagaaaaagtaatagtctacatgctgatctgaacaacaatcattggctatctctgttaaatccaatcacttccttggaggaggtaaacgaccttgtccagctggggggaagacttcagaacatatccctacaagatggactggcggatgaaataatttggagatggactgaaaatggggtttactcagaaaagagtgcctatcttgcccagttccagggatcacacacaaacgttttttacgagcctctttggaccacatctgcagaaccaaagcatcgattttttggctggttagtcttacaccaacgaactcttaccgcggaaaatctgctgcgctgacactggccatgctgactggaatttagtagttctatgctaggtggggacctttcgaggtatgctcactacatgctagtctaaaatgagtgtcctcctttacgcacacttggttttgtgataccatgttcagttagtatggtcttgatctattcatagcactcacatctaactatacatttattctttcattgtaatgactggttggatgcactcctttgcaggtatcatagccttaaatcaagaaggaagcacattctgagtgtccttttaacaacatggtggaatatttggctagaacgtaataggaggattttccaaaattcttcaaaaagcgagctgcaggtggccttcctagttaaagagaatatagacctcatcaaccaatccaggctctattgctgctgatagaacctggtcctcaggcgttctttccttgggttgtaaatttaatcgcaggagctgtactgccctgttgttgttttcgtttatgcaccctctgtaagactctcttgatttatttcttctaatatatacggcaaatctcctgccgtttaatgtttcaaaaaaaaaattctgatcaaatgtaatagcaggccgctggcccttcttttgtttctgtttgtgtttgtatgaacatctctgctttaatttcaatggaaattcaggtggggaagctctcccctccggtgattattaaaaaaaaaaagagtattcagatcatcagatgtatatcaaaattttagagaaaaaggtatatacaatatgtaatacgcatgtgcatgaaaaaaaagggaaaaataaggctgtattcagaccaaaataaatataaaccaatctttcttagtttcttacactcttctgatcttctccaatggtctaattcgcacaagtttactcggcgccggcgtagacaa

SEQ ID NO: 60966 - DNA, 3479 bp, Oryza sativa
attgaagatttctctggaatgggccttatatgggcctagattctccctctcaaccaaagtgtggcctcagcagcccacatttattttccgacaattatcgggctcggcctcttcgcgccggatcgtctcactctcaccccttccatagtggccagctcggcctcgatccacatcgtcgttgttgcacacagcttcgatccacaccgccgccatcgttcatggctttgatccacgccgccgcaaacatccatagcttcgaagccaatagttaaccctgattttgtctgaactctgatttttctctgaacaattgagcaagatctgtctcctttggtatataataaaattccagcacatacatcactaaaacttgaaacatggaaaggctcatcctggtacttctgaatgttatttcatacagatgaaagcttacaaatgttaaaagttcgttgagcaataggtagtcaaatttctgttctgtgttttgttcataccgtaacctgctcacctgctgctagcttcataatacccaaatgttcagaaatggaattggcgctcgtcgattcgttaaaaaaaaaaaggaaaaacagatgttcagaagggaaaagaaattcaggtgtaatagaagggttttttgggtgaccccaaaattacaagtggaaaatatttgtaggggtaaagattaaccaaacatccaagcgtgcccttagcaatcagaaccgcatcctgggtaggggtggataaaaagcttgggctcgtgagctcagctcgggcttggctcgagctcacttagctcggctcggcttgaatgccaaacgagccaagcccaagtctccctttcagctcgtttctaaaacaagccgagcccgagctggctcgcgagccgcttgatttggctcgtgagcctaggccatcatgtatttatatggatgattttatcttctagtggagttattatttgttaatatgtaatttatcatctatattttgatgaattgaatatataaagttattttaattttacatgttgatgatttgttattgcttttcttaatgattacaaattatgtatcttcaacggaaggctcgcaagccagctcgagctggctcgagctaagaaataagccgagccgagctcatattttaactcgttttactaaccgagccgagccaagcctaacttgttgcgagccgagctaagcttgtcttggctcgtttccacccctaatattgggtgacatagaatgatggtgcaccatagtttcttacctaggacctgtttagatttcaactttttttcttcaaacttccaacttttccgttacatcaaactttcctacacacacaaacttccaacttttctgttccaatttcttcaaacttctaattttggcgtgtaactaaacacagccctagcgtagaagctctatgaagctccagtattaaattctagcatcggtcagtttaggcatgcacaagcacaagtggtatatcgtcagtaacaagaagacaaaggagcacaatcaatcactgaccacggatgaacatattggaccaatagctagtagtaaaccaatcatcagcacttcaaatcaaatggaatgttctatactaagcagctggttccttccaggaacatgaaaaattgaaaactctaaacactagcgacacgctcacggcggctcacccgtgacagatcctgacctctctcgcggagcactcgccgcctcgtcggcccttggaccggcatgaggaatccgactcactgctgaactttgaacagctccagctggttcattgagctgaaaatgttttggatgtttgtttagagatcccctcggaagtgttacaacctgcaaagatttatcgacgtaaaatcagcaagcataaatcataagccagctttaggaagcgtgatcacaatttgccggctacaccaatcaatttgggaacctataataacgggcacaactttagtgttcagtctacttttaatagccaattaaaaagaaaagataaaccatgtcagttcggctagcatcgccgcaatgatattggtaccacgactccacgagacagtgacaacacaatgatcaatgacaatacaataccgaactgcccggtcagacatggctacatgacttgcgcgtcactgtcaccctaacgatcagggcatttatcatgcaaattaccaaacgaattgtccacctctacaactggcaatcaacaagtcagcatcccaaacaatggcatggaatgaacatagccaatctttgctccaagtagacaaattactcccatatatagttatatactctagagtccatatagctagcagcaccaaacagaatgttttttttgggatacgcgagggacgcatctttgtattaaggaataaagtatttacagagcgggccgaaaaatcaaaaacacgaaggggacaagatacaggaggggggaggaggaagaaaataaaagcctaatctcccaacgaatgtggcgaccttccacccgacataggggtcgccatggccggtatcgcggctctagccaaccgccaaaggtctgcttcgcccgtcatggccctagcaatttccgcccatgtcctactcttttggttgaagacccgattgtttctttctttccaaatcgtccacgccaaacagaatgttggtattgagaaataatgaggcagctctcaaaaatgtgaaagctgtcatgaagattgtatgaccaagacaagaaacatgtcaaatatttaagctgcacgattagagaatgatggtaaaaacaaaagttcagaccttctaaaattagagagctttaaaagcagtaatatattcaatcactttcatatacctgaaagccgccaggactgaatgcaatgcgacaatgtcctgaaggagcacttaactattcccggtttactggtttaggcatgtagaatttgcagcatggattcaaatttgactccacgaaagaacctttgcaacaagtggatatcaaataaggatgaggcagagcatcataaatggaagcaaacaccttcctccataccatgatctgatggcctgaacacaaagaaaacaaaatggcaagattactctgtctagtcattcttcccttgatcagtgtactgccattctcatatgcttcacccctgttgatgctaagcaccggctcatccttatttgttgaagagcataagcaaaccttccttacctcaccaaacgccgatttctcttgtggcttctatgaagttggagggaatgctttctccttctccatctggttcaccaacagcaagaataggaccgtcgtatggtctgcaaaccccaagtccccggtaaatggccatggctctaaggtgacactgaaccatgaaggtaacctggtcctcgctgatgtcaatggcaccgcaaattgggacagcaagacgagctctggcaagggcacaacggctgtccttcttgacactg

SEQ ID NO: 60967 - DNA, 10207 bp, Oryza sativa
acttacatgaatcttgaaacaaatctaatagtttaaaattatatgaaagttacgtgtaggttatattacggttatatgcaagttccaatgtaattatattacgattatactataatttcatttgttaaatttttagaaaaacacttatcaacaaatatataacaaaattggcttagcgtgcaccgaggaagcgcatgagagatggagagaggcacgacgggcgcgatcggcagcgtgagcgcgctgggatgccataccgttctgaaatttgaaggaataaaaacactatttgtaattcagttctgctaaggtatatgatgatgtttgagcctcatcgtttgccttatagcatataaagttataagccaatgctaaaatttgaattttaatatttgattttgatgttttttcaaagattttcttttttagctttagcttttaagtcgctatgtcgaggagtgatcctctctagcgggagatcgtgagatccccttttgtgagttcggccgggggaaaaggctcgcttgtcgagatcgtgtatccgccctgagggtttctagatcgcgtacgggcgccaagattatacaggttcgggccgttgtggagcgtaataccctactcctgtgtgtgggatttatggttgagtgttacaaaggttcctaaactccggagagtactctcgctcttctcctcctagagttcaggcctactgagcgtcgtcccttttctcggtgggcaaggtcctccttttatagttcaaggggataccacatgcaccgcttctacctactctttcacgggagggggatccactttaccttgaccggaccacgatccgtgtcttcgcccggaagctaagcggcagtccgtccttgagtgggacacagcgccgccccccacctgacacgggggacagccgtgtcattccgtcttaaatggatgaagacttgtggcggtccttctcacgtggagggagctccggatgatacttcgatgggacggggcatacctgcctccactccgctgggtacaggggcgagtgtgggggcacggccgcccgtccgatcggacgtgaccggcgacaggccagtcacagtttggtcacgcctgattgacgtgagtcaaacgggccccaccgcacgtccgcccttaccgcattaaatgcggtgagggacagttggggcggcgcgcattgatggtggttcagtctgagtctcctccccgctcgctcccctcgccacatggcagttgagcgagggcctcagggcgaggcagcgcgagggcccgaggggtgtgacgtggcacccgaggctccctggctgcctctgggtcttccgaggcgcggggggagggccaagctgtagggccacgtggctggatcaggaggtaactcccccgcacttcgcataccccgagccatatcaccgacacgctaagtacacatatataaaagttttactcataaatcttttttatcactaataagccgtaatggtttttaatcagccgtatgcaaccgatgggacctttgtttcaaagaattctgggagtgcttttcttttttttttcttttttttttcagtcaactgattgcttaatatttggggaggagctcaatactgactatagtacttctactgagtatactcgatttgaagtcttaactacaatttttcggaatttcataatccttaaatttgaaattcaagtgctgaattaaactcacagctgactgctgctctaagctgaactatgctaacggttagcctggtgatgatcatgaccggtaagcggggtgttcgtcctcgtcatcgaacgccgtgagagccttggcgatgtcgtccatggtcggcctgctgttcctgtcctccatacacgccagagaaatcctcaccatctccatggcctgacgagggttgaactgcccctgcagcctggcatcaactagagacctcacatcgccactgtccagcacatgcctcagcgcctgcgcgatctgcggcagctgcagccgctcgccggcttccgtcctctggtccgccacccggctcccgaccacgatctccagcagcacaatgccgaagctgtacacgtccaccttggcgttgatgggcacgttcagcgcccactccggcgccatgtaccccgacgtccccctcatgtgggtgagctccacgccggcgccgccgtcccgcttcgacagcttggccagcccgaagtcggcgatcttggcgtcgaagtccctcgtcaggaggatgttctccggcttcatgtcgcagtggatgacccactcgaggcactcgtggtggaggtaggcgaggcccctcgccgtgcccagcgcgatcttgtaccgatctttccacgccagcgtcgtcgtcgacatgccgccgccgccttcggccgtgtcgaacaggtgccggtccagcgactggttctccacgtactcgtacaccagcagcttgtgcttgcgctcggagcagaatccccaaatcctcacaaggttcatatggttgatccgcccgagcaccgtcatctcggcccagaactcctcgtccccctgcatcgtcacgtcgaccgccagcctcttcacggccaccaccttaccgccgtcgagcacgccgcggtacaccacgccggagccgccgcggccgagctcctccttgaagttggccgtcacgtccttgagctcccggtacgtgaaccgcctgaactggctcgtcatcaccctcctgtaccctgcctccagcgagctggggatgctctgcttgctggacaggaaccaccaccctgtcgcgatgaagaggaggtccaggacaccgagcacaccggcgaacacaaacaggtaggtccacttcccgctgtttcttggagccatcccgtacacggcagcgggcactgtcacgatggagacgttgggattgcacgtgaggccggcggcgctccgcgcgctgaccaatggcgacgattcgtcgaagtcgatggacaccttgaggtagatgttccccgggaaattcgccgacgtgtagccgttgaaaagcctgcctttcgtgaagcatctgccgacgccgtcgaacctgtaggagaaggcgacgcactggcaatcgctcaggcactggttcctgcatagctcgaatgttatcgaggacccgttgaacatcaggtcgtagccgtagaaatcggtttggggcaccaccacagacttgaaccgctcaggcgccgccggctggctgcagttgccgacggagaacatcggctggcagcctttcctccagtcccggcggtcgatcatctcgtaccctggcgggcacgagcaccggaggctcggcaggtacacgcagaggccgttcttgccgcacagcccgtgagcttggcacggctggctgagcgccgcccatgtcaccgcccaacctccggtggacgcgttcaggctgtatattctcaggttgccgtcctgctcgatggtgagccgcctcttgacgccgacgcccatgtcggaggcctgggcttgcagcctgtcggaggagcggaagacgccggcgtcgtcgaggatggcgatcctcgagctgttgtagtttgtccggccgaagtcgaaaatgctcacccccggcaacggccagtagatgctggcgatctccgggccatcgtagagcatgcgcagcacgttgtcgttgtcgtagtagaggctgaagtagccggcgacgagcttggtgtccttggtgaaccgctgcgacgggagcagcgtgtccgtcggccagtcgaagctctgccacacggcgcggccggtcgacgggtcctcgatgacgaggttcccggtgtcgcggagggagacggtcaggccccgcccgccgccgcccgtccggctcgcccacaccgtggtcccgttggtgtcggcgagggccagctcgccgtcgtggcggaacgagatcgtcgagcccctgccgttcacgggggcgtcggggttggccgtccagacgacggcgccgtccctggcggcggtgaaccatacggagaaggagaaggcgttgtcgccgtcgtcgccggcctgaatgaagccgcaggagaaggtgccgtccggcgacaccaggaacggccgcgaccggtccgccaccgacagggaggagccggtgccgagcgtgtgctgcgccgtcgacgcggacgagcacagcagcagagacgccagcgagagctgcacggccaggcagccgatgaccaatccagccatcgtttcagctcgctgtttggttcattggttgaactacggtctacaaaggcaaagaaaattatgggacaaagtgtataaaagatgatcaagcaaccaacgttcaacgcaatcattatgcaaatcaaagtacgggtagtattcttgatttggacatacgcagccgtaagcgacaggataatggcgctttgtctgacaatcactttgatatttcatcagtttacgattgtcattattgctggtcttcagtcctcaactagtcgtggccgtcactagtgctatgccgatttgatatgaccgttttcgttcgtgaagggaaattcctcttgagtaataatcacaaaaggaacatttgtccattggcaagacccagagcacacgctggttttgatttcacttttagctgggtacttcctgtgtacatgatcgatttcgtctacgagtcttgagttggactcgaatcaattggttggcaaatcgcatatatgcatgataaagctcttaaaatatggtggctagctgtatgtgggttggccgagactagcaaattagccggacaaaactactcctcaattaagcatggaagttgtattccttcaaaaaaaaaaaagcatggaagttggcacgttcgatagagtttagataatcatatcgcacatgagaaattgatgacgctcgagggttctgactgtcacttgcttgcaattatttggtacagcaagggggtcctgcaacgcatgcgtacgtagactatgaattagatggatgcgttgaatcgcctttctgataaccacttgctttttttattattactttaaaataaactgttttgatatcttctgtccgatagtgacagcaagagtccgtggtagtggatttccaaagtacataaggatcgataagtcatactttcgattttagatgataagacacataatcaaatactacgaatctgtctacattttagtactacgaatttaaacagactaacaccttcaatcttactctctccgtcaaatttaaaaccgatataatattggatgtgacacatcttagtaatacaaatctggacatatctttgtccagatacatgtattataatgtaatatgtcatatccagtgctaaattcatctttctttggacgaagggagtatgattttgaaaacacgacaacattgtagaaatggtgtaggatcgtaaagggcctttcccaccccaaaagctagacattgaggtgaggggctcccccacttatatcttaggtcatttgcccttccacaactaatgtgggactattcaacaatctcccccttcacacattggtgtccctcagcccttcaccgccccttcaccgtgtatagaccccaccggcccacggtccatcaggtatacgggccccgcaggtacccacggtccatcaggccttcacacgtgtccatcgggccagagatgttaacctagccaggctctgataccaattgtaggatcgtaaagggcctttcccaccccaaaagctccattgaggtgaggggctcccccacttatattttaggtcatttgcccttccacaaccaatgtgggactatttaacaaatgtgtttggatggagagaaaaaagtaggaatcaaaataaagatagatgcaaaggatttttttttcaagaggttgaaactcacgtcaaaattcctacaaaatttctctgttttgagctaattcaaagaaatttcataggatttttggatagctatttctttaatccaaatgatcaaacaaaaagtttctataagaataaattcctctataatttgtttaaaaatctgttgttctaaggagccttaaaatagagttgcgtgatgatagaacgtacggttttggtccacagaagacgtcagagtacatctaaaatcgtgcgagggagtatcgagccaaactcgagctgcattaggggcgaagtgaattgctctctttgttttaatcaataaacgacttttgctagcagtatttatcaatcaccaaatatttttatatcagttttgttaaaacataaaaaagaagaaaatgaattaaagtgaaagtataaactaaaagtgggtctaatacgaaacatcgatgtgaaaatcggatgcgtgcaacgcatgcgtgcgtagactagatggatgcgttgaatcgcctttctgataaccacttgctgaaataaactgttttgatatcttctgtccgatagtgacagcaagagtccgtggtagtggatttccaaaatacatagtaatacataaggatcgatgtgtcatactttcgattttagatgataaggcacacgttctaatactatgaatttgtctacattacgaatctagacaggctaatactttacattttattcccttagtcccataaaaaattaatctagtattgaatataatgtatcttattaccacgaatctggacatatctctctccaaattcattgtaatataatatgtcacatccagtcctagattttctttttttaacgaagggagtatgattttgaaaaacatgagaaaactgtagaaatggttgtttggatgaagagaaaaggtaggaatcaaaataaagacagatgcaaaggattttttttcgagaggttgaagcccatgtcagaattcctacaaaaattctatgttttgagccaattcaaagaaatttcataggatttttggatagctatttctttaatccaaatgatcaaacaaaaagtttctataagaataaattcctctaaaatttgtttaaaaatctgttgttctaaggagccttaaaatagagttgcgtgaagatagaacgcatggttttggtccacaaaagacgtcagagtacatctaaaatcgtgcgagggagtatcgagccaaactcgagctacattaggggcgaagtgaattgctctctttgttttaatcaataaaccacttttgctagtagtatttatcaatcaccaaatatttttatatcagttttgttaaaacataaaaaagaagaaaatgaattaaagtgaaagtataaactaaaagtgggtctaatacgaaacatcgatgtgaaaattgggttcaaaatggaaaaacaattctgccccaatcagggtgttcaggattggtgggaaatgatagccaacaagaaggaagtgcccaaaaaagacctgcggtcggaaggagcgtaacaggagaatctttgaacacaaagagatgacggccccagcctaatggcaaaaataaaagaagaggcacgagcttggacaatggccagtgcaaagattaatttcgccttgtacagtttcttttttctcctttcacccataggggtagtacttttttacctctctattcaatgatatagcacagtctgtgctgattcctttcaaaaaaaaaaaaaacaattctgcctcttaagagaatatctcctcattatttgcaatcatttggacagtaaaaagaatcttaggaaatatcacagcatagatctttgtggtatatactccctccgtcccaaaaaaggcaaaccctaggtttccgtgtccaacgtttgaccgttcgtcttatttgaaaagtataaaaaaaattaaaaagataagttacacataaattattaatcatgttttatcatctaacaacaatgaaaatactaattataaaaaaaatttcatataagacggacagtcaaatgttagacacggaaaccccgttttgtctttttttttgagacagatggagtatgtatcactttacatacatggaagtttgaattcgattaagttaagaagaaacaaatctaaccgtggatagtgctcgtgaaacttaaaggttagtttgttattttgtttatcaatttgtagatcagttgagctcaaaattatctttttggaggaataataaacgactgtcgtatcaatcttagcaaaaaaaaatttcagattttttttaagcatttgatttatatttgacaggttagaataaacgagggtatgtcgtcaaggatgattaatgaactccgtccaaattgaaattcaaactattttttttattttatgtagccaaagagatactaccttctgtccaaaataaatacagttttgcactgtttatattcaacgtttgaccgtccattttaattgaaatttttttatgattaatatttttattattattagatgataaaatataaataatattttatgtgtgactaatttttaaaataggttttttataaaacttttaaataagacggatggttaaatgctaaataccaaacaccatggttccacttaatttaatttagaacggaggtagcataagagaagcagaagtatcaccaatcgcagcaatggaggtctttttcaacagctagcgtgacaagttggagggtaggaagtcatttttctacgggtgggggtgtgaactgtgaagtcttggaagagaatgagcagaacaaagcgttaggccgtgttagttccattttaattttttttaagtatacggatacacatttgaagtattaaatgtagactaataacaaaataaattacagattatgtctgtaaactgcgttacaaatctattaagcctaattaatctatcattagcaaatatttactgtagcaccacattgtcaaatcatggcgtaattaggctcaaaagattcgtctcgtaatttacatgcaaactgtgcaattgttttttcgtccagctttatactccatacatgtgtccaaaacatttgatgtgacgaaaaaattaaaagtttaaagagaactaaacgtaaccttagttatcttgattggatatacttccacccacaatatcgcaacccttttcctttatatggtcaacgcctacacgtgaattgcacgtgccagtgagtacgagttagttaacaatactagttaattactactaaactacctggctttgcaactacaaatatatttaccttcataatattttcttagtaatgaaactgaacaacgaaatcatccgacctatccacttacactaactaaggaagaaaagaacacataaattaacatatcatttgtttctgtgacagtgtgttcaactacaatcaggagaacgctaggaatataacaccctccaaaacatcgaattcaagaaggaataatcatttgtctaccaatgtcgctcaagccatgctaaaaagtcaattctagacttcccttcaaagacaactctaagacgcgacaccatagaaaagaatcgacaaacaaataccgacattattatttttcaaaaaaataatacatgactttacccccccccccctccgggtgatatcattaattgccaagaattccatacattcttccatgatcaaagaaagctcactgggtacaacaggtgcaactgatgactgcctccaaccagaagagcagccagaaaagaacatgactgcctccaaccagaagagcagccagaaaagaaccactccgatcggtcgtgaccaccaagtcatcttgaaattcatcaattggatcagaacagccacgaccgattatatataaaatgtgttatttataaatttgatagtatcctgattttatgattgtatctcgattatatgatatgacaaataaaaaaaatactatatctaatatgttgatattgattaccttgtagcacctacttgacaaagcgtcgtcctcactaatccgccttcactgttctctgttcaggaagataagtcatacataatgtattatttatgttttatcatctaacaaaaaaaaatactaatcataaaataaatttatataagatgaacggtcaaacattggataaaaaacctaagaattaagtcctttttttttctgagacggagggagcacggaggaggcgcgctgcacgcctgcacccccggcggccgggttccaccaattttttttgttccgcaaccaatggtagcggttcaaggcttgctaactttaaactgccgatctg

SEQ ID NO: 60968 - DNA, 2091 bp, Oryza sativa
cttgggcgcagggggaatgggggatgagcatgtttgtaccccccttcgcggtcccagccggccaccgtctcgccggccaggttgacggcgctggctcttgttcgtcgaggtgacgcctccctctttctcttcgctgttatgcaatgctctgaccgacgcgtggttttgctctggatcattgctgcatttggttactgagagggcagcattagcagctttggttactagaaattgaaataacaaatttaccctgctctaagagatcgggacgagaacttttagataaaatgcagtaatcttgaatctataggagtataggttattaatagttcattgaaaagccacaggaacgtgtagggaagctctttttagttaattatccttttctctgtaccattacctttgttctacatttgagcaaatctccctgtcccaatcactttcatatagctgagaacaaggaaatctggtaacatgaagaactgatttgctataacttacttccgtttcaggttataagactttctagcattgcccacattcatgtagatgttaatgaatctatgcacacatatatgtttagattcattaacatatatatatgaatgtggttaatgctaaaaagtcttataatatgaaacaaagatagtaaatgaatcttttttttttctgaaaacaagtggtgtggtaacagaaagaggaaccatcaggctgtgaattatatagaacttgggaactaactggaaaaagataattaaagagaattcttaatctacaaacatacatcattcgtaaatactactttctccatttcatattataagactttctagcattgcccacattcatatatatgttaatgaatctagatatatatgtgtgcctagattcattaatatctatatgaatgtgggcaatgctaaaaagtcttatacctgaaacagaggtagtaatagcattcattggcatgaacaagttgtaagttggcttgtgctactttttacatccctgactcttgaatggtccttttgcttcgcctttatacttttgaagtaacatttgattaattcgatgagactggtttgcatttatgtgttacatactattctgtgcagtcagcatacttgtcttcatcaccacatgccatcagagctttggtaatttcatccattgttggcctctttgtcctttctcctatgcatgataaggaaatcttcaccatttccatggcctggagatggttaaattgtccatgcagcttagcatccactatgtgtgtaacatctccacaagctacaacttgctttagtgcttccacaatttgtgtcaaatccagtttctccccttctgttgttgtctgactagaaatcctagctcccatcacaatttcaagaagcacaattccatagctaaaaacatcaacctttgcgttaatgggcaaattcaacgcccattcaggagccatgtatcctactgttcctctcatatgggataattgcaaacaagagcaatcccttttggatagcttcgctaggccaaagtctgctattttaacttcaaagtcctgggtcaagagtatgttttctggcttcacatcacaatgaacaacccactcaaggcactcatggtggaggtatgccaagccccttgctgttcccaatgcgatggtgaacctctggttccatcgaagtaatttttttgcatctatgctctcaaagagatgcttgtccagtgactcattctccacataatcataaaccaatagtttatgtttgccttctgagcaatagccccaagtccttaccaaattaacatgatttatcctgccaatcacacttatttctgattgaaactcctcttcagcttctgttgcatttgttaatcttttcactgtcacaactttctttctgtcaagtacgcctctataaacaactccagaaccacctcttccaagctcttccttaaaatttcctgtagcctccttcaattctctgtatgagaatttcctgaagtgctcagtcatcaattcataaccatccatcactgactttggaatattctgtttgcttcgaagaaataaacaagctgttg

SEQ ID NO: 60969 - DNA, 1435 bp, Oryza sativa
gcaggttcgtgagggttcacggccttgtttaataatactgtgtagctctaggatcgtctttataaaatggctttgggcaactaagtgacttttaaaggctgttactgcaaaacttaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttccctgtcgcgacacctagctccgcctcccagctcccgtattgaaggcggagggtgtcctgcgcctcgttcatcacggtggtggcaatgagggcagccccccgctcctcctccacttccttggcgatttccgccaacaccttctttcgggcttcaagctccgaaacgtgccggcggtgtgccttgcggcccacctccaccatggcctccactgagcgccgcccctcctcgacacgcgcccacgcggcgtcgagctccgcccgctctgcttgcagggcctccacctgggcattaaacccgtccaacaccgcggtgtttgcggcggccaaggccagcagaaggggctctgcgctcagcggggcgatagaaggcgcggggaagagccgccttggagaggatgccgcgcggctcgggccgccgatggaagtgccggactcggggatgtcccctggacctagttggtcctgggtgtcgcccgagggagtgggcccaggcgacgcgcctgcagcctcgtcgccagctgccccggaagttgtcgcctgagcgtcgcctgagggagtgggcccaagcgatgcgcccgcgacctcgtcgcgagctgcctcggaagtcgccattgcctcgtcctggcgaaatccggctttctcccgagcggcttcctcggcctggtgggctcgggcggcctcctcccgagcggcttcctcggcctggcgggcccgggcggcctcctcccgagcggtttcctcggcctggcgggcccgggcggcctcctcccgagcggtttcctcggcctgacgagcccgggcggcctcctgggcggcctcctcggcttcccgtaggcgatccgcggccactcgccggtcagattcccgcctccgggcctctgcggccgccggatcctcggcctcagattggccagacttggaatgacgggagggacgcgacgggatctcgctt

SEQ ID NO: 60970 - DNA, 9242 bp, Oryza sativa
gggtgagagacgaacctgcgagggggtcggttgaaagaccactttggaggggagatgaggtttccccgagatggttctgtctcccccatcttgcggagccgtttcttcttgtgctccccctcgggctgcgatgtcggcgcggccccctccgggcgcctgctgctggcacgtaccgccccgccccctcggggaggagattggggaggtgttcctccctgtttcctcttcccccgggcgtcggcagggcggctgctccccgggtctccgtcgcgagacccagaagcacgaccccctcccggggtagattgatcccccttgcggctcccgcctgcgccgtcgtggccctttggagctccctcctctgaggccccgaccgccgtcataatggtcaagatggaggcgcggtctggatcgctgcagagggggaggattccgtggggaatgagggacgcctccacggagttgagattcagcacccgttggaccactatcttgaagtcctcaggagcccagtcccatctgactccctggtggatcctcatgtagtcttcggacccggtgtactcccaggcgccccgagcgcgccgctggagcggcgcaatccgacgacggaggtagtcaccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggggtgtagaaccagtcgctcttccagtcatcccacttcttgcggaggacgcaggggatgtagcggttcaacaccggcccccgcggcaggaagtagcagccaccgaccaccgacggcggcgacaccgactgcacggtgaagaaccaccggaacagccgaagagatgggcgcaccccaatgaacatctcgcacaggtgcgcgaagatggctaatgtcatcactgcgttgggggtaaggtgcgccatctggagatcgtagaactccaggacatccatgaagaaagaagaaaatggcggaaccagccctgccattgcaaaggggagaaagaagacggaccgccccgggtagtctggcgccgggcgtccctcgcccagcatgactatctcccggccggtggcagattccggcatgaagcggcgcggcagcccagcctgcctctcgctcacgatgcgggaaggcggcaacacgctaccatcgagcagagcggagccccgtgccatggcgccggacgaagagaagatggagagcgagcgcgtgtggcgaaagaagggcgcaggaaagaaggagttagggcgcaagcggcgaagacaaggggaatgatggcgaaaggaaggaaacaaatcctctcctcagtgcctttatactcttgccaatgctgtgcccggctcctcgtttctcgcacccaccgtttcgccccctcgtttctcgcgcccacacctccactaatcccattcgcccgcttgcggcgcgtgaggtggatatgcggttgtggcagtcgagatagatcatttcgtgcgcgcgttgattacgctcgccgaccgaagcgccatcacatatctcctggcaaagcgaatcggctcgtccagattcgtgtactactcgagtaatgtggcagtctggaagagaccgctcattactgacagccgagttaccattgccgatgtgcgtagtttgtgaccgttgggtttctgcctaattgtagagaccggtcccacttgtcaccaggctttaggggtggcgtcacgcccgaccgcttcccttgaaaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggtcggaccactcctgcctcgcccccgagggccgaggcgccccgacccctcgcgggttctactccgcgtgtatgggttaggtgagcacagcggggctcacctaaccgcatttattgcggctcggctaaacgtgtcacgccgcacgaaatgcagtgcagtgcactcgtttatccggtctgtgaccagtcacagaccggtcagatcgcgggttaggtggcaacaggcggtctgacgcacgcttcgccccatcccgtcaagacgagagcttctaggcactcgtccccagctggagctagcgtgttacctcccagagatggcacgttagccccggtcggatatatgccaggcttcatcctaaccattacaagcaagatgttgtgtgaagaagggcaaacatgcacgttgctaagctgacgcgtggtggacaagaatgaccgatttgtgaccggtctgacactgatcatgccgtcagcagacagccacgttcccacgacgcgcctgcctccggcagaagtggaggtaggtatgtgccgtcccgtcagaaggatgttcggagggcaaccgtgcaaatctccgtccatttatgaagagaagaaaagtccagtttggaaaggggggggtgcatgtggtatccccttgaaatataaaaggaggaccttgcccattgagaagaggggatttttctccagattcggaacctagaacaagggagaggttggctcacactttgtagctccttcatacacagatccaccaaaacacaggagtagggtattacgcttctcagcggcccgaacctgtatacatcgcctgtgcctcatgctctttcgataggtcgcgatctttccacatacagagagagcttgggatttcaccctgagcccccggccgaaccggcaaagggggggcctgtgcggtctcccggtgaggagccccacgctccgtcaaatatttttatataaatatacactatactattagtacttggcgcatctctcatacacatataatatcttatagctcgtgttaaagttggctacaaatatataacccgtttttttctccctcctctcctctacgtatgtctgtagctagctagcttagctaccttataacttgctattgtacctgctctaactatatatatagtcccaacccaccacataagagcaagtttaatagtatagttaaccactagcttcaaattatctataatcaatttaatagccaattcatacaatagttatatactctattaatacctgatcccacttatcatacacacactgcgtcttggagtccgtgctacagttggctacaaatttgtagcccgctgctcttctctttttttttatcttcttaaaatatatttatagctagcttatagcttactattgtatttgctctaagctggtgtctatggaatttattaggatgccacctaataaaaatttgatgtgacatggtaattaaagaaggaagagaaggaaaaagagaaaatgatgtggcaagcaccaaaccggatcgccgtgtgcatcaaggccctggaaagtagcaaaatcagcgttggggttgattaattgtttcttccccgacacatctatctatctattatattattaagacagctcgaaaaaaagacaccacgttcactgtggaggctagaaattcccatattaatggaagaaaaagaaaaaaagagttcaagtagaaatacaatctaaaaaataactgaaattcggaattaaaaataagtaatatttaaagaggagtccatataagaacctaatacgtgattaattaaaattcagaataataaataaataaatttctgaaattaaaaaaaagaaaaaaaagagagttcaagtagaaatacaaatttgaaattattaaaagaataatggtctagatttactgtataaaagataatcatatcaatctaattatagatcatacaatccgtactaggagtccttgtccatttagaaaaatcaattgcaaaactatacagtatatagagttatgattctaaaccaacatacattgccgcacatatatatatatagggtggagataccagaccagcacgttaggctgcagcagcagaaaaataatatagtgccctcatttcatacaagtctacgaacccaatacgagattaattaaaatttgaaatgaaaaacaaaataaaatccgaaattagaaataagaaaataaaagaagagttcaacttggaatgcgatttaaaaataactgaaattcgtaataaaaaataaagactatttaaagaatacaccatctagaacacataacgaaattaattaaaattccgaataattaataaaataaattctgaaaatagaataaaacaactaggaatataatttataaataaaatctatcggaacgaaaaatatggaaatttcaaaaaaaaaacatctagaacacaacgatgataaatgacaataaatatcggagaagcaacgaggcagggagtagagtggtgacagctgatgggatatctaaaaaactattaacaaaaccccaaatagaatctcaatgacaattaaaaagagtgatgacggacaggccgttaagcagcacggtcacgacggttagcgggatttctaaaaaagtaaaaaaataaacctcaatgataatcatgttcgattttaaaatttcaaatataataaagagtgggaggaagcgggcgagccatagagtagtacagtggcaaagccactaacggtttggtgggactctagaaagtaaaaaattaaactcaaacgatgattatatttgatttttaaaatcccaatgacaataaagagaggaagcaactgtagcacccgtattttatttgcttttattttaaaaaaaaagcttgtcatttaaaaattggagttaatttggttcttagatgattttgtgccaaatggatctcaaatcctctcttagaattgcctttcaaattcctgtgaaactctaggtcaaattcaaattcaaatcccttcaaattctcctcaaaattcaactctataaatccctgggaaaatgtgaaatatcactgttcatattgggcctccttcccttccctctctctcggcccaactctcctccacctctcctctcttctttcccctgagcaggccggcccagcgcagcccatttctgctcatcgtccccttccttgagccagccagtgcatgcacacaaggtgttcgacgaaataccgacccgagtcgctgcaccgttccgccctcgttcccgtaccgcgttgcaccataccaccctcccgtgcgccccacaacgtgccagggccacgtagcgccgccccgcacgccgcgccaaagccgcatcgcgccaaactccacgaaaaccgccgcgccctctccgggagacacggagccacgtcgccccgcgtcacccccgtctcgtcgccgttccatcccgagctctcgcggacgcgcgtcccttcgctgtcgcccgtcgtcttgtcgtctgtctcctcccgggaagccgccgagctcgcgcctccctctcactcgcgttccatcgccaccaccgtgtgacgtcgctcgcgtcgcatcgatctgagaaccctaccacccaaatcccggccgtagccgccgtcggccgcgcgtcatcgatgtcccgtcgcctttcccgctctccgcgcgtcacttcgtgtcgcgtcgccgtcgttttcaccgtcgagtcaccaccggtgcatgacgccaagccatcgcgtcgccatctcgtccaccccggaatcccgccctagccgctagccagctacccccggagctccgcgtctagaccgccagctcgccaccgcgccgcttgcctataaaaggggaagcagcccgagctccttctccccacaccatcaccatctctccccatctctctctcctctctctttctctcgttttgctctctgttgctgccagccagagccgccgcgctattctcccggcgccgccgtcgccggtggagcctcgccggagttctccgccgccctccctcagccgccggtcgcctcgccgcgccccatcgccgagacgcatcgctatcccagaccgagccgagcaaaagagcgagaggaggaagaagcaggcctcctcaagcctctgccaagccggccccaccttcctttattccttcctgccactgacgagcagggcccgtgtgccttttcctctctagcagccaccgacaggtgggcccctcccttttcctttttttaagtcaatttccaacattccagaaaatcctttattctttgaaaattcatagtaaatcaaccgtaactccgattgaccccgttcaagttcctaaattttttataaaattgagatctacacagtggcaccattgtttctctgatttgagctagttttattgccttttcttagttagttttatttttcgcgtttagagcccgagttcgaggaagctccggacgccgctttcgaaggagaagaccccaacgctgtgcaaggcaagcccctttgatcacattgcccctatattttcaatgatatgttgtttgcaaagatgcattgttagttcacacgattaacatgtttaggcctcggattgtttatacaaccgacggaccaacccagtagtcgcacttatattacataggttgatgtttccataccattgatagctccacaaatatttgcgccggtatcattattcgattaccgaggtagtttcgcttagccatgcttacgttgttgccgtgtgggaaacttgggttattccaaatccatgtttaaaaaaaatccggtatgttgtaccgaggaattgtgaaataaaatgtgttgtgaaagtggtgatgatgcggagtcatgcctttgtggtttggctacgtattgtcgttaaggaccgattcctttgggaaatccatccaaacacgttacagtgcgaccacacgggtatttatgggatgcctctggctaagtaaattgttttcacatgggagttggtgtgccgatggttgtggaatgccgaggatgaggagacgaagtgttacacatttttgcccatcatgggtgtcttttgcctctattgtggcgtggtaccggtaggagtaggaggcatcctcggtatttcctgagtggatgacggctgtcattgcctgatacttggctatggatcttagcccaactaggtggcatgcggttttcatgggttagctttggaaaggccttatcacgaactttcattgccgacgggtaaacgatgtcagtttcgtgtcgtgtgggtaaagcgtgcaacctctgcagagattaatgaactgttcgaacagccgtgcccacggtcaagggcgagtgtaaggtgtttctcatagcgtagatttgtttgacaaatgtttgtgaagaagtggttacagggaagggtaacgttaccagagtccgcctgtgtggcagacggctaacctgggtggttaggaacgggtctgtgtgacctggggtgtcgtctgacaccgaggtgttgttagggccatgaagatggcgttgttgtgctgagataactgtgtggactatgtgttgttgtgagaagaaactaatagaggaacaaattaatttgctgttcgttaatcgtgacaagttgttgcaaagcaacttgtggaatgggtcgaggcgtgagcctcctcccgacaactaaaacttgactcactcactaggagttttgtgaaataaatcactttgccaaaaaggcagctttcgcaaataaaaccttagcctccttgtttaaaccaaacatgtcattctttcccctggcttgctgagtacgttaagtactcacccttgccccttataatattatatagagtatggagatgaagacatcgacccgaccgccgaggagtatctccaggagcaagccgagtatgaagacttctagatgtttcgtgcctagccccaagcctcgcctgtggaataagatagatgcctaggttattcgcctagtgcatagttgcttagtcgcttagtgctccgcgctgttcgcttctgcgccgttgcttttatggttttctgtaatgttgtgttgctcatctatgggcctgtccatgatagcaacttatgtaaggactactacccagtgatgtaataaagcagtttactttgattccacatttattctgtgtgtaccagctagttgtaacatcctgaaaattcccaacaataaaaatcactaaaatttcgaactttttaaaactttttgcatcatgctggatgttatggttgcttttacttgccaaactataaattgtcacaatggaaaattaaactaaagttatacagctaagtaataattataataataagatatttattatgaaccccataaatatttacgcacgagaaaacgaagccagacaaagggaaggttaattaccaatttaatttatggatcaaatattaaatacttgaaccatgtgatgcgtgccatgaaatataaacacttaggaaatgataatcattcaaataaatggaactctatctatagaatagttttactgggaaaaattaattagatattatataatttgaattgaatcacaaatgctaaattatagaaatccatgtggtggtaaaaccaatccaaaaagataaaccaatatatgtgaaaacatataaataccaaaatcccaaacataggaaattataaaaatctaggatatatattaaatattggacaatattaaattttggggaaattcacatttgagcacttaatatggtcactcaactgcttagtagtaaaatacaaatttaatttgcaacttttctcaatttataaataaaccaaaaccttaaaaataggaatacttagaaaaatatataataaaaataaaaatatgttcaatattaaatttgaatacaaatttcgatggattaatttaggcttggtgtattgtgacaaaattaggggcaatagtatatttttcctaattgcaaaataccctataaaatcaaaaatagttggctagcattgttcattagccctctaggtgtttgatttggttccctaaccaccacccctcctctgccgcgctccccctcaattctcgcgccgcccctacgtgcgccgcgacgctgccgccctctgctgcgccgctgccttgcgccccgcgccgccgcgcgccgtcttgtcaccgccgtcgccgtcgcgccatcgccgtcgcgtcttgtcgccgccgccgcaccgcgcgtccccattgccgctgcc

SEQ ID NO: 60971 - DNA, 3131 bp, Oryza sativa
taccccaccccctccccactttcccccactccatttccctcctcctcccctcttccctctcaaccgcgccgccgctctcgtgccactgcgccgccgccctcgtgccgccgcgctgccgccctggtgccgccgcaccgcgccgtgtgccgtgccgagcgtcgcctcgccttgcgccgctgtcgccgccgccgccgtcggtaagccgccgccccttccctcgttccgccgccgtcgccgccccgggtaacttgagtcgagagagagaggaagggagaagccgggagggagaaggaaaaagaaaagaaagaaagaggaaagaaaaagagaaggaaaaggaagaaaagaaaagagaaaagaaaaaaaagaagagagagagaaaggaaaagaaaagagagagagaggaaggagaagagagggtagagtgggccccacctgtcagtcactatagctgtggataaggttgtattataaataaatgaattagggacagtaccatttcgcaattattagaattaattcaaatttgaatctttacgctagcataacttattcatttcagctccgatttgagtgaaacttgaacctaaattcatctaatttcataagctttccaatgatatataattcactattggataaaatatatttataaaaattaaataattaatatcaagatgatgcataatagtcaacttaaaaatatgctaataaataaaattagtattgtacagcagaataattatctttaatatgttctgtcactgtagcaaccacataaattaagtataatcgatgtttgaagttaatggatatataggaaaatattagtgccatttattaatctatgtccaaatataattaaaacccacgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatagtgggagaggtgagcaacccttagttaaccaagcagtaaatagaaattattcaaataaatgattcaatatactaagatattgtgcacacatatattgtacatcccattatagatatatggtatcgtattaatttgcttgttgcgtatattaatttagagggagtatatgacaaacatgaatattagataaatactagttatacatcttgtcctcgtataattacagatcaactgtaaatttggattattcattgtaaaattatgtgatgggataatccgtaaccataatatgattaacctaaacaattctaacatacaaagcatgggtaattgttaaccttttataatttattttgacaagtgaaatatgtacataattaaaataaagcctccattaataaaataataatacaaatgattcacagtaattatttgaccgatccaaaatccatccggcaacagaacctctagtgtataaccgtgctatgtagataaatgcatgcctagccataatccttccatagccatttgatagactaaaccaccgattagccaaatatatatgtatcctataaatgctatgttggttaactcctaaataggccacgttgacaatagaaagattaagaaaccttagcccctagcgagattggaatccattagcagacatgagtagtatattttgttgtgcatatttggttgttatttgaatattggtttttcttgcgtattatagaatttatgtatcggttagtcgtgaggcaacgtcaacaacttccaggaggtgaaggttaatcaagaattacatcaagaataaggactatcctgagcaaggcaagtcatcactattctttgaacatgttgatcccaattgcgaaattgttttgtttacaaataaaattgcatgcaattatgaacatcctacttgtgattataccatgccttgattattgttcacctttaaatctttgtaaccatagatacgtacgagtctctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggcgggtgtctacagtggtgtcgccatcggtaggactgccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaattttatgctgatggagccacatcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaatacccgctatcatatgcattgttgttgt

SEQ ID NO: 60972 - DNA, 1848 bp, Oryza sativa
tgagataataaactcaaaaactataagatccaatttttaaaggttacaaggagaatgaacataagccatggtagatcgagaaaacaaataaagaaagggtgaaaaaaaaagtaaagggtagcaattgatgtgacttttataaaagttataaaattagaaacatgggatgatatggtttggtctttcaaaatcttaagacaatgagatatctattgaataaattataagtaaaatcatattaaaaatagataattttgtatgggtgctaaccgcgcaattgcacgggccacccagctagttttttataaatatcccgatcctctgcgtcggcctccctttgccccatagctgatctttaggatttttgccgtagctgatccttgcacacgcatgaaggtatttaattcattttctcggtaggcattaccatggacaatatgcattggagaagattacgtctaaatgggtatttgttgccctctctcttctctatacactacctatggatattctgggttgggactgtctaaaacaaattagtagtaaggagaaattacgtactgtagtgcaccttagtaatactcttgattgtattttctaggctccaaataaatacgtatgtcttaactccgttgaccataagatgaaacaaaaattttgtgggccaaattttgaacgatatttttttgtggaaacaagtggaccaagacttaactctgttcacgccttcacgggactgttaatttggagttttggactaagaaatatccacatgtttggactctgcggttgccctcggacagaagagacatcaacagttcaattcattagaaagtgatccatttttctcctaacatcagaaaggcgattcaacgcaccccggaagttcagtcgacgtatgcatgcgggcatatgccggcacagcctgtggaaaattgcacacgagctagagaacaaccctcgaccgacatattcgccatttcgtgcattataataatacattttttcgaacgactcgcacgagacggtgcgaagttctattgatagagcaggaaaaaattacaagattataaccctggagggtcataaccagtaaaaggaaaaagaaaaaatataccaccccccacacaccgacagtgccaacacacacgaccaggaggaggctagcaccggaccggccgccgctaaaccaacaaaggaacacagacgagatcgccctacagctagggggtgccaaaacgacgtcttcaagaagagaagcgacggaaaaaccgccgccgccgtccatccgggctcaaaggagccaggactgggctttcgcccggcaaccacccttgaggggtgagacagcacgacaacgccctcaggagggggaattaaccatcgttgtcggcccggcatggccggactgggttttcacccgccgcacaccacctgcgaatccacggctaacgcaccgatgctccaccaccacacaacctctaccgacatgtgggacccccgcaccggcgccccccgccggccagccttcgagcgccgaaaatcgtgccacgcccaccggcatctcctcctcgcaccagggtcgcctcttcctctgccggccgcgcatctcgcgccgaaccggcctcctccaccggacgcgcctctcgcgccaatccggcctccctccctcggccgcgcctctcgcgccaagccggcctccatctccgccgcccgcgcctctcgcgccgagccggcctccgctgccatcggctgcgcctctctgcgccaaaccgatctccgacccctcctccgtactctcccgcgccggctagatgcagccgtcggccacgtcctcggctagccgac

SEQ ID NO: 60973 - DNA, 7678 bp, Oryza sativa
gggggaggaggaagacgacggcggcggcgtcgcctctcgtgtcgcccgtggggagggcgacgcgagagctggtcgtgaccaggaaacctccattataataatataaagcggtaaattgaacaataccatgagttacgacaccatcgtatatgtatgagccttccgaacattatagaatggaataaatactagaatcctataacaccaagcatataaacactaccattaccgtttcatcggttgccaatattctctaataaatctttttaacttgttattagaaaataaaaataaatttagaggtaaaacttttatatatgattttaatgacttaaaagtcaatactgagaaataaactacgttgaaaatatcttcaaatcaattttaaaatttgttttagattattagagcaaccagtggctcttaatcctcatttatgagaaacaagaatggctgtagagagcacggctagcattccaagtcgcatgggggacgatgggaagttggtcatgggacccctgccggcttaggccccaggccgtcacacagcccgcctagattcagagccaacccttgtagtttatataaataaatccaattttgctatatatttatcgataaattttctcctaaaaatttaacggatgtaattacagtacaatcgtagtgtaattacactataacttgcatgtaattacactgtaactataaatataacttgtatgtaactttcaaaaatatctccgtaaaatgttattttcggtacaatggaggtcgtgggaacaaatcctttcacatatgtgtgtgctgtgatttttttctcttccttaccaaaacaaatcttgtaatagatctaacgattcaaaattacgttaaacttacatacaagttatattgtatttacatgcaagttacagtgtaattactctacgattgtactataattacatccgtcaaatttttaggagaaaatttgtcgacaaatgtataggtggtcccaaataaatccgttagttgtaactccgtgtaatttgtagcaaatacacagtaccagggtagaattgccttgtcgtgcaaatccggcccaaaatgcagcttgggtctagctctacattccctttcgcgatttcagacgtacgtgccaagtgtccaagtggacgatcgaaaaccctgcatatgttcaagcgactcttaaagtttggactaagataagaaattccctagaccacgaccacatatatactctctttaattgctggcactctcggacaaatgagacactatcaatagtttaataattcagcaagtggttcgtttttttttctctcataacatcagaaacgggtattcaacgcatccgagaattacagtctatgtgccggccctgccgattgcgccaaattgttcacgagcgagaaactcgatcgagacttcatgcgcattttgtgcataattaatccgaactaaacgcgtcacacttaattaattagctttgttttttttttcctaatttgctagttgagtagttgacccccctcaaaaaaacaactaaacaaatttctagcagttggcattggccaacgccttcatccaagctttgtgccattttttaaagagcttatcatacatatgtcatcccagtttgatatagatgatgcttgttgaaactcagtttgtgtaacaattatacacaaacgaataattaaatattagaaagctcaaaagtccatgtgctgccaatgttcggatggtggtttcggattggctaacagagcatggcggcagggttgcagagggttccaagcgaaaacttagcccaatgatttattgggtcaactacgcttttgggcgtggtaatcatcctgaggacgctgttgggatacccctcctccaacagtaaggagctctgagtgaaaacctgtctagttctttggacggatgacaacggcgtctttcggcaccacaaccttcgtgagggcgtcgttttttagagtctccgcttcgtggtggtgttgtaaacccggtggtgaccggtctctcgtagcgacggtcggcttggtgctccgcttccctctctgtaacatgtgtctgtgcggttggcacatggttcggggcgtgtgctctagttcatattctttctcgacagtcagttgtcgatgaaaaatttttttgcaacatttttttcatctatcttaataacatttggataaccttctttggtcatcccggtaagaaaaaaaggaaaagctcaaaagtaaattaaaaaacttttataaggaatgccaatgaaaaaaaaaaggacatcgctccaacttgcaatgtcttttctaaattactgtttagtcgatgactcgatgtaatacattgtattcgcattgttatttttattttatcaccctgcttagagtttcgcccggagccatgaaattttctgggatggccttgatataattatcctcttccgcagaccatgtaagaggaaaacagaaccttcgcggacgaacagtttgatctctttttttattactcgacataaattccctgtatgaacagcaatttattttgcatggcattggtgatcgtactgtctgtgcgagtagttaaaaaaaaagtgatcgtactgtcacgacgagtcgacgaacgaagaccagcaacaaccgagatcagaattgaagctagcaaatgcacgcgtccacacaaaaccttgcgaaaaacgatccacgaccctcacaagaaatcttgacctcagctcactaattaactaacacagggagtacgaaaacaaaaataaaacgtagagaggtgcttactcctaatcatcatcaaacgaagcatcgtttcctgtggcacacgcctcacggcgtatgtccaagtcatcaataattagacttttcaacacatgactgcattggctgcttgatatcgccttatatgcgctcataatttctttgccctatgtagtacaagtgtacaaccaattgccaaactgctatagttgaaacgatggctggattggtcatcggctacctggccgtgcagctctcgctgatgtctctgctgctctgcccgtcctcgtcgacggcgcagcacacgctgggcagatcctccatgtcggtggaagaccacgcgcggccgttcctggtgtcgacggacggcagcttctcctgcggcttcctcgaggccggcgacaacgccttcaccttctccgtctggttcaccgccgacccgaacaggaccgccgtctggtcggccaaccgcgacgcccccgtgaacggcaggggctccagggtctcgttcagccgcgacggcgagctggccctcgccgacaccaacgggaccacggtgtggtcgagcaaaacgacggctggcaccgggaacagaaggggcctgaccgtctccctccgcgacaccgggaacctcgtcgtcggggacccgtcgaccggcctcgccgtgtggcagagcttcgagtggccgacggacacgctgctcccgtcgcagcggttcaccaagcagaccaagctcgtcgccggctacttcagcctctacttcgacaacgacaacgtgctgcgcatgctctacgacggcccggagatcgccagcatctactggccgctgccggggttgaccgtgttcgaaaacggccggacgaactacaacagcacgaggatcgccatcctcgacgacgccggcgtgttcctgtcctccgaccagacgaaagccgaggccaccgatctgggcctcggcatcaagaggcggataaccatcgaacaggacggcaacctgagaatgtacagcctgaacgcgtccaccggaggctgggcggtgacatggtcggcgctcaagcagccatgccaagctcacgggctgtgcggcaaaaacggcctctgcgagtacctgccgagtctccggtgctcgtgcctacctgggtacgagatggtcgaccgccgggactggaggagaggctgcaagccgacgttcccagtcggcaactgcagccagggatcggcgccgccgccgtcgccggcgacggcgccgccgcagttcaagttcatcgaggtggcccagactgattttttcggcttcgacctggggtacaccgagtccatcacgttcaagcagtgcagggaccagtgcatgaacaactgccagtgcaccgccttctcgtacaggctcgacggccggggaaaatgctacccgaaaggcacgctgttcaacggcttcacgtcggcgaatttccccgggagcatctacctcaaggtgcccctcgacttcaacgcctcgtcgccgcgggtctccgcgcagcgcgccgccggcctcgcctgcggtgccaacgtcaccgtcgtgaccgtgtccgctgacgtgtacgggatggcgccaggaagcaacgggcagtggacctacttcttcgtcttcgccggcgtgctcggagtcctggacatcctcttcatcgcgacgggctggtggttcctctccagcaagcagagcatccccagctcgctgcaggcagggtacaagatggtgatgacgagccagttcaggcggttcacgtaccgggagctcaagggcgcgacggccaacttcaaggaggagctcggccgcggcggctccggcgcggtgtaccgcggcgtgctcgacggcggtaaggtggtggcggtgaagaggctggcggtcgacgtgacgatgcagggggacgaggagttctggtcggagatgacggtgctcgggcggatcaaccacatcaatcttgtcaggatctggggattctgctccgagcgcaagcacaagctgctggtgtacgagtacgtggagaaccagtcgctggaccggcacctgttcgacgcgtccgacggcagcggcggcaaggcgacgacgctggcgtggagcgatcggtacaagatcgcgctgggcacggcgaggggcctcgcctacctccaccacgagtgcctcgagtgggtcatccactgcgacgtgaagccggagaacatcctcttgacgcgagagtttgaagccaagatcgccgacttcgggctggcgaagctgtccaagcgggacggcggcgccggcgtggagctcacccacatgagagggacgtcggggtacatggcgccggagtgggcgctgaacctgccgatcaatgctaaggtggacgtgtacagcttcggcattgtgctactggagatggtggtaggaagcagggtcgcggaccagaggacggaggccggcgagccgctgcagctgccgcagatcacgcaggcgctgaggcatgtggtggacagcggcgatgtgatgtccctagtggatgccaggctgcaggggcagttcaaccctcggcaggccatggaaatggtgaggatttctctggcgtgtatggaggagaggagctgcaggccgaccatggacgacattgccaagtctctcaccgcgttcgacgacgaggacgaacaccctgcctaccactcttgatcagtactcatgaccaccaggcaaatggcacgctggattaactatagaagtacatccgtacttagttcagagttcagagttcagaatttctttttaagctcctcagagcatactaattttgtatgaagtttttgaaaagaaaaacttcattttatctctcaactcaaataaaagatagaactgcgccaaatctttttaatgctagacaaattagttctcttagtacaatgctacaatccaatatatgttattttcttgaaacaggaatccaatatatggttttggttaaattgccacatgttttgcctctctttgcctagggctgaaactccatccgttctcaaatataagggacataagcatttaaaatttatttcaaaatataaaatatttatgtacaatttgtccaatcaatcatcttaccattcaaattttcttttcactttccgaataacattttcactcaccatataatggggggtgttatagtctttatctttattattaatttatacaagaaaacctataattccttgtacgtatttaggaactgagggaatatctatctttccctcgttggtagagccaaggaagtcaagtcacagctacaatggccgatcattgagctcaatattgtggtgactacggtcatagcatattggaattttctccagggaattctattggacatggatcctctctgcagtacaacacatgcattagcagatccgatctcatatgtcagtagtagctattagaggtgtaatactacagacaattcgtactgaaatatatttgtctcgagaggacatttatttgttttgtgcaagtcgcgtaaaaagtcataaaaaataagatagatcaatatgtggcacaaacatacaaatcaaatttaacctatataagcataaaaaaaaacaaatttgaatgtgaatagtgtagttgattatttgctccatgcctctaaaaatactccccattggtacataagtataattttagctagtcgaagacatattaagtaaagaattaaaatattactatgcccttcattattatgcaaagaaaacatggatggggagtaaactagaaggatgagatatttatattggttcaatggctaaaaaggagaagtaaaagatgaagtagtattagaaagttctagtggaccactcaaaaactaaaattatttacagacaaatcttttaattaaaactacacttatttaaggatggcaggggtattttctgtatattgtttagatcacttattttgtgttgtttgttcagtttttaaaatttttaaatcatctctatatataacgaagtagataattcattaaaaaaaatgtagggccttggagcacaggaaacatctagaacaatgacgggtggttttcggtaaggaatatggataatagttggataatagccaaacagtgccatcatcgtgtgtagggagaaaaagaaacaaaggaataaaatggcaaggaatgacgtgcgggatgatctttctttccttgtttttttttttactattttgctactatctctgttttaatatgtaactagcatggtggcccgtgcagattgtacggttagcatcattatattttctcttatataatagcatatatgttttctcattatattattcaaatatattaaaatgacaacataattttaaattttgcaataactttacaaaactactaatgtgtaatatttatattatattttatatacgtgttagttattaattatttttaatatcaaattttagttatttgtaaattatatatattcctatatggactctagactcatctttaatatttttttaattctgaattttctgaaaattgtatttctatatagagtactctatgctcttcttccaatattatttattttatatctgaatttttattatttctaattgtatttctatgtcgactctaaattcatctttcaatattctttaatttttcatttcaaattttgaatttcagttacttcgtaagttgtatttctatatagactctatgctcttcttccaatattatttatttttctttctaaatttttattatttctaattgtatttctggactctaaactcatctttcaatattctttaatttttaatttcgaatttcgaatttcatttacttcgtaaattgtatttctatatagactctatgctcttcttccaa

SEQ ID NO: 60974 - DNA, 12287 bp, Oryza sativa
aattccgaatttctattttttttcttaattgtttttatatatggactctatactctacttctaatatttcttatttttaattccgaatttcagttattttctaattgtatttctatatgaactctatactctacttctaatattccttatttttaattccgaatttcagttatttcttaattgtatttctatatggactctagtctcctattctaatattccttattttttaattccgaattttaactatttctaaattgtatttctatatggactctagtctcctcttctaatattccttattttttaattccgaatttcagctatttctaaattgtatttctatatggactctgttttttctttttctccgattaatgtgagaatttctaggccatgagagcaaacgtggaggctcctttttatattcctttaataatataataactagctgggtggcctgcgcaattgcgcggctagcaccgatataaaattatctaatttttaatatagttttacttaaaattttgttaaatagatatctcgttgtcttaagactttgaaaaaccaaaccttatcatccctgtgtttctaattttatttttttaaaagttatgtcagttgctactcctaaattctttgtcacctgtcatttatttgctttctcgatctaccactacgtctatttgtgtcgagggaagaccccctgatcgcgggtcgcgtgacccccctttcgtgagttcggccgagggcagagactcgtctctccgaagtcgcgtgttcgtccctccgatccccgtttagatagcacacaattcgattacccaggttcaagccgctctggagcgtaataccctcctcctgcgtttgggattatcagtggatttttacaaggttctccttgctcctctccgctctccggtgggcaaggtcctccttttatagcttaaggggataccacatgcaccgcctctaccctccccctccatcggagggaggggagggggcccttctccctcttcccaccgggtttcaacccgtgccttttgctggaagctaagcatcggtcggtccttgagtggggcccagcgccgtctcccgcctgacacggggggcagccctgtcattccctcataaatgagtgaggacttgcggcagccctatatcgaacgacgtccggatgtgacggggcgtacctaccgccactccgcggagacagaggcgacgtgggggcacgaccatccattcaatcggccgtgaccggcaatagactggtcacagaccggtcgcatccgactgacaggggtcggtcgggcacgccgcacgtctgccctcgccgcattgaatgcggcgagggacggttggggcgctgcacatttatggccgcccagcctagactctcctctcacccttccccccgagggagggcctcgggctaaaacgacgggagagcccgagggggtgacgtcacccccgaggggatgtcgtcgacccccgaggctctccccatcaccttagtgactcacgaggtatgtgggtgggaccagctcgcagagccacgtggctggaaagggaagtagctctcctttactccacatacccccgggcccatatctccgacagtagcccccggcgccatgtcagacgcgggcttcctgggatcggtctgacatggtgcctcacgacctccctagctggggttgtgggcccggcggggagtttaaaggagtattgccgagcggccagattagcgggccagccatagcggcggttcggtcgcctctgatcgcgctaaagacgaggatgcttgggacgcgataatcgggggatcggttagaccacgcctcgattacctcgcccgctattcctacggcggttgtggtgacggttcactcagcttgcgcttatagccgttgcgcattccacctcgagtgcgccgctgataggcgcactaaaggtgggacgcggacacgacgggcgacgtggtgaacgggcgcgggaaacggagagacaactgcggacgtgggggcaattatgagggtgcgaaacgaggaggcgagcgcggatgagacaagaattaaaagggagtggaggcagggacctctcctccttcctttcgccaaccgccgactcgtcctctcgcctctcgaaccctaacactctcgccactccacgcagctttgcgcgccacgccttctgccactgcctcgccggccaccatggctcaagacaccggcgacacagtgctcccttctccccgcatctcggcagacagacaccttagcctcccccgcaaaatcatgccggacggcgccgtcgtgagggcgggggagtcacggccgcggccgcgatatccggagcggtccgtgcacctcttgtccttcgccatggcgggattgattccgcctttctcccgatttttccacgaggttctggatttctacgaaatccatgccttgcatctcgcgcccaacgccgtgatgacaatgagcatctttgcgcacctgtgcgagatgttcatcgaggtgcgaccgacgatgcggttgttccaggccttcttcgtcccgcagctgctacagggtgcggtggtggggggatgttacttccagccccgaccaggcacggcggggcagtacatcgagagccacctccgcaagaaatgggaggactggaagaaagactggttctacaccgcgctgccggatcacccacgacttcgagttcccgccggtcctcccgagagatccgccgcatggctgacggcttcggagctgggcgaggaatatgacgcggtgtgggatcgtctcaggggcctgcgaagcttgggcctcacaggagcaatggtcttcggcgactactttcgccgccgtatcgcccctctccaggaacgatcccgtggcgcgtgggagtataccggccccaacgaccccatgcgcaagcacgcgggcgagcgctgggactggggcgaggaggacgccaagatggtgattcggcgggtgctgggcctggactccgccgagcaaacactgatcccggatgggatcctccccctctgctgcgaccgcgaccgggagagcatcttggccgtgatgtcggtcgtcggcgccggcaggggccggcctggccgagggggcgccagcggtagcgccgccagcgccggtggtggcggcgcgtccgtgggcgggagccggccaagcggtccgggcggtggtggcgactcacgggcgcccggctcgggcccggagacgacccagcaagtgacccgaaggggaagcggaaggcggccaaatcttggccgccctctcccccgcgtggaaggggtgcagagcgcgcgacagaccttccaccggcgggtcacaagcgacctgccgggcccgaggccggtcggaagaagaaacggcttcggaaaatagggcaaacggagccgtgccgagggagcttcatcgagcccccgaagtggaccttcaaccatcctccccgcaggtacaaacgctggcgcccacttcggtgctcttacctagctcggcctcttgttccctccctttctttttcttttgttaacgcgatctgggttcccttgtagcgatattccttctcaggggacctcggggtcggacccctcgcggaggacgaaatccgcacaaccggagcggtccgggcctggccaatccaaggccacggggtcttcgcaacctcgcggtggggtccacaggacacgtaccgggcccgaggttgaggtcgaggctgggggcggtcctgagcccgaggccgaggccgaatccacccgaggactgggagcgggggacgaaaagaacagccgctcccccttgcgtttggggcaccctcggggctggcctcgcagaaggggggccgagagcaggccccgtctcgcggggggtccagcagcactccgtcgtcccgggggcgaaccgcgggcttttcttccccatccccggcgagcatggagccacttctgcaggtgctcgccgccgccgactccactgtccgggaggggctcaacacccaagttcaagccctggcggaagagcggacggccctggatgccgaatgggctcagcttgtggcggaccgcgcgcgagtcgacgaggggcaccgtgccgtggaggacatggtgagggtggggcgcaaaaaacaccaagcccacctagctaaaatccaggcgcgcgaggaggtgctggactccgtcatgcgggaggcggaggaggagcggcaggcggcgctgatcgcctcgagcgccctggacgaagcgctgggcgatattcgcctttagtacgaggcccatgccgaggacctggcggagagggtcaggaatgcgcgtggcaccctcgacgcagccgctgcccacgagcggcgagcagcggaggccgacacctcgttgcaggcccggactgcggcactcgaggctgaacgcaaggccttggacgatcgtgcccgctccgtgcaggagtttgaagccacgatccgtcggcggattgaggtccttgatcggagccagcgcgaacaaaacgcgcgcggccaggaacaggcgcagcgggcccaggagctggaggagcaagcacgcctgctggatcagcgggagtccaccttggccgcccatgagagaacggcggcggaaacggaggcctcccttcaccttcgtgaagaggccgcggctgagcacgaccggatcactctcgccgcggaagcttccgcgggccgccgcgcggaagagctacggctgcgggaggaggcgtgccgggaacgggacgccgcactcgccgagcgcgaagccgaggtaaaccgccgcgaggtagccttgcgccggctgggcgagcagcttgcgaagcgcgaggaggctgctgctgggcgcgaggcccggcatctggagagcgcttgcgctgagcgcgcggcgatagcggcgagggcttccgaactggaggcccgggagaagcacctggcagccggcgggccgcccggcggcgcggggttggcgagcgagctcgctaaggctcagagtacccttgccgacctggggcgcctggtgcaagatcaggctggggagatcgcggcccttcgcctcaccaacgaactcgggcccgggcagctctccgacgccgtcgctcggctggagcgcgcggcgcgccgagtcggcgttcccatgcgccagcatagccaacttccgcccacacaaccagcgctcgcgttccggttggacgggctagcggcgggcctggagagactggaagaggaggtcggcgagaccataaagtcctcgtcagcttctttggcacgggccgcggtggagctggttcttgcaagccaccaagcgcgcgaccccgacttcatgccgtggtgcgcacttgaagattttcccccaggaactgaagcgagggcccgggagcaagttcgggaggcagccgacgcgattttctcgggcttcgagggatcggccccccgcttcacctccgggctcgcctcggacgaagaaagcgggagcgggggtgacgatagcgacgaagactaggacgacatcgtcagcggcgccggcctcggagggccgggcaccccgtgactatccgcgccttcaattccctcttgttgtgcgcccgtagcgggcacctcttgtatttaggccgtcgtgccatcctgccttgttttgcaattgaaacttgcttagctccttttcccctttcgcttcttctattcattgctccttccactgaatgtctttgaaacagagagaacaacaaacaaaaaacaagggaaaaaggggataatcagtccgtgatcgagacgccgctttgaccccaccccccctcgggcttgttctagcgagatggtgaatccgcgtttggtccagggcacctaagtggtgatggacaaacccaccgctccgagggagccgcctagcgggactggccagaccgaggccgcgtcgaccgggggtcggggacggccgtgtgtaggcccttccgatcctccggggttcggcgcaacccagggcacggcccgcgttcgtgctccctttcggggtttctaggccgcctcacagcacttaggattcagagcaaacgcagattaccccttaaaccaggacaagccagaggaagggaaaaaagaaacggtctttgggtaaaagtacacaagaattcattgcttgtaagaggaaaaaaggatacacagtggtagcccccggccaggcgcgcacaaaccgaggggttgtgcgggggctggcccgagctccaagaaagcaaaaaagtctcgatattatggatagaagcgatggaggtgttcgatattccaggggttaggcaattctgtgccgtcctccgtggttaactgtcacgcccagaaatttagcccaaatttccagactattttgtgtattaaatccctgtccaggaccagccagggtacacaaaacgacaaataatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaacagttgagtaattaaagtaacattaaatctccactgatcaacgctacaccacgttgaacaggcccaaccaacccacctggactacagtgtattgggtcgatttattaagatgggactaatcacggtgaatctggtcgaccgcccataaccgcgggcacggctattcgaatagttttactctgatcagaggtgtacaactgtacccacaaaacacagccccacgacacgtttccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccattcagttgcattttagttggataattacgaccatgaagcatggccagatgtctcgagcacgcagctcattctgatactaaaaggtctaatactgtaattatcccatcaactgagctagtagtaattaagcatggctaagcatatagttctagctaggtcacataagtaacctgagctagtcgattcattacccaaggttgacaaagaacagatatcaagtaaacatggcacaagcgagcagataggtaatacccagatcccatgtaattagcaaaacatgcatatttatttgtaaacggtaaaacatttataaattgggatcaacatgctcaaggggaatgtgtgacttgccttgcttcttcaaaacaatcttccgaactcttttccttgcgaccgcagacttccgaaacaacggattctacacgctggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaaggttttgagccattttaatgaatttctagaattattcacgaattattgcgcaattattatttattttctcaaaggaaaaggctgtgctgaggtcatcaaaggggaggggcggcgccggcaagcgggccccaccggtcagcggcacaaaggcgccggtccaccgtggaccgggaccaccgaggcggtccaccgccggtccacgggatccgacggcccggatcggcccaaagccgatcggacggccacgaggcggcgcggctggggcacgggcacggcatgaagccggctcggccgagacatggcgcggcggcggcaagggggaggcggcaagggggcaagggggaggcggcaaccggctgcagcagccggcgacgtggaacggcggcgggtggccggaggacagcggcgcgcacggggacggcgacgcaccccaagaggcggcggtcggcaagaaaggggaccggaaaaaaaggaagggaggagagatcctcaccggaagcggcggccgacgcggaggaagaggacggcgacgacgattgcccaatggcggcttgcgaggacggagggcggacggggtcgcccttgaccttccgaaggagaagagggagttagggagaggaggaccgatgcggggtgactggaaacgaagaccgatggcgatgacaagaggtagagctcaccggcgaccgaggaaggaggagctccggcggatttccggcgaagaggggcggcggccgaggtcctcctcgtccttgcggagctgagggaggcaacggcgcgagtcgacgtcgaccgaagcggcggcgcgacgcggctggaggcggtgaaaggggcggcggcctcgggtgtgcggtgggagtggtgctcgaggggtggagagggggaaataagaggcggccggacttccccttgcggtggcgaagctggcggtggcggtgctcggcgcggcgacggctgtggcggcgggaaacggcgaccggagctcgccggagtgtggcagcgcgtgggtgcggcgtggggagagcgagggagagtatgccgggctcgggaaaaatggggaaacggacgaggggagcacggggatgctttttatgggctcggggaggagaaatcgtggccggacgggcggcaacggccggcggagtggggaggtgaagtggagctcgtggggaggtcaaaccggcgccgtttcttgcggggtgagtgggggaaaaggtggaggacgtggagggggttgtgtccacgtggttggatgcgagctcgggtgcgggagggcgccggattttgcggcgacgtggacggcaatggcggttggggtcggccggcgagaggtaggaggaggagctgacgggtgggaccgctggtcccacctgtcggcgaagggagagaaggagggacgcaaaacagacttttgcgagcgggccaagagagaggggagaaggcgcgcgggccgcgggagaggaaagaagacttgggccgaaaatggcccaaagagaggaagggggaaatttatttgttttctttttatttaaattagtttaatgaactttgtgactctaaaactatttctcgagctccgaaaattcacggaaaattccggagagtacattagggcacaaagaatattacaaaatattcccggccaatgatttttaagggaaaattttaattctcccattatttcacttgattaaattgatttatcttttatttaatttctagaaaatgtattattaatgatttttaatcccgaacgaaaatcggggcgttacaaatctaccccccttacaggaatctcgtcccgagattctgggatggctagaaagaaagctggtgctggtgggcggtttgactgatctgcacattgaactgccacattctgcttcgaactgattgattgactggttgatcaaacctgcacgattgaactggctggattcaacctttctgttcctttgttttgccaaaactggaccgactggttatgcttgaactgacctaggccagaactgtggatgctcctgaaacttacttatcttggactgaactgttgagattggcaattttggtaacctgagaattcaccacgctggctataagaggatgaaaatggaatctggcatttgtaaatcatttaccctatgtccgcttggactggtcccaactcaaatgacaagtaattccaggaaaacctgcttgacctgtctttcgtctgtactacaactgtcctcgctgttgcttctctaagctgaactgttgacatgcttcacaggtgtaccttagaatcgaacctgtcgacctgagattggggtgactctgctaatggttcgcaactgactcctttaattacgaaccaatttgccgcaccgggttgaacctacaactgaaacggcaacgaggttagccaaaactcatctgtgagacctaccccccttacagtgggtagtcttactttcgcctgactgagaacctttgaactgttgtccttgaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaggtgactctcatttagctcatggacacattgactcttgactaactttcccataagttctaactactggcatgactgtcctgcttctagcttgacttcggtgtcgagttgcatagttgattcctcaaaactgaactgaccgactctgcattggaactgacacaacttgaggagttggggtgtcactaacaaagctcttgatgtgatgacgctgacgccttactgtggaacaaccctctgagaggtgccctgtcgtacatcttccatggatagttggacactttgcaaaaactgctcttgaaaaccataaccactgtaggtagcatttgttgcctctgggattggtggtgacttagctgtgctggtctgctgaagacttggtggcgtactgtctgaggttgcaggtgcttcctctttgaaaacaaactggctttggctctgatcctaattccagcttgcatctaggcttgtgcatgttgttggagacactgttgttgcatctgctgcatcggactctgcggttgctacatcaatatctggcacatccatcttccaatcttggctaaccagagcaaggtgctctgactcagctggtagcttgttgtcttgaactgatccactgactctgactgcaacacactactgttggagttatttccgctacatttgaccaggtatcgaacctgcatctcccacatcgaatacacccatcttctgatcttggacaccaaaagttgatcatgagcagggttcatctggcattggggcaccttgcagctttcaactaaaccattgatctgtggctttaatacaccgtcgttgctcttctctctgacactgaccatctgccgccagaacggaagagaggtggaagagaggggttgctaaagataaggtactaaaccacttgcctattgatctgttgtgagtagatttttatggtttaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaactccacttgatcttcgcagaacgacgactctgaactgatcttctcgctccttgcacgaagcttgaggcttgacttgacttgactcccgaacagacacaaagctgacggtttatcctccacgttttaacaactataagaattggagggacagggaggagaattttgaaaaactgtttcgcaaagaaaagccgaagggcgaggggagacatttttcaaatagggttttcagaaagcttgtccttagggtttgaccgtttggctcaacctacagtcaacctggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagcctgggtcctctaactgcgtcttcagctcagaagcactacacttctgaaaaggggaataatagcagggtgagt

SEQ ID NO: 60975 - DNA, 5814 bp, Oryza sativa
cccgtgcctcttcaagacgttgtatgtcttggtttttaggcctttgaggatttcggcattggctcgctcgactggccgttgctcttggggtgggcgggcgaggcaaagcataacttgatgcccatgttgtcacagtaatcgccgaacagctcactggtgaactgggtgccgttatctgtgataatgcggttgggcactccgaaccgagaggtgatgcccctgatgaatttgagggcagaatgcttgtcgatcttgacgacagggtaagcctcgggccacttggtgaacttgtcgatggcgacgtacaggtgctgatacccgcctcgagccgctttgaaaggtccaaggatgtctagcccccagaccgcaaaaggccaagagagggggatgacctgcaaggcttgggccggctggtggttctgcttggcgtggaactggcacgctttacaccgccggacccattcttgggcatcttgtaatgcagtcggccaataaaagccttgacggaaggctttcccgactaaagttcgtgaggccggatgggccccgcactcgccctgatgggtgtcggctatgagctcgatgccctgctctcgagaaacacacttcaagagtatcccgttggcggcacgccggtagagggtcccttctacgaggacgtaccgcttagagatgcgcgcaagcttttcagcttctgcgcggtcctcaggatgagtattgccgtcgagatacgcccggatgtcagtcatccatgcgacttggcgaggggggtcggggtcgaccccctcgggctccggggggcgcggaggagggtcggggtcgaccccctcggcctccggggggcgcgggtcggcaggagtccgggcggagggtatgctcgtggaccccctcgtggggttcggtcgtgctgatggttggacaagcctttcttcaaaggtccccaggggaagtggggctcgcgccgacgcaacacgcgacagctcatcagcgagcatgttgtcgcgccggggcacgtgccggagctcgattccgtcgaagtggcgttccatgcgccgtacttcgcggacatatgcatccatttgagggtcggtgcattgatactctttggatacttgatttacgaccagctgggagtcacctaggaccaggagacggcggatgaccattccggctaccgccctcaaccctgcgaggagcccttcgtattctgccatgttgttcgtggctcggaagtcgagccgaacgacgtatttgaggacgtctccgcttggcgaggttagtgtgactccagcacccgcgccttgaagggtgagggagccgtcgaaatgcataatccagtgtccgccacgaatgtcagcgtttgggtcctctttctcttcgggggaggaagggggttcggacggaacatggtcgtccactggggcccattccgcgatgaagtcagccaggacttgacttttgatcgcgtgccgcggttcgaagtgcaggtcgaactcagctagctcgatggcccattttaccacccgtccggtgccctctcggttgtgcaagatttggccgagagggtacgatgttaccacggaaacccgatgtgcttggaagtaatggcgcaacttcctcgaggccatcaatacggcgtaaagcattttctgggcctgcgggtaccgggttttcgcatcccgaagcgcctcgctgacaaagtagacgggccgctgcaccgttcggcggggccggttcgtgttgttaggggcggatgacccggggcgcgcctgctcgggggccccaggggattccggattatcttgggatcacagggctcggggcctcctgccaaagcctcgccttctcctccgggggcctcggggtcctcccgggggctgggggctttgggggacgaggggccatcacgagccggagggacctcccgctcggtctcctcgcgttcaactactagggcggcactcaccacgtggggggtcgtagccaagtagagtagcaatggctcctccggccccggggccaccaggatagggggagaagtgaggtaagctttcagctgattgagggcttgctcagcttcctccgtccatacaaacggcccggggcgcttgaggagcttgaataggggcagcactctctcgtccagtcttgatataaatcgacccagggcggccatgcatccagcgacacattgcacatccctgagcttgttggggggcgcatcctctctatcgcgcgtattttctcgggatttgcttctatgcctcgggaagagactagaaaaccgagaagcttgcccgccggaacgccgaacacacacttatcggggttcagctttacgcgcgtggacctaagactatcgaaagtctcggccaggtcctgcagcaatgtgtcccggcggcgcgtttttaccactaagtcatcgacatacgcctctacattgcgccctatctgattacttaaagtaattcgagtcatgcgctgaaaggtaggaccggcattttttaacccaaaaggcatggttgtataacaaaaggtgcctacaggagtaatgaaggcagttttttcttcatcttccctagccatgccaatctgatggtacccagagtatgcatctagaaagcacaaaaggtcgcaccccgtagtggagtcgactatctgatctatacgtggtagagggaagggatctttagggcatgccttattgaggtctgtgtagtcgatgcacatccgcagcttgccgttggccttcgggacgaccaccgggttcgccagccactccggatgaatcacctagcggatgaaatcagcctccaggagccgcgccacctcctccacctcctccctgatgaaggcttgtcgctccggggcttgacgccgcactttttgccggacaggtcgcgcatccggtcgcacggcgaggcggtgctcaatcacctccctggggaccctgggcatatccgacggcttccatgcgaaaacgtcagaattcgcccgcaggaaggagacgagcgcgccttcctatttggcgtccaaggttccgccaatcttagcggttttggacggatcgtcgccaaggggaatctccttgacgggaacctcgtcggccaaggtgaggcgcttcttgggggcgcgggacgcgggggcctccggggcctgcggccccgtggccatcgccaagttgtccgcgcgctgttctgcacaggcgagggcgactttgacatcaccaaagatggtgatgggaccggcaggacctggcatcttcatctggaggtaggcgtaatgggtggcggccatgaacttcaccaacgcgggtctgcccaggaccgcgttgtagggcagattgagatccgccacatcgaagtcgatccgctcggtgcagaaattggtggagtcgccgaaggttactgggagctcgacgtgaccaagcggccacgtgtgtcccagagtaacgccaatgattggcagcgacggttggagcttcatccccggggccttgagcgcgtcaaaggcagccggggagatgatgttcagactggccccaccgtccaccagcacacgcttcatcttgacgttgtggatagtcggggagaccaccagggccaacttccctccccgagcgagtaccgtcggatggtcgctctggtcgaaggtgagctttacctccgactagcgcgccttccggatcgcctcgtgggtgggaacagcggccagaagttcccgcctcatggccttgaaccctcgacgagaaatgcgagcgcaagcccccccatcgaatgtggcgacggtcccttggggtatctggaaatccagatcctcactacctccgccatcgtcagcaggggccttgttcttggcctcctctcgctggtcactggttgaggtcacgggagccttgccctcccgtcgaccctgccgcttttcctcatcggcctttcggaaccgctcggccaagttcttgaccgagcggcagtcggcgagactgtggcggtaagtgttgtgcaccgaacaccacttgtccgccgaccggccttcgccggagggggcggtggagctcggcttatcgccggtaatctttcctttgcgcggggcccgcgtgggcccgtctgccgcaaggacatggccctcgtcgtcggaacgggccggtttcctcttgcctctcctatctcgccgcttagagcggggggcagactcgggggcagccgcagccgccgcaccggtgccaggagagttccaggcccacgcctcctccttccgggccaccttgtccgccagctcgaagagctcggcggtagtcttgggctccttggaggcgatcttctccagcatgcggttatgccgcacgccgttccggaatgcatacactactgcgtgggctggaatgcacggtatggtgtggcggacctggcagaagcgctgtatatacgaacggagggactcgtcgtccttccgccgcacagcatgcaggtccgcttcttcccccgggcggggatatgtcccctggaagttcgtgacgaactgctggcacagatcctcccaagagtgaatggagtcggggggctgggtcatcaaccagccacgcgcctgacccttaagggccatgggaaagtagttcgccataacccggtcgtcaccccctgccgccacgatgatcgtgttgtagatttggaggaactcggaggggttgatgctgccatcatacttctccgtgaggttggggcgaaacttcgggggccaccggacattccggagactcgcaacgaaagccctacaacctgcccccccaggggtgagcgtgaggggagggccgcctcgcgaagaagagcgtggcactccagatgaggaggcgccttcccccatgcgggtagcccggcgctcgtcccggcgtcgctcgatgttgacccgagcgtcctgcgccccgtagaggtcatcgtgacgcctgcgtcttctcgagaccttctatgtcgctggagccgtggatcgcctctaggttgtggcctatcgactggcccttctgctcgccgacgaggaaagggtagccggggcacttgatgtacctgtggcggtggattggccacccgtggccaactgccgctgggcagcggtgaccaagttggccacgtcgtccagccagcgccgtacgggggtctccggctccgggttcaccgggggatgccgcagaagggcgcccaccgcctgaagcgcgccttggggcgaaccaccgtctccgtagtcgagacgatgacgtgctccgacgcgtcgcgacctccctccgcctgggggcgggagagggccgtaccacttgaacgggttggatcctccctccgcgaaggctcgcggcggggaggacttcgagagccacggcgatggtgatgagggtcacggttttcgcccgaatccccactcccagacggggtgggggtaaacgccaccgcttcccccgcttccaggacctcgaccatggcggtctagggcctggtccgacttggagcggaaggaagcgacttcttctcaaacgcgcaactgccccctacctggcgcgccagctgtcgagggaagaccccccgatcgcgggaagtcgcgtgacccccctttcgtgagttcggccgagggcagagactcgtctctccgaagtcgcgtgttcgtccctccgatccccgtttagatagcacacaattcgattacccaggttcaggccgctctggagcgtaataccctcctcctgcgtttgggattatcagggacttttacaagggtctcttgctgctttcgctctcggggggcatgggcctccttttatagcttaagggatac

SEQ ID NO: 60976 - DNA, 4098 bp, Oryza sativa
tttattttcattgggattttaaaaatcaaacgtaattaccatttgggttctcttttttactttctagaagttccaccaaactgtcagcacctttaccattgcacacatgtactgctctcccgctgcctccctctttattgtctttgagattttaaaattcgaacatgattatcattgggtttttttttttactttttagaagtcccgccaaccgttgtaaccatgctactttatgacccgtccatcgtccctccttttaatcatcattgggattctatttggggtttgtttatagtttttagatattccatcaaccgccaccactctaatcctttacatgcatgttgcttctcctatatttgttgtcatttgtcatctttttataatttttagaagtcatatcaaaccctgtcaccgtacttctcttcggcctatccactgcctcttctctttattgtcattgggattttaaaaatcgaacataattattatttggattcatattttactttctataagtcccgccaactgccatgaccggctgcttaacggcccatccgtcgtccctccttttaatcatcattgggattctatttgaggttttgttaattgtttttagatgtcctgtcaaccgccaccgttctacttctttataaacttgttgcttctccccctctttattgttgtttgtcatcatttgtgttctagatggagttttttttagaagtccatatttttcattccgatatttttatttacaaattatattcctacttaaactcttataattatttttctattttcagaatttatttttttgttatttcaaattttagttaatcttgtgatatgttctagatggtctcttatttcaatagtttttatttttttatgacaaatttaagttatttataaattttattcctaggtgaactattatttttcctttttctatttttggaatttattttaatttttatttagaattttggttaatatcgtattatgtcttatatgaattattttttaatgttttttattttcaattttatagttgtttcatcctactcaaactatcttttttatttctctaatttcggattttattttatttttattccgaattttaattaatctcgtattggattcttatatggactcttcttttaatattctttatttttaattccgaattccaattatttctagattatattcctacatagactcttctttttccaatttcagattttattttatttttattccgaattttaattaatctcgtattggattcttatacgaactcttctttcaatattgcttatttataattccgaatttcagctatttttaaattatatttctatttggactcttcttttctttttcttcgattaatgtgggaatttctagccccacaacgaacgtgatgccttcttttcgagctgttttaataatataatagatagatagatagatagatagattagtaatttagaataagattagaagtattttagaattatgaatatggacatatatctatatccagatttaatatattcaaatttatagatctacggtggatgtaaagttaccgcatacttccttcgtcccaaaaaaacttaacctagtactcctatctagatttgttgtactagattatatcccatcgaagtagtaggttgagtttttttttttggacggagggagtattaccatgtagaacgccatcacttcgaatttcgttatgaaaaagctagttagtgctgatagatgattcaagaggtgaactagacatccttcaaaccgccttggcccttgagcgactctgcgactgaaccacttcaccactccccactccccacttcaccagcgaaccagccgcgccgagtgccgaactgccgctgcgctcgccttcgctccgcctcaaccacgttgcctcgggcctcttgccaccagcggagccatcagatctgcagctctctccgtgtccccggccgcgtccggcgtgctctctgcgcaggtgaatgttatccccccccccccccatccatcatcggcctttgtccttgccccgtgcagacctctattgtctttgcggaattctatcgaacaccttggcggcaaccacgagaatggggaatcggggatgactcggatgattgaggacatatcgcgggcccctccctcttgatggctcggttatgttattactagtctcgtgatggtattagaaaactgacatttttgccgtcaattggtaccccacaggtgatgtcgcagcagtagatagatgaggcgatgagccatccctagaactgaatgcggctgtgcatagcggagagcgtatcctttatggctttgtgtatgtgtatattttttaaggaaagtaagcttactgcttacgagatcacatggtactgtggtagtgtaaatcatgcgccaaaggatcaagagaaatgtgcactaaattgatattgtgtatatcatatccttacttgggcccttctgaataactgaacgcagcttgccatcaaataaaggtactggtatcgtacttctttctaaatgaacctacttagtttcatgcaagagttcatacagacactagaatattcaacagattcattacaattaagaacaagttgatatattattgccctaagaagaattcataacatgctcgaactgatcttttctctatggtataataattcttcttcttgcaaaataaaattagtgttgttattggtcaccattagtaggttgtctgattatcgcggtggttgtattctaggagaacttccagtatttaaatcattattagtgagctggttctttcaaggaaagagttcctttctggtccttacaaattttccaacgataggtgtagcagtctagcacctttcatcattatcttaattcacttgtttaggatcaaaatggccatattatatagtattaactactcgtaggtgaggcaccctcaaatcctatttgccattttaatctctgatactcagtgccttgagggaatttttagcaaacattctgcggactgtgctgattatcattgatttgtattatgtttacataactaccacacatgatcatggatgactaggtaagttacaggatgtcatactcaagtcaactatttattcttggattctatattctctttaagctttgtacattatctgggcaaatcagctagcagcctagcatattaattcaaccttactattccagggaacaacaaatacttaaattcgtaaatttatttgtggtcatatcgtgagacactactcgttgtctaaagcatgatggaagggtctttcctggttagatctctaacgggtgaaaaaatgtgaagaaatagttgttggatgctgttgctgtatttcccaacagatgactacaccagcaacacaactacaaattattcttagctacgtggaaatatatacgtggagaatgacacgtcagtatgaggagattctcaggagactcaccagaagtgcaaagttaagaactttaaacattggtacagcgttccactgatccaacacacttatttttctattggatgtacatttgaataaacaaacctgccactatactgaaatgaatttatagaagtatctgacttattttctctaacaagaactgtttacttcaagtattgtgcatgctaaactgaataactagtttttgatccttcaaatcaaaacactattgctttgcaggtcaccatgagtaggctgggtgattgtcttcgtcatcacatgccaggaaggcttttgcaatttcatccattgtaggcctgctgtttctttcttcaagacaagatatagcaacttccaccattacctttgcttgctcagaattgaaatgcccattcagtctagtatcaattacatccttgacgtccccagtagccagaatatgtttcatgacctgcacaaaatctctgagctccacctccctcccatccacttttatcccgcttgatatcctgcttccagttacaatctcaagaagaacaacaccataactgtagacatcaacctttgcatgtgattggtgagt

SEQ ID NO: 60977 - DNA, 6979 bp, Oryza sativa
ttatagcggagggaagcgagccgagcacgggagagggcggaacggcgacgggaatggtggccggcggcaaaggaaggcggccggacttggcgcggccgttcccggcgattgggggcaccattcaaggggaaattaagggggaaatagagagaagggaaaggggattaattcccctcaatcaatttgggaatcccatgcttgattcgcgcggatttgagggaggaagggagtagggttcgcacgggagggagagagaggaagggccgggcggctggaggttgggggcgacggcggcctgacgcgtgggccccacgcggtcgggcggcgtcagcgcgcgcgcggcgcgcggtcagcgcacgtgcgcgggagggggggggcggctcagctgggccgggacacggcccaggaggagaggagggggagaaggtgggccgggaaggagaggagggaggggcggcccagaaggaggaggagaggagggagtgggctgcccgggaggggaagagaggcccgggagagagagggagagaaggggagggagagaaagagagggaggagagaaggacttcgggctgggcttggcccaaaggaggaggagaattatttttagattttctttttaataaactttgttaattgtttttgttgcttaataattatttccggtgctctgaaaattcaagtaaaatttgagggctccttttagaccaaggagaatttaacaaaaattctctgggccacatttgaatttttcttgcacgtattttagtgtttgccaatttcttttcgaattttaattaattctattattccttttagcgaatgatttttatttcgggatgaatttatcaggacgtgacaaatccaccccccttacaagaatctcgtccccgagattcgaggaggctagcaagaagataggttgggcggtcttctcttcttgtccgacttcttccgtcgcatcttttataacaaacttgcctagcaaaacttctccactctggactgcttggctcaatctcctgttgcagatggaatcttctcttcacctgacttttccctggttgcacctctagctgacttcgactggattgtggcacttgaagatgggacttcagttccagacttctcataattcatatctttggcgtcaacctcatacaagttacccacttcacgttatgcgtcgatatcagcttgtcattactaggataccatgcttgttatcatgagaatatcatgcttgtcatttacttctaacttaccactattcacttcatgttgtcctcagttagcattcaacgtattcctttaccctttgaccttgatgtgttctttcccgatttctcttatcaatcacctttcgacctacttctttgcctggtaataaacatctttttcgatatcttctatcagtcatcttttgacctttgtcactaagtactcttcactccgagagttgtggatgcttctggtggcgatgaggtcctttggtctgctacctttcagtgaaaccttgaagtgtttcgccaaaagctatactgactgtcattgcctttgatccgaaaaagacacatctgaaactcttagtccaaacaaatgtctctttggttaatcacttgattttcttttccatcctcaggtgggttattagctcgagggtagaatatagttcctctggcacgagaccctaggtctcctttttcagtaaacaattatacacatgatcacatatccgcatcttccaatagaatcctctcagaacttgtctgtattacacatttctccctcattacatgaatactaagcactgcctaaaaggaaaggtgattggcattggtacattgtttctgctatgggttctgattaacccgaggccttacgggtacggcgtttgctccagtgaccacaatacgattgggatgtctgcttcgtgtaaattggcggtaatgtggaggtcgactttgccttggttgcaggcagtccctcgagtaatgccctggttctttgcagttgtaacaaatcaacgtcttctttactgagctgtccatctggggacgatcattttgacttggagttggaattggtggttgggaatccttgctaacattggcatcagtggtaccatagttgctatcaccattggagtctttctcagtgtcgaaattgctaaggttgtcattctgggttccaacattgatactatcgttgacatcttggtgaatgctactgacattgcacgctttattcgagtggtcactaatggggcaagaaccatggttgttggtggtatcatcatcattagtattgctagtgttgttgtctgtattgcgtccatcttcttggggcggaaactcttgatgcgcaacagaagatccggtgatctgaagtggctcagtgcgctgtctttggttaccacctggaaatactgggatgttgacaatccttctcttgcagttcgtcatccgattatgctcactttcgagttgcatggctttgtccacaagtttctcaaaatcttcataatcctctagaagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcggaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggccatggcaaaggttggaggccccgttttgagaaattctgataacttgcactgttgctggactgtaggtacttgaacgttggttgcccctgctgggttgttccgattctgtaatagttgaaaggctgttgccaacatgttggtttggttaaccacaatttggattagctctggtgaggtttcgttgatgcttttctcattcccattggcttgggttcttgagtcatcggatccatcattcccatagcctttgttaccagtgttatccatctgtcacaaggtaggggttgagagaggaagcatacaaggaaagaatagaccagagctagggacaggaccttaaaggaactaactctttttgttgatgtgttgtttgttttgcttattctgcaagttgattaagcaaacaacctagcatggttacatcaccacccaccgatgcaaaccacgcgctacacacacaagcaaggaacacacgactaacaacactaccctatagggcggcttaggttctgcgacgggttttctaagatcttcactcctgcttcacagctggcttcactgcttcctccacttcgctagcggatcctgcattcttccggagcttcggcaaacaactgacgacatcttcttcttcgcaaagctgaccatctagtactagttgaaatttgaagaaggaagaaaagggtaaaccctttgcaaatagcattaggggaaggagaaaaagaggaactttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacagctccatcttcacaggcgctcaactggggtataagccaggactccacctaagacttcttctccaaagcttctcttactgaaggggggagaaagatagagcaagaatgagtacaaccacagtactcagcaagccacaccggagatgcataattaatgcaagggagtacaaggggataataatataggggttaagttttgcagtaacagcctttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggcgtacatctttacccacaagacacatcttcctcacgtgcaaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttataaccaggctgagccacaaactaagccttacccactagacatgtggaagtacggtagtgctttgcaacagaggcccaagcttaatccttatagtacccgaggtacgactaacaaaacccaaccacgcacctcgagcccagcctaaaccattttgggggttttgaaaagagggggaggtgtgtgtccaattccaacataagccaaccattccatagtgtccaaatgatatgagagttcccaaagtctaaagttataaaatcacctaatgttgcctaattaaccagcgaagcatctacctaagttcatactagtggaaccataaatagagtacccactagttggggttttgtttaatctagggtgaacaaggtaataatatcaataacaataatattaaggtcataacaaaggtaaataggcatggctaaataaaacagtgataacgcgggaatttaaataaagcgataatgcattaatttaaattaaaaataattttgtaaactgggattcaatatgctcaaggatgatgtgacttgccttgctcagagagaacggccttccgaaccttcggcgacgaccacgaaccacgcttcgggaacctccggaacgacagaagctacgcgaagcacacaagcaaagctacaagcctataaagaagcaataacaatacataaaaagaaagcacagggttctttaggttataacaaacattaagagacttgaacgggtcgattcggagttcgtatgaccaagatatgatcatccgaggtttaatgctgttatatggagatttgcggattattataatcaagctttgcaattataaaacatgtgcaagcgctagcctggaaaagacaggaaggctgcgccgttgacatgcggaccccacatgtcaacctaaaggaccgcggtagaccgagtacacagagtcggtccacgggtcgacggaagcggatcccgtgtgtcaaccgaggcgagtggccgacaaacggactccactagacaccacacggcctgcacacgtggaaaccacgcggctaccgagcgggcacactaacgcggacactacacggtcaccacccgcacgcgtgaacgactaccgacaccggtacacgggtaccggggtcgtcaaccgcacaacgggcacgggcgacaccgaaaggacgagaacggggcagcgagaggacggatccttaccaccacgcgacgaggcgtaggaacgacaacgacgaacgggcgcggcggagacagacgggcacaacggagacgaacggcgaggggacggcttcggcggcgatccttggacgaaggcgagacgcggccggcacggggcttgacgacgcggagccgaggacgaagacgaggacggggctgcagcggcgcgcttgacgaatgcggacgacggacgagaacggctcgacggagggacgaacgccacgacgaccgggaacgacgagaggacgacgacgacgacgacgaccgggaccggcgaggaggcgacgaggacagccggcagcggctgcacggggacgaggatgacgtggaacacgccgctacgatgacgatgacggaggcggcgccgcgagacgacgagccgggcgaccgacgggacgtcgacgacgagaacgatcggagacgacgatgaaacgatgatggcaggcagcagcggctgagtggaggaggggacggcgtggaacacgccgctgcgatgttggtgaaggtggtggtgcagcggggcgacgagccgacgaggaggaaggagaggccggcgcggagatgacggcgttccggcgaaattcgggcgacgccgtggcctggccgggagagaggacggcactccggtgccgggagaggtggtggcgacgtcggccggtgcaccggggacgcggcagaggcggccggaggcggagaagtggtggcgacgccactggacgccggcgaggacgcgtctccggtgatttccccgcgaaacggaggcgaagccgggaaagaggaggcggctgcgacgccgggagaggtggcggcgcggccggagggtgcacgggcgaggcgggaggtgcggctggaggtggccggcaaggaggaatgagaagggcgacggcgggagtgcgcctccggcggtcaccgcgcgaaacggagggcaggccggggtggaggaggtggcggcgacgctggaggaggcgacggcgcggccggccggcgcacggtcgaggcg

SEQ ID NO: 60978 - DNA, 6874 bp, Oryza sativa
ggcccagaagcagtaggagaggagggagtgggctgcccgggaggggaagagaggcccgggagagagagggagagaaggggagggagagaaagagagggaggagagaaggacttcgggctgggcttggcccaaaggaggaggagaattatttttagattttctttttaataaactttgttaattgtttttgttgcttaataattatttccggtgctctgaaaattcaagtaaaatttgagggctccttttagaccaaggagaatttaacaaaaattctctgggccacatttgaatttttcttgcacgtattttagtgtttgccaatttcttttcgaattttaattaattctattattccttttagcgaatgatttttatttcgggatgaatttatcaggacgtgacactagggaaaaagctcgacgccgcccaaagggtgcttgacactgccgctgcccaagagcagcgggcggcggagaccgaagcggcgtcccgacagcgcgaagagacccttgaggcgcgcgccatggcgctggaagagcgcgcctgcgtcgtggagaaggacctggcggaccgcgaggccgccgtcgccatccgggaggcaacgctggcggcgcacgagtctgcctgcgccgaagaggagtccgcactccgcctccgcgaggacgcgcttaccgagcgggagcgagctctcgaagaggccgaggccgcggcgcaacggttggatgacagcctgtccctccgtgaggcagcgctggcggagcaggcacgccgcaatctagaatgtgtccgcgccgagagggccgcactggaccagcgggccgctgacctcgaggcgcgggaaaaggagctggactcgagggcacgcagcggcggggcggctgcgggcgaaagtgacttagccacccgcctcgcagctaccgaactcaccatcgccgacatgcagcgcgcgctagactcatccgccggggaagccgaggccctccgcttggcgagcgagatagggcccggcatgctttgggatgcagtctcccgtctggatcgcgccggtcggcaagtgggcctctggaaaggccagacaatgaagtactccaccaaccagggaggcctcgctcagcacctctcgaagatggccggggctctccagcagctccccgaggagctcgagaagaccatcaagtcatcctcgagggacctcgcccaaggagcggtggaactcgtactagcgagttaccaggccagggaccccaacttctccccatggatggcgctggatgagttccctcccgggaccgaggacgacgcgcgcgcgcgggttcgggatgccgccgaacatatcgtccacagcttcgagggctcggcccctcggctcgcgtttgcccccaactccgacgaggaggacgatgccggaggtgcagacgatagtgacgacgaggccggcgacccgggagcatcggactgagcccccagggcgcccccagtctttagtttttccttttttttccttcttctaaggccttcgggcctcttttttgtatagaccaacttaatctgtaatcaaaaatgcagaaattttttgtgttaatttcattttgctatgtgcatgagatgaggacgatctgtgccatggtccttttgtgtcttagcttgattaagggctcgtgtccaagtcccaatcctcaaaaggcgcgggtcggggctagtgcctggggagatccacatgtcgagactggccagggcggaaacgtggtgaccgagggttatgggtgacccgattgtgggtttttgccgattcccccccggagttcaccacgccccggggcacggctcggttctgggccccgtttggcggttttagccgacccgagcccccgagggcaggattgagcacaagtgacctatttcaagtcaagattcttcaaaaggaaaaaatagcacagatacggcctttaggagaatgaaacttcttttattgaaatactgaaacaagagaaataagaatgtgcatgtgtggcagcccccggccaaccctgcacgcccaagggggtgcggggttggcccgagcccgaaacctgacacccgaccccccctctcaggggtagaagcgacgaaggtgttcgatgttccacgggttaggcagctctgtgccgtcgcccgtggccagccgcacggaacccggccgggggacaccgatcactcgatacggaccctcccacattggtgagagcttgctcaatccagcacgcgtttggacgcggcgtaggacaaggtcgtcgacgcagagtgatcgggcccggacttggcgctgatggtagcgccgcaggctctgctggtaacgcgcggctcggagggccgcgcgccgccttcgttcttccaagtagtcgaggtcatctctacgaagctgatcttgatcagcctcgcagtacatggtggcccgaggagacctcagggtgagctcggatgggagaactgcttccgcgccgtagacgaggaagaaaggcgtttctccagtcgctcggcttggtgtagttcggtttgcccagagcaccgctggcaactcctcgacccatgaatcgccgtgcttcttgagtatgttgtaagtcttggttttaaggcctttgaggatttccaaattggcgcgctccacttggccattgcttctggggtgggcaggtgaggcgaagcagagcttgatgcccatgtcttcgcagtagtcgccgaagagttcactagtgaattaggtgccattatctgtaataatacggttgggcactccaaaccgggccgtgatgcccttaatgaatttaagtgcggagtacttatcgatcttgatgaccggataagcctcgggccacttagtgaacttgtcgatcgcgacatacagatactcaaacccgcccggggcccgcctaaacggtcccaggatatcgagcccccagacagcaaatggccacgaaagtggtatggtctgcagagcctgggccggctgatggatttgcttggcgtggaattgacacgctctacatcgccggaccaggtcgaccgcatcactgagagctgtcggccaatagaaaccctggcgaaaagctttaccaaccaaggtgcgcgaggcggagtgtgctccgcattcgccttcatggatatcggcaagaagcacaacgccttgttcccgaggaatgcacttcaggagaactccattagccgcgcgccgatagagggtcccttctaccagcacatagcgtttggagatacgttggacgcgttcactcccttcgcggtcctcgggtagagtcttatctgtgaggtatgcttgaatctcagcgatccaagcaatcaatctaagggagctaggagcgctcccctcgggtcccgaggcttgggctccgacgggcctcgggggccgatcaggcgcgtccatctcccctaaggggtcgggtcgcgccgacggctgggcaagcctttcttcaaagacgcccggtggggtctgggctcgcgaggacgcgagtcgtgagagttcgtcggctatcatattatcccgtctgggcacgtgccgaagctctatcccgtcaaaatggcgctccatgcgccgtacttggcgcacgtaggcgtccatctgcggatcagagcaccggtactccttacagacttggttaacgaccagctgggagtcgcctaataccaggaggcggcggatccccagtccagctgccactctgagtccggcaaggagtccctcgtactctgccatattattggtcgctcgaaagtcgaggcggaccaagtatctgaggacgtctctgctcggagaggtcaatgtgacccccgcaccggcgccctgaagagacagggagccatcgaactgcatcacccaatgggcggtgtgaggcaactgcgaggggtccgtgctggcctcagggatcgagacgggctcgggagccggggtccactctgccacaaagtcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcacacttgtcttcggtgctgatgacctcggggtcggaggataacaggggcggccttacctcagtggcttcggggccatcctgggggtcgggggctcctgttgtcgtcggacaagcgggcaaagggccaactccggtcgtcaggggccttaggcctccgttcggctcgggggcctcttctccctgctctttcccgggttgagtcagcacagggtgagcctcggggtcaaagggtgataggtgcggccttcccatagtggcctcagggccttcctgtgggtcgggggctcctagcaccatctgacaagcgggcagagagccaactccggtcgtcgggggccttgggccaccgttcggctcgggggcctctcctccctgccctctcccgggctgagtcagcacagggttgggatgcgtggagtgaggattgtcctcatcgcgctccacaaccaatgctgcactaactacttgcggggtcgccgctaagtagagtagcaagggctcatttggctccggggcgactagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagtttgctgggggggcgcatccgctctatagctcgtatcttctcggggttagcctcaatgcctcgggcagagaccaagaacccgagaagcttgcccgcaggtacaccgaacacacacttatcggggttcagttttatgcgggcggagcggagaccctcaaaggtttccgctagatctgagagtaacgtttcttggttgcgcgtctttacaaccaagtcatcgacataagcctcaacattacgtcctaattggctacccaaagaaattcgagtagtacgctgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcaccttgggaacgaccaccgggttcgccagccagtccggatggatgacctctcggatgaatccggcctccagaagtcgcgccacctcctcgcggatgaaggcttgacgttccggggcctgtcgccgcactttctgccggaccggccttgcgcccggccgtacggcgagacggtgctcaatcacttccctggggaccccgggcatatccgccggtctccatgcgaagacgtcagcatttgcccgcaggaaggagacgagcgcgtcttcctatttgccgttcagaagaccaccgatccgcgtggtcttggacgggccgtcgcccagggcaacctccttgaccgggacctcgtcgcatgtgatcatccgctgcctcggggtagcgggggcggaggcgccaagcctctcatcgccaccctcgggcttggacgcggcggcgagatggtctacgcgctgctccatgcaagcaagcgcgactttgaggtcaccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtacggaaattggcggatccaccgaaggtgaccgggaggtcgatatgacctagcggccaagtgtgtcccgacgtcacaccgataatcggctgggacggccggagcaccatccccggggccttgatggcgtcaaaggtcgcgggggaaaggatgttgagggctgctcctccatcaatgaggactcgccccaacttcacattgcaaacggtgggggaaaccaccatcgcaatctgccctccccgggcaacgcacggtgggtggtcggtctggtcaaaggtgagggcaacctccgaccaccgcgcccgacgcgtcgcctcatgagtaggggccgcggccagaagctctcgcttcatagccttgaagctccggcgagaaacgtgagcacacgctcccccatcgacggtggcaatggtggccccaggctcttggaaacctaggtcatcatcgccatcatcgatgtcctcggcgggggccctctgcttggcctcacttcgccgattgccggaaggaaccgccggggacttgccttcccggcgcccctgcctcctctcctcctcccacttccttgtccgctcagccaagcttttgactgcgcgacagtccgcaaggtcatggagggaggtgttgtggacggtgcaccacttgccggtggggcgctccctgctgggagcgctggcctccttctttttgtcgctcgcaggcctcccctttcgggtggcccacgaagcgccctcgacggcgaggacatgaccctcgtcgtcggaatggactgacctctttttcctcctcctgtcacgccgcccctgtttgagcagcggatccgggggcggccgaagctgccacaccggaaccggaggggttccaagtccaggc

SEQ ID NO: 60979 - DNA, 4874 bp, Oryza sativa
ccccccctgaacgcgtaaattaccgcgtgtgcagggatgcacggtatggtgttgcggacttgacagaaccgctgaatgtacgagcgaagcgactcatcatcccttcgctgtactgcgtgtaagtccgcttcttcacctgggcgcggatatgtgccctgaaagttcatagtgaactgctggcacaaatcctcccaggagtggacagacgcgggtggcaagttcattagccaaccccgcgcttgccccttcagggccatgggaaagaaattcgccatgaccctgtcatcacccccggcggcctcaatcccggtcgtgtagacctggagaaactcggcggggttgatgctgccatcatatttttcagcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggtgtgggcgtcctgctccccacgcagatcttcccgggtcgaaggagtcgacgaaggagtggcagccgaacggcgaacagcggctgccgctcgtcgtgccctccgtcttgacgacgcggagccggtggtagcagcaccagaggccttggtggcggaggaccgtccaccagcatctaggcgctgcctgtcacatcctgattttcgtttcaggatttataaattatttaataaattattaatagaatttatattaaatgatctttaactttcaagtgaagtaaaatgtgggaaataaaattttctaaatctaaagcatggatggatttaatttttgttaaattctccatggttaagtcaactctctgaaattttctcggatttttcagagctcaattcttaaataatacaaagaatagttcagtaattatttgatcattaatgatctaagtataattgttaagatcttttcttgtttaaaaatccttaacttataaatggttgtttaaaaggaattattagaaatgattttaaaagcctaaaagagaagatctaattttaatttgctaaatctcaatataaaaaggggccagataaaatttcattaaatactttgcttaattctataattcctagatttttctgggatttatttgagctaaggaagtatttttaataaatggaattgcatttaagaaataatttaattgaaaaaggttttaaaaagtcttcttttggctttgggccgaaagccggcccaaaacccttctctctctttccctcggcccagccggcccagtccgccgagccgccactcttctctctctcggtgtcgctgacaggtgggtcccacgtgtcaggttcgtcttcctcgagccgccgctgccgcccgaaaccctagcgcgccgccgtcgccgtttccttccaaatccggccgctcctttccttctccggccgaattgattgaggggaaacaatctccgggatctcctctaccttttctcctttggaaacatcggctaaatcgttttggaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgtcgtcggtcgccgtcgccaccatcgggttcgccaagtcgtcgccgtccccgtccaccgcttcgccgccgccgaagaccgtcggagcgccatcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctatccgctccgccgagctgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcttaataaattcatttgaagtcagaatgaggccgttcaagtctcataattcatctaaaaatatgatctacatgtttgtttactttttatgtactgtttatttggtttttattagtctttttcttcgttttgcgtgttagcttgtcgtttccgtcgttgcgaaggttcgtgagtgcgtcgggagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttaatccttgataccttgggttattataatttgactagttgagctttatatattggttcagctagatattagatgtgattgcttagccatgcttagaaacattagcacactattgggataacttatgattcattattatttaatgatggtttaatggtagctcacgatggtcaatcgtgattggttaattaatttcttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtatagcatggttcattgcggggcaccagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcacaataattatggatgttatacctgataataatttgcttagctcttggtttggagattagatctgtacagccgggtatggttgttcaggatggttgggcctgtgcagcatgggtgtgctgttcaatgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgtgggagtggagctggagcttcgctagattttattttccgctgcagttttcttcttggtgaggacttagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacactgccgcgccgtcatgaccaatttggccacgtcgtccagccatcgttgggctggagactccgggtcagggacgacaggcgggtggcgtaagagcgcgcccgcagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtggagggggcggtggagtacgagctcgacggcgtgggttcggctccccgtcgtcgccactcacactcggagagaggtcgtgcgcctttgcttgctcggccatcaggctgaacaggaaaagcttggtgcacagggcagagtgcgagagctcagaagacacacgctgaggccccctacctggcgcgccagatgacggagcgtggggctcctcaccgggagaccgcacaggccccccctttgccggttcggtcgggggctcagggtgaaatcccaagctctctctgtatgtggaaagatcgcgacctatcgaaagagcatgaggcacaggcgatgtatacaggttcgggccgctgagaagcgtaataccctactcctgtgttttggtggatctgtgtatgaaggagctacaaagtgtgagccaacctctcccttgttctaggttccgaatctggagaaaaatcccct

SEQ ID NO: 60980 - DNA, 3995 bp, Oryza sativa
cttcttcacacacatcttgcttgtaacgttaggatgaagcctggcatatatccgaccggggctaacgtgccatctctggtaggtaacacgctagctccagctggggacgagtgcctagaagctctcgtcttgacgggatggggcgaagcgcgcgtcagaccgcctgttgccacctaacccgcgatctgaccggtctgtgactggtcacagaccggataaacgagtgcactgcactgcatttcgtgcggcgtgacacgtttaggcgagccgcaataaatgcggttcggtgagccccgctgtgctcacctaacccatacacgcggagtagaacccgcgaggggtcggggcgcctcggccctcgggggcgaggcaggagtggtccgacccccctcggggagaccaagaggtgggcgcacacatcaccctcgggcccgacgtcccccgagggtgccaggccacgtgggcgattgtgtctgcctcaagcctctagtcatgatactcccggtcccatgtcaccgacaatattgtatatggagtagactattagattggttgtaaatgattttagagctagcaattgactatactaataaacttgctcttataattactagcatgcaagtaagtctttgtattgagttgcattttatgttcggatttgcaaaactttgagccaattctaccctatattatttaatgagaaaatggggattataccatcctcaaaacagggcttcgctgaaatgccatcctacaattgggattcgcccaaataccactttcaactgagcccaacccgctgaaatgccattctcttcatttgtagtaaatcaaaatcattttctctcttttctcacaactttgatgaccaaaatacccctggttcattcgatttagaggatatagagtaccatatacacaggatgtgatgaacatatgaaaaaaggacctttacatcctaggaactaccacaccgagcgtgccttaaacaacaccacgtaagaatcactcattaagcatcattaacagcattcaaacaacaccagttaagcatcattaagagcatgcttcccagatcattcgcagatcactcccaaccacaaaatgcataatcactcaaactgagttcatatatcataaacattggaatccatctgcatcactcctgcaagtagatctgagacggcgacagaccggcgtggagaggggccgcagtacaaccgagcgcagggcggcgtgaggggaggctgccagccgagccgcgacgctaggggagggcgccggccgagccgcggtgcgaggggagggcgcgccggccaagcgtcggcgcgaggggagggcgccggccgagccgcggcgcgaggggagacctcgtcggcgccaggggagagccgcggcgtgaggggagggcggcgacctcgtcggcgccacgggacggccgcaacgcggcgcggtggcgctggtgaaggacgacgacacggagcggcggcgcgaggggaggcgcgccgcgtcgtcgcgaggggagggcacgacggagcggcggctggagggaagggcaaggcggcgcggcggcggtagggaggtcgtgcggcggcgcccagatcggcgccgcggacaaaaccctaaccctatgcgtctcgctctcccagccgattgatttctaaggatgaaattgactgaggggtaatttcgtcaactcatgtgaaaagtagagtaaaatcttttatttttgatgaaaatgatttgggatggcatttcagcgggttgggctcagttgaaagtggtatttgggcgaatcccaattgtaggatggcatttcagcgaagccctgttttgaggatggtataatccccattttctcattatttaatataacgcaaaatttagacttatccatgtatgagactctaaccctcctcgtaagtatacatcccaaattaaaaattcatgtatccctgtaaaaataaaaattaaaaattcatgatgtcgatgtttgatgtcgcgattccggtgtttgtatagtatgaggatcgttggtactaggatgacggagcgtggggctcctcaccgggagaccgcgctggcccccctttgcagattcggccggggaccctgggtgagactctaaactcccaatctgtatgtggaaggttcgcgagacaggaagcacagaagacaccggcgatgtatacaggttcgggccgctgagaagcgtaataccctattcctgtgtttttgggagatctgtgtatgaaagagctacaaagtatcagccagcctctcccttgttctgggcccctaatctggaaaggtccagtccaagaaaaagctctctctaaaatctatccccttctctccgtgggcaaggtcctccttttatatcttaaggggataccacatgcaccatcccccccttttttatggggacttaccctaccttttcacaaatggacggagatctgcatggttgccgttcgagtcaccttctgatgggacggcccgcacctacctccactttcgccgggagcaggtgcgacgtagaatcatggctgtctgctggcgacatgaccggtgtcagaatggtcacaaatcgatcattcttgtccaccacgtgtcagcttagcaatctgcacgttggccctccttcacactacattttgcctgtaatggttaggatgaagcctggcatatatctgatcaggactaacgtgtcatctctgggaggtaacacgctagctccagctggggacgagcgcctagaagccctcgtcctgacgggatggggcgaggcgtgcgtcagaccgcctgtcgccacctaatcccgcgatctgaccggtctgtgactggtcacagaccggataaatgagtgcaatgcactacgttacatgcgtcgtgacacgctcagccaaaccgcaataaatgtggttaggtgagccccactgtgctcacctaccccatacacgcggagcgaaaacccacgaggggtcggggcgcctcggccctcggggccgaggggggtgcagcccgaccccctcgggggactaagaggagggcgaacacaccaccttcgggcccgacgtcccccgagggtgccaggccacgtgggcgattgtgtctgcctcaaacctctagtcatgatactcccgatcccatgtcaccgacataggatatacgcgagacttaggtaaaagagacggagacgaggatttttatacaggttcgggcccctgaattgttaggtaataaccctacattctgttggccgaagccgatcgttgctcttattcatcataatcacaccagtacaatatttggggtagcctatctaactgttgtcgacatggtggtctgaagctctgactcgtagtcgacaacagggtagtcttcctcctcgaatccgggctcgacgagatcagagatagcgctttcatctctcctgatagtatccggagacaccgtaggggactagccatgcctatctctgaagtcgatatccggcgtcttgtcttagcgtatgttagcttgtataatgtggcttctgttttgatctattgttccgtgtctgtcgattgtggtgggtgttgattgtctccccctctcctgctagggggccttgtatttatacccataggtgtcctcttgtctaagtagaactagggaaaccaatatggatacaatccgagtagtccatatcgtttccatgtagaactctggctgtctttccttatccggatctccctccatatccgaggtcagtttccgtataagacatgatatgtggtgggtcctgccaagatgtagttgactactgttaggtatgtggtatccataaccctgacacatataaatgtttttttcagataaaatgcctcaccaaatagatgccttcctctctctctctctttatacaatccagccaaagagatatttcatatgtttcccaatgtaagccattctagcatttcccaaattcatattgatgttaatgaatctag

SEQ ID NO: 60981 - DNA, 1276 bp, Oryza sativa
tattgggagctctagtgctaatcttcacaggtacaagctggtggtttctttacagcaagcacaacatacccatgtcaatggaggcaggctacaggatggtaacaagccaattcaggatgttcacgtaccgagaattaagggaggcaactggaaagttcaaggaagagattggaagaggagcctctggtattgtttacagaggagtacttgaagataagagagtgatagccgtgaagaggctaatgaatatttcacatggtgaggaggaattctgggcagaaatgagtattattggaaggatcaatcacatgaacttagttaggatgtggggtttttgctccgagggtcaacaaaaactactggtgtatgagtatgtggacaatgaatcactggacaagtatttatttggtgatgtaagtgctgagcgattgcttgcatggagccaacggttcaaaatagcgttgggtacagctagaggtttggcctatctccatcacgagtgcctagagtgggttgtccattgtgatgtaaaaccagagaacatacttctgaccagagattttgaagtgaagatagcagactttggactagccaaacttgcaaagagagacagcactagtttcaatttcacccatatgaggggcacaatgggctacatggcaccagaatgggcgttgaatttgccgatcaatgcaaaggttgatgtctacagctatggagtagtgctccttgagattgtgacaggaatcagggtttcaagcggcatagtggtagatgaaaggcaagtggagtttccagagtttgtccaggaggccaaaaagattcaggctacagggaatgtcaccgatttagtggatgacagactgcatggacactttgatccagagcaagtaattacaatggtgaaggtagctctttcatgcctggaagaaagaagcaagaggccaacaatggatgaaattctgaaggctctcatgttatgtgatgacgaagacgactaccatcctgcctattcatattagcctgcagctactgcataaattttgagatgtgtacgtaataggatatcctagatgatgtaattataggcatagctagatatggtgacaagggcttattgtttatgacattggaatgattatattgcataatgtaacaagttttgttctgtagatgaaatgagtgaatgaatagtatgcagggctattccagaattgattggtttgttcgttttctctcaattatctctacaagcctacaaactttaaccgtcatt

SEQ ID NO: 60982 - DNA, 8020 bp, Oryza sativa
agtaaatgtctgtaaatctccgaccaggctttcattccccccaaacagaagggctcccatgcatatcgatcatgagctagcttattaccccctgcttttgcctcttccaaatctgatgaactgggtaagttaactgaatattgcttaactaatcagctttttgtttcatctgatggatagataggaggagtagatcttggtggcatgaactgcatgagatgcagattggtgtaatgatggggggaaagactgcatgactgtacaattgcacacttatcagagctacttgggatctcttctcttctcttctctctctgcaataattagcctttgatgagatgaagggtgatgaggaaaaggctgtcatcattaaaggcctttgttccatgcagatcctatccttcatggttggaactagctagtctgtattcatcaggtacaaataccttgcttaatctttcttctttcatatgtatgttcatctgatctttacctttgcttgggtatcacaactcttagctagcttgactgatctaaaaaatgcttttttttttatagtttttggtgatctatttttcatcttcgtttttcttcatgttctaccttgcctggtaggataatgaaacatgaagtacatatatcatgctctgtagtacactccgggagaaatatatggatatttacttcctgttaatttgttgcttggagtagatctagagagaaaaaccaactctttgcactgtgcgtggattctttacctttttctccttcaatttttgtctctctccaaataatgttgcattgggacatattaatttgattccagtttaagggaattaataggtagctagcagatttccatttatactttggtcactgaggttaattaattaattgcctataaattgttccgataactgattcacactgttcaagagaaaaggcaagctagattcatattcttcagagtaatgctccggtgcaatctacttgcagtattctactccaagtagaataatcttgaccgtttattttaaagagcaggtaagtaatctcctaatatcgtttaggggtaattttggcatgggatgttttcttctgttcgcatcgtatcaggtctgaactccgttgcacgcagtcacctcgctattcctcccccggcctagccgccttgtccgccccctccgtcgccatccgtattccccgccgtcgccgccttgtccgcttcctcagtcgcatcgtccgtctgggagcggacgagtgtggtggcgtccgagcaagtgacgatcttgagcaggagttctggcggtagtaaaaattccagcctaggcttcggcggcagcgtcacgcacgcacgcaatgtcatttgcttggcagcgtcgtctcggctcattcgtcttcttgccgtttccgatcactgtgttgtttcatggattacatggatcgattaagatcttgcacgaccaactccgacgaggatgacatggtgatcgatctatggatcggaaaacaataataccccttcgcgaattatttttcctagacaaaaacacccctccacatttcacttccactaattctggtaggagtaaaactagatcttaaccctacaattaaatatgatcaagggcctagattactttttactccgagtagaaagcaccagagtaggactctattcttcattcatggtcaaatcatgacaagggtttgagatcagcagagcagatatatctttattaatttttggtggtaactatatataatttcagctaaaccggccaagtagttaattactgtgcctttttttttctcttctgtttactttatgatccagtagctaccataaatgctgtagaaagaatatactgcaaagggcacgtagatttttaccttctaataaatgaaatggaactgcgggaaactattctaaactctcgagtggatgtcttctcgttgtgcatatatacgagatcatgatcttaccaaacaataacaagttcatatataagatgtgcatttctatgacaatatatatactacatattgattttttatattaatttgcaagctacattcatgctgatcatgatgatgagatttaattttgttcattcaattcttagaacactaatcaaaagtaaacatcggacttttgattaatctgaaaacttaaatattatcgatatagctacagtatatgtttgtcagggcactagctagctgattctcgatcagctagctgcaggggagtatatttgacaccagtgcattggtgttggtgtaaaccttgttgttatgtatcaactctgagttgtttcctgtttgaagccttgagctctagcttccccatacagtactacacccattattttttgtgtcgagatgctcatacattgagttatgtagtgcgtgctgcatgtacaaaatggtgtttccagtgatcccaaatccctaaagattctcttgttatgttgtacattgtctttgattgctatagtagctcttaagttttaattactccttttttataattctttcaggatctctcatgttcaaatgttttcagaaaaaggaacctcccttttgcctctctgttggcagttttgctctcctttttttcttcagactgttagctgtactagtgaacatgtatatagttcttcataaaaaaaaaggtaatcccttttgtagctattgcaatataatatgaatcaggagtggtgttttaattagccccatatatacatgcatgctagctaggcagctataacagccagctaatacgtgtagttgcaaattatatatgaaatcaattaaagggacgctaaatcattcagtccagggaggatgtatatataatcgatcagaaaaattaaccaactaattaatctaatatatattgattgcgtctatagatatatccacatctatctctcatttcagagaggtgataattagcgatataagtgtacaaaaccggttattacgtctgacaaagagaggttccgttaattgcagagaatgactcgtgtgagcactgaccagtcaaagcatgtacagctcgttgagtagggcacacgtgtgaatagatgcctttgcatgcgtcgccatagctacttaattacaattataatagtgtagtacatgattacatctaaattggtaacctttctcctctctgttttgtaaacaagtacatctacacgttgacagcagtaagtgcgtgtgtgaatagtgattcttaaaaaaaaaaagactactgactactgcatgtatgagcaacaggactggtgttttctcaagttggtttgattgagtatgcatttgtatttgcagataacaagtggattccacacgcatctgttaagttatatttacgtgtaattattttacgcgttcgtgaaaaatacttggttttctttgacagatgattcgctggattattgttatagcggattatctagttggttataagaaatctaaatattaaatatttttaaaaataaacttatgaactacttcctccattttgctttaactttttctaaaatcaaacttaattagttttattaaactttacgtatgtttgtttgatgttgaaaatatatattgttatatttttctatagttataattaacataaaagaaattcaaatttagaaaaacaatgcatcttatataattaatgtggaacggatggagtagtttataataagtgatctaaccaacatagtagttttttttagaaaacatatttttagaagcgtagagcaaataatctacccctccgtgagaaaaaaaaagctcacttatagtgcggtttttttaaggacggagggagcgtacatcaataatccaatgaagtagtccctctcttaaaagaagttcaattcagaggatgaatactcatccctaatattgtgtttctagagggagtagcgtaggagtacatatggatgatgcatgcaacactaatcagaaaatccattccataactatagactaattcgcgagacgaatctattaagcctaattaatccatgattagcctatttgatgccacagtaaacatgtggctaattatggattaattaggcttaaaaaatttgtctcacgaattagctctcatttatgcaattagttttattattagtctatgtttaatacttctaattagtgtccaagcatccgatgtgtccctgatccaaacaccacctgagtacgcagtagtattactccgatacaagctgtgtttagatctaggggtgtaaagttttgacatgtcacatcggatatacagacacacatttgaagtattaaacatagactaataacaaaataaattatataatccacctgtaaaccgcgagacgaatttattaagcctaattaatccatcattagtaaatgtttactatagcaccacattgttaaactatggcgtaattaggcttaaaagattcgcctcataatttacattcaatctgtgtaattagttattttttcgtctatatttaatactccaatactctatacatatcacgtgtccaatcattcgatgtgatatggtgtaaaattttactatgagatctgaacagggccatactatctgcgtacgttgatggcagtcttgacatgaggtatcatgcagatgctgagatgcagaaggaagcagtagcaacactcatgtcagaagccaatttttaagatgtgtgcatgcaacagctagcagcttccatatccatgcatactgatctggctgcctctttcatgtcaccaacacagttcatggctgttgcatgcatgcatccatcagctactccagccttttctgctttagttttgcatatcctatgcttgcatttgcatacgctcttaataactggcccatgaagcaatccaattcatatacactccagcaaatgtgctttaatttgcaaccgcagaaacaaccaatttatactaaatgatcaatccgcacttgtagatcgtttctgtttggagtactgaaaaacttgatgaaatatactgcacgtcttcagagtttcacagcttcagattcgcacagttcaatctgcgccttacggagatgatatacatacatctagaattgtatttatatttcagcactaaattgcagatcaattagtccacacatatatatatacgatcattagatacagtatgtgtgtaagtgtgttgctgaatataccgctccgtatatgacaagtaccaaagatgaaaagatcgaaaggggtcggagttttcttctccgaacccccatgaattgccattttctcttacaatttcttttagaggctctttaattttattttgtcttctccactttagttcggcccataaaaaaattctaaacacaagcgtacgtgtcaaaaaaaaaagaaaaagagaaagatcgctagctacctgtagcttgttaatcatcagaggcaaaagggattgtcttaatttggttgatgcatccagtaacactagatttattaatttgcacatgtacggcttacagaaaatggtgccgacgtcgttaattaatgtaagacgatttgctgatgtaaatacgtaaatttgcagtttatccaaataggttcggagttttcgtctccgtatcccctatggcgttctccatttcctgcagattgtatatattgatccttttcccttgcttgatttctacccccttagatttctcggattcatttgccttcgatttctcgaatatgttttcgccgaattacaaacggaagccgatcaatgtttaaacacgcgaccgattttcttctgcaagggggttcggagttttattttccgaacctcttgatctcggcagttttgaaatgaagccccgaagtaaattcggcccatttaaccgttcgggcccaaaatccttgtggtatggatcgatttgcctggcccagctaaaaagaagagggaaggactgacgcgataatctgtgccgcacatcttgatcggacgtctcactgagatccaaagggtcggagtttttttctcctaatcccctcggatcaccatctagctctccgatttagccattgagttaatccggcccacctaaagacttcggcccaaaaagaatgtgtgtgtatatacacaaaaatgaaaccagatttgcatacatgttaattagtctgtaaaatgtgtctgttatgttcgtctacgtacttatcagaacctaacgagcatgggcatgggcatgccgcccttatctgaacctgattgcattgtgtaactaaaactcttttttcttctaatatattaacgtgcaattcttttacgcgtttgcgataaaaaaaatatccgaagggttcttagttttcttgtctatccccttgaggcctttagtaaatttggcccgtttaaccattcaggcccaaatgcctcgtaaatggatcgagttaccccgattttcaaggcccatatgaaaaaggcggaaattcatgatacgcaaaggaccaatgtgaaaattttgtctcctatctaatctctaccgcacatccttgatcggacgtctcacagagatccaggggaggtcggagttttcctcaccgaacccgcgtgggcatggtaacgctgacacgtgggtcccagccgtcagcgcaacgggtgacttgcaacggcgccactccgagcgccgccgtcgccgctttctctggagctctatgcatcattgcttccgatcttttcctttttttttcgagaaatatcaatcggatctcgtccagtattttctcatgtttgcattcaggctcttacgtttcttgatttcgttcgctcaaatctggattctgcagaccagtctaaaaaaaaaattggattctgttgaatgaacacaggtcaatcagatctctaaatgatcgatcgatgcaccaagcttcaagttcagaatgggcaatccgatctacagaaggtactgattcagatttgagattcagacttgttaccatttcttctactagtaggtagttaggtaccctaccctctctgaacttctgaaatatgatccacaattgatagagagattgaattactacatgcttaattagctatagcatcatcatgatcccacacctcaacgttccatttgcagtgtctgtccaaaagaggatggaataattccaaggtttttacaacggtttattaaccatccaatattagtcagacaagaatgcacacctgatcatgcagagatatcatgtatgatcatattttttttcatgcgaaatccatcacccaaagtgctccaattatgcattgacctttagttcaaaaaagatctcccctactcccccagataaatcgaatcgacgatcatggggaggagaaaaggtgtcgtaatctcaatcggaacagttcctgcactgtatcagaaatgcatccgcgcgtcaggctatactccactggaggagccagcaagggattatgggctaaagataatcaagtaaagaattgtcactgttgagagtttgattgagctagtagcttaggcaggcagccatgatgcagatgcagtactagtactggtgtgctagctagttggtaaatggatggctgggagcttttgctttcctagccattatttccaaagttcagatcaaaggcgaagaccggcaccatccatggtgacaatggtcaggtccattccatgcttaatacccttgctcattattagattgatctcccttttgctaccatatcgcaattgtcctttctggcaatctttcaaattaagcctgcagatttttgtccccaaagttttagggatgtatattgtagtactgtgcaagcaagatcttcagaattcagatatggattgagttcagaagctgctagcatctttagagatttgtatcttcagccagaattattgggataaaaatatttccggatatgctacagtaaaaataagcatcttatacgctatagataaccagagagcaaatttcattttcacggtttcgccaatccataagtaataacc

SEQ ID NO: 60983 - DNA, 3777 bp, Oryza sativa
  unsure (1)..(3777): unsure at all n locations
gattacgtacatatgttacacgtgtgcacggtggaaggaggggagagaaggaagacgacttcgctatgaaggtagtagagatattgtgtatatattctagtagtttttaataaaattttgggcttgccatatcaccgcctatgttgaggatacacacactacacgttgagtgttaggtgtaatatatgacgataacactcatgaaatcttatctttcttccatcatctataacctgtaaatatctttgtaagtttattgatgatttgtctaccaacacatagagataatataatggatatataaaatgaatattcatattacttagaattaaccatgcaaagcaaataaaaatagtatctacctaccacaacaaaataatgttacatatttttctttggataacatatgagtccatataacaaggcaatatagtaaattacacacgggtatgagcttttggttgcatgtaacatgtatatataccatgggttatgcagattgcaagcaatatgtataccacatgtattctatcgccttggatagatttaaggcctgcgaccttggtcatcggcgtctagagacttccattgcgtattttgctaggctttaaatttttttatgcttgccagatcactacttatgtcgtttgtgagagactgcacagatacaatgagcgagcgtttggtgtaatatgtgacagtagcatacacgaaattctatctttcctatgtcgtttataggaaccacagatgtctcctaaagttgaccggcaacatctctagtgagagatagagatatccgttactaccaggccgatgtaggtgtaggtgggtataataaatgtatgaattacttcgaattaacgaagctataagatatagatattacctacagtaaaaaaagatataaatattttgctttgaataatagagttaatatacaacatggtaaattgattctaactaattctaatatgtatggtaccacattctcaaatctcaaacacatggtgttctcactgacacttgtaagcacacaaagcctaggcaacaccagggcatactggccagctacactctacggagggatcagatgccctctccgctgtagctaatacaaagctgtagagttagtgccttgctctatctccaacagctagctacacacaaaaaaaaaacacatttcttttaaacatcccaaagagaaagctaagataaataattatttctggattaattaatatcactcctgaaatggtggagtaatatttatggggagagatatgacatttatttctcaccaggaaaatcagcagctgcaggaaaagaaacagtagaagaaaaaggaaatcaataaatcataaatagtaaaaaagagtaaaaaaaaaattcacagatagaaacaaaagggcgcagtcaccggcctcctcatatacacgcgcaccctacgctctcctcctccaccaactcctcctcgagccaagaaaccatcaagctagcgaggccacctcaccggccgccatggagatcccgccgctctaacggcggcgcgttcttgctcgtcgtcggagctagagatcgatcgaccaagctagcgtttcttcgattagatatagtcatatctatataggtagaaggatgggtgtgcacttgctgaagaggcagcagtcatcggcgtcggcggggggctcgtcggcggggggagggatgccgccgaaggggtgcatggcggtgagggtggtgggccccggcggcgtgggcggcggcggaggaggagcggagggagagaggttcgtggtgccggtgggttatctgaagcacccgctgttcgtggggctcctcaaggaggccgaggaggagttcgggttcgagcagaagggcgccatcaccatcccctgcggcgtcgaccacttccgccgcgtccagggcatcatccaccaccagaagcaccaccacggcggctcccatggcgccggcggcgccggcgccggcggcctcctctccggccacggttcgtcgggacaccacaacaacttccacatcgccgcctgcttcagggcctgattgagatgatcatcagatgatgatgcatggtgtttctttggctagcttctctctctcttagatcgatggattaataatacttagggttttaatttccttttggttaggaatttagtcatggtttgtgatgatgatcaaanaggatcatgcatgcatgagcagatctgtcatgcagctgcgggttgttctctgatcatccttataggactctctctctctctctctctctctctcctagttaagttagattgtgatgatgatgatgatgaaaatggagatcaaaggatctgttcaatcaaaacaaaagatgttccctttcttctttttctttatttgtgaattccgtttttttttcaattttttgagatgatatatatggttggtagtattctctttctattcagaaagagcatcctttttctattcagaaagaacatccttttcctaatggttgttgatcaagattcatatatggtatagggatgaaaaaaatatatgaaatttcagaaacaaattaaacatgtctatctatatgttggcttccaaaagagtggagaaaaagaacctagctccatagacaagaacaaagagggccagctaactagctagatagcaaatgttgttttttttttctttcatctcttctaggattctagcttactttcttggttttgtccactctcagtactaaacaacaatcatcagaatttacttagtgctaagctagctactccagctgttagtgctactcatcgttattctctaaaagaaaacttactaggacaataaatcgcctactgatcgacaggcgccagcactacccaatgcattccaacacattcagagtttttagttggtgaaagttgttggtgaaacagaaaccgagaatgaacgaatggctaaatagcttatttatgataattattataggaagttggaaaatggatttgtaatattgtttagtttgaaaaacgtccggtttaatccattatccgttcatcacgaaggcagtagtgcaacagttgtcagagcttcttgtggcagatagacctggcactgtcagagatgagatgagagagagtgagagaagaatctcgagatggtagtagggagggcggcgccgcagtaggaaatggagaaggggatggatatgaacaagcaaaggacacgttgtttggccaaaaggacaggcagtacgagaaactgagaagcattgcagatcacacacacatgtaccgtacacattcagaagattcagacagataatctagtttaatttattttcttggtgattttctccccttgctaattactcccaccatcccaaaatataacggattgatacatgttttagttaattgcaaaactacctcttattatgatccactgaacatgccagattagattttttttttcatctcaacgtgcagtgaaaagtaaaagtaaatcaaactgatcagagtgctatgcggtcatcatgtttatgagaggtgtatagtttttagcattcccgaaattcggagaaatccaatccagatcattcccgaaattcggagaaatccaatccagatctagctagtggcaccaaattaagttttcacaaataattaagcaagaattgatactctagtactagcagctagttagtggtaggtcacttttggtgatcaatagggaaagagagatgtgtatgtgtgcgtaggtcagaactcc

SEQ ID NO: 60984 - DNA, 3761 bp, Oryza sativa
tttgatctggttaagagaccaaggggaatgaatacaatctcttttcgtttatcttatccgcaggtgcaggcggtaatttgatctcatctcctaaagcatagtacaatcttatctggttttttcctatattctaattatatgatcaatatatcccaatttggtaatgatatctgtattgacatagtgaaatggaaccaatcaactaacaatcaaagtattcaatattctctctgttcccccgcaaaaaaaatataatctgttaaaagttataaaagtttgattgctagtgtacgtacgaaataaattcgaaacaaattcaaaattagatcacatagcagtatagaaagttattttggctgacatggaatcctaatcaacaaaaaaaaaacaaaaatatgggaccacattttcttatggtcttgaagcaccatccacattttctttatatttacagaatttattttagagtaaattgcacccacggtgtatcaacttggcaggtgggtgcaatttggtgcaagaacttgagaaatgagtattctagtgcaacaacttggtagataggtgcaatttagtataagaactttataagtgatcgtataaatgcaacaacttgcaagatatgtacgcttttcatacaataaattaaaaagttatacggtaacttaattatttggagcattttttttatacatatttaatttttaagtacttattttgacaattaatatgctagcgtggatttggatataagcatatttatatttttatcctaataactaataagtcaattaaactgatgtagaaattattatatttcggttgagatttggaaaggtgagaaaaaaacaaaaattcttaaaggtaattggatgtaaattgcatgtgcaatataattcttaaaaattaaattcaatattataaggtaatatccgtaggattgctatgtaatgacatattgacgttgcgggaaaaaacccacctagcatatgcttagctaagttgatgcaccaaaatattatattgtcaagttcttatactagaacgcacccacgtgtcaagttgttgcactcgaacattcaattctcaagttcttgcaccatatcgcacccacctgccaagttattatatcgtgggtgtaatttactttttattttaatacatgttagaaagcttatggagtttacttctagatggttttgctcccatgtcaaaattcctcatgagctgctgggaatctgcaaattcatccacgtacttcatttgggtatttgaatattgtaattgtaattgtgtattccgagtctgatttgggtatttgaatattgtaattgtgccgtgagctaagcctaaggggctatgcgctctaggacaaaccctaggacgtcatatgtcgtagtttcgcgttgacaagtctgatttgtaaatccccaactacaaatgctaatcattcatttgcaatttaagattagtcgatactctagacatgctaacccttaacatgccaaatttctaacccttaataagccaaatttcgtaaagacgcgaagttacacgtacgctgccggtaagtaaaaacacccagtttaacctcatttatatgttgaccgattaaaagctgacatgcattttaagacttttgagacaaatttaagccaaagagatcattctcctgtagaacagcacatacatggcgattctgaggagttgttgccgtggagttggacagttggactgcttgtcattctgctgccttgaaggctcagcgttgggtttgtgcattgaggaatgaggtggtaatggaaaaatccatccaattcctcgaaccaaacaactcaacaagaagcaagtggtgaactcatcattcactcctcaagccaaactgtccgaaagagttggatcactcgacttttgtgttaactcaaagcaaacaatcattgccacacctatgcccaaaaactcgacagtttcagagtacacagtggacgcaaaggtaagccaagatacataaataaatcagcatatatatattactttctactttatagatggattcatcaaccctcctcgagcaacaattaacgcaactagctgataagtttctgctcacaaaattatactcgtatatgcccagcaacagtactccttaaactccaatcagccaacaaactactgagccgacaatattcgcatccggacaggcatctatgtcacaccctttctaccggcggcttctgcgtcctcctcagcttgatcaactcttgtacctacattataaataaaatagttcatgatccatctgataaaatgtccttgaagcaagaattactgaccttttggatcaagggacaagggaaagagcattcatgtagtccacattgtatacaataggacaagaaaaacctaaggctatataaatattaataactgctttattcaagttggccttggtcaataccttattacttgctctattctctagttctttggaaattgacatgctgtgaatgcactttgattattacttctttatatttaaatgaatgctagcaaaatatattagatgcataatgataagaaaataagatcgatgacgcgtttactgatatgaatttttatgagaaatgcaaataattttatagtcgtcaacattttattaggtgttgtaccgtagttgtgcacatgggaatggaggtgtcgtgatcatgttaacaatgttcattttaataatcgttgcaccaaacacacagcagttcatttcaacaaagttcaagttctattttctgactacggtagaaaaccccaaagtttgtcttaaactcacacagaacagtatgctgcataatgactcttggtactactctgccataatgactctaggtactgctctgccattgcagtatatcaacctcatcaagcttattgtcctaaattaaagttcactactcctagtctcagtttgctcattcagaccatcctgaaaaaagaactataatagaagatagaggcactccgatgcaatatacttgcagtattctactacaaatagaattaatcttggccgtttatcttaaacggatagattagtaatatgttaatatagattagaggtaattttggaatggtatgatttctctgtctcatcaagtatggcggaatcggtggctcgacgcaacgcatctcgcccccgacgcatcaccacggtttctgctcctcctcccggcaggcggcggcgcggcccccgagcccccgacgcaggcaccgcatctctcccgagcccccgacggatcaccgcatcaccgcggtttccgctcgtcctcccggcaggcggcggcgcggccggcggcgctgcccctgagccccggcgcagtccttattttcccatatattttctataatctagttgacggagcgtggggctcctcaccgggagaccgcgcaggcccccctttgccggttcggccggggactcagggagagattctaagctctctgtatgtggaaggctcgcgagaccggaaacacacaagacacgggcgatgtatacaggttcgggccgctgagaagcgtaataccctactcctgtgttttgggagatctgtgtataaaggagctacaaagtatgagccagcctctcccttgttctgggtttctaatctggaaaagtccagtctcgtccctcatctcagtgggcaaggtcctccttttatatcttaaggggataccacatgcaccatttctctcttttttgtggggactta

SEQ ID NO: 60985 - DNA, 11693 bp, Oryza sativa
ccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggtgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgctgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgccgcgccgcttcatgccggaatctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccatcttcgcgcatttgtgcgagatgttcattggggtgcgcccatctcttcggctgttccggtggttcttcaccgtgcagtcggtgtcgccgccatcggtagtcggtggctgctacttccagccatgggggccggtgctgaaccgctacatcccctgcgccctccgcaagaagtgggacgactggaagagcgactggttctacactcccctcgccgacgaggcgcgcctccgacttccgagccagcctccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcgacgcgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccacgcctccatcctgaccattatgatggcggtcggggcctcagaggagcgagctccaaagggccacgacggcgcaggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagcagcaggcgcccggagggggccgcgccaacatcgcagcccgagggggagcgcaagaagaagcggccccgcaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttcttttgtttcagcgagatcccatcgcatccctcccgccattccaagtccggccagtctgaggccgaggatccggcggccgcagaggccctcaggcgggaatctgaccggcgagaggccgcggatcgcctacgggaagccgaggaggccgcccgggctcgccaggccgaggaaactgctcaggaggaggccgcccgggcccgccaggccggggaagccgctcgggaggaagtcggatttctccaggacgaggcgatggcgacttccgaggcagctcacgacgaggccgcgggcgcgtcgcttgggcccactccctcgggcgacgctcaggcgacaacttctggggcagctggcgacgaggctgcgggcgcgtcgcttgggcccactccctcgggcgacgctcaggaccaaccgggtccgggggacatccccgagtccggcacttccattggcggcccgagccgcgtggcatcctctccaaggcggctcttccccacgccttctatcgccccactgaacgcagagcctcttctgcaggccttggccgccgcaaacaccacggtgttggatgggttaagtgcccaggtggaggtcctgcaggcagagcgggcagagctcgacgccgcgtgggcgcgtgtcgaagaggggcgacgctcggtggaggccatggtggaggtgggccgtaaggctcaccgccggtacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctaaggaagaagctcgacgccgcccagggggtgcttgacgctgacgctgcccgagaacagcgggcggcggagaccgaagcggcgtcccggcagcgtgaagaggcccttgaggcacgtgccatggcgctggaagagcgcgcctgcgtcgtggagagggatctggcggaccgcgaggccgctgtcaccatccgggaagcaacgctggcggcgcacgaggctgcctgcgccgaagaagagttcacgctccgcctccgcgaggacgtgctcaccgagcgggagcgagctctcgagggggccgaggccgcggcgcaacagctggcagtcagcctgtccctccgcgaggcagcgcaggaggagcaggcgcgccgcaatctggaaggtgcccgcgccgagagggccgtactgaaccaacgggccgctgagctcgaggcgtgggcgaaggagctggacgcgagggcgcgcagcggcggggcggccacgggcgaaagcgacttagccgcccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctccccatggatggcgctggatgagttccctcctgggaccgaggaccgcgcgcgcgcgcaggtctgggatgccgccgaccatatcgtcgacagcttcgagggctcggcccctcggcttgcgttcgcccccaactccgacgaggagggcaatgccggtggtgcagacgacagtgacgtcgaggccggtgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggctcgtgcccaagttctagtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggctccgttcggcgattttagccgacccgagcccccgagggcaggattgagcacgagtgacctatttcaagtcaagattcttcaaaaggaaaaaacagcacagatacagcctttaggaaattgaaactgcttttattgaaatacagatgtaagagaaaaaagaatatgcatatgttgtagcccccggccaaccctgcacgcccgagggaggtgcggggttggcccgagcccgaaacctgacacccgacccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcaaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaactggtatggtctgcagggcctgggccggctgatggatttgcttggcgtggaattgacacgctctacatcgccggaccaggtcgaccgcgtcattaagagctgtcggccaatagaaaccctggcgaaaagctttaccaaccaaggtgcgcgaggcggagtgggctccgcattcgccttcatggatatcggcaagaagcacaacaccttgttcccgaggaatgcacttcaggaggattccattagccgcgcgccgatagaaggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccacttcaccacccgtcctgtaccctctcgattacgcaagatttgaccgagggggtaagacgtaactacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggtggccttcccacagtggcttcggggccgtcctgggggtcgggggctcctggcgtcgttggacaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcttgggggtcgggggctcctagcaccgtctgacaagcgggcagagggccaactccggtcgtcgggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgctttcaactgggtgagggcattttcggcttcctccgtccaggtaaacggtccggagcgtttgagaagcttaaataagggtaacgccttctctcccagccgcgatatgaaccgacttagggcggccatgcaaccggtgacgcattgcacatccctaagtttgctgggggggcgcatccgctctatagcccgtatcttctcagggttggcctcaatgcctcgggcagagaccaagaaccctagaagtttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgtctagaagaccaccgatccgtgtggtcttggacgggccgtcgcccagggcaacctccttgaccgggacctcgtcgcctgtgatcatccgctgcctcggggtggcgggggcggaggcgccaagcctctcgtcgccaccctcaggctcggatgcagcggcgaggtggtccgcgcgctgctccagacaagcgagcgcgactttgaggtcgccatggacagagatggggccaccggggcccggcatcttcatctgtaggtaggcgtagtgaaccgccgccatgaattcaccaacgcgggcctccccaggaccgcgttgtagggcagactgaggtccgccacatcgaagttcacccgctccgtgcggaagttggcggatccaccgaaagtgaccggtaggtcgatgtgacctaacggccacgtgtgccccggcgtcacaccgataattggctgggacggccggagcaccatccccggggccttgattgcgtcaaaggccgcaggggaaaggatgttgagggccgctcccccatcaatgaggacacgccccaacttcacgttgcaaacggtgggagaaaccaccatcgcaatctgccctccccgggcaacgcacggtggttggtcggtctggtcgaaggtgagggcaacctccgaccaccgcgcccggcgcgtcgcctcatgagtaggggccgcggccagaagctctcgcttcatggccttgaagctccggcgagaaacgtgagcacacgctcccccatcgacggtagcaatggtggccccaggctcttggaaacctaggtcatcattgccgtcatcgatgtccttggcgggggccttctgcttggcctcacttcgccgattaccggaaggaaccaccggggatttgccctctcggcgctcctgcctcctctcctcctcccacttcctcgtccgctcagccaaacttttgactgcacggcagtccgcgaggtcgtgaagggaagtattgtggacggtgcaccacttgccggttgggcgttccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgagcgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttagaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgatgcgacactccggacgaggaggcgccctccgttgcgtggggagcacgtcggccattacgccggcgctcgatactgatgcgagcatccggttccccacgcagatcttcccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtggatgtcgaagtcgcggatccttcggccctctcgagcgccttctcccgcctaggactttggcgtggaggtggcggtggagtacgagctcgacggcgtgggtttggctccccgtcgtcaccgctcatactcggggagaggtcgtgcgcctttgctggctcggctattgggctgaacaggaaaagcttggcgcacacgaaagagtgcgagagctcagaaaatccctcgcagggccccctacctggcgcgccagatgacggagcgtggggctcctcaccgggagaccgcgcaggcccccctttgccggtttggctggggactcagggagagattctaagctctctgtatgtggaaggctcgcgagaccggaaacacacaagacacgggcgatgtatacaggttcgggccgctgagaagcgtaataccctactcctgtgttttgggagatctgtgtataaaggagctacaaagtatgagccagcctctcccttgttctgggtttctaatctggaaaagtccagtctcgtccctcatctcagtgggcaaggtcctccttttatatcttaaggggataccacatgcaccatttctctcttttttgtggggacttaccccaccttttcataaacagacggagacttgtatggttgccgtccgaatgaccttctgatgggacggcccatacctacctccacttccgccggaagcaggcgcgacgtggaatcgtggctgtctgctgacgacatgaccggtatcagaccagtcacgtcggtcattcttgtccaccacgtgtcagcttagcaacctacatgctcgcccttcttcacacaacatcttgcctgtaatggttaggatgaagcctggcatatatctgaccaggactaacgtgccatctctgggaggtaacacgctagctccagctggggatgagcgcctagaagccctcgtcctgacgggatggggcgaggcgtgcgtcagatcgcttgtcgccacctaacccgcgatctgaccggtctgtgactggtcacagaccggataaacgagtgcactgcactgcgttacatgcggcgtgacacgctcagccaaaccgcaataaatgtggttaggtg

SEQ ID NO: 60986 - DNA, 5019 bp, Oryza sativa
accccctcggggggactaagaggagggcgaacgcatcaccctcgggcccgacgtccctcgggggtaccaggccacgtgtgcgattgtgtctgcctcaaacctctagtcatgatactcctgatcccatgtcaccgacactagtatttgctaaactgattgaaaggttctttagcggttgacaaggtattctgaggccttcttgcaggtatatgaacctcaactctgttgttctgtaacaaaatcaaatcattcaattgcgactgtagtttatgatagagtatctgcagagttttccactgatactgaacaatggcactgcataaattgtttccttattgttctttcgaaagttcgcaagttatttcctcgttaatttcagtattttgatatttgaatggctgagttatcagattagtatctgatccgatgtgttcaatttgcattgttgtatttaagcccaaatagaccccctcgctgctggagcaaacgactgccggcaggaagatgtggcaatatctggcttgctagatggaactggggagtacactttggtttacgaggattatgaaggtgacagggtgcttgttggagatgtgccgttgggggtgtgttttccgttctaccttttattttcagagtagtagacaaagttactacatttataggatactgattacgcaaatagcaatgcttaaaaatgatatgcagtctattgccttaaattttttttcagttttattgattatcaaactgggaaaaaagaattctaccatcaaactggaccatgcctcctatctgatagtctgatactccaattcatgtaggatgtttgtttctttagttaagagactgagagtactgaagacatctgacctatcttcatctgtcagtacctttttccaccttccttctgttacatcaaactcacggtaatctccgcattattctgaaatttgatcatgccatgtaatccatgcagcttataacttctggacggaaaagaacagcagctgagtgttgaccttctttttttgatctgctttgacactttcagtgacgctgttcagaagaatatgatcttctgagcttgtatcatcgtctctttctctcaatgtcttgctgtgctgagcttggaatagagtcctcgatcctgatgagattagggcaaaaggagctccatcgaagagacgaaggccatgccgtgagacattgtacacaaataaccaataaggttacttggctcacaaactttgtatcttttgtattaatggcatagttttttttattggattaatggcagcaatagctattatatgtagtgtgcaaacaggaggatttttaaccttccccaatatttttttttcggatcagctctgaaaatacatataggccacttgagcactgtatcatgtctcttatcaagccatgctatgatttacagaagtttgaagtgacttttagaagcactgtatgaaaagggggaaatgttgcactgcgcgggtgagcaagcagtgacggtgcgtgggcaagcacacggcacactacactggacgggctagcgtcgcaggcgcacggggcaggcagaggcagctcaagatggtgatatcaggccaaggagcagtggcgaatttaggaggaaatttgctacaaacacctcttcccatatacatatagaaaaaaaaggtaaaatttgctatggaacactcaaaaatttttttgtggtttttgctagtaaaaatctcgaaaacataaatttgtccaataaccttttaaaaatatggtaatttaccgtatgacactaaggtcattaaaatattattttcattagagctagagagagaaacaaactaaaattactttgctgccatgtcttctttctccatccattcctccattggtattgctgaaatcggagaatataaagcgctgcggactggggcgatggaggcgtgggccacgtcactctttttttttcgcccgccggattaggtatggatgtctgagattgaggcgcggagtgaaaatttttcaaaagagtcatccagttttcgtataattcgatatagatccctcatgaacagttccttgctccctgttattttacatgtaggccctttataaagccaaatatttcatgcaatggcaagataaaacgtgaattaggaccgcgctctaaaatgtggaagacgaggggctttttagcaaaatgacacccactaacccattcacactccaaaccctagccgccgctcacatctcctcctatctctcgtatcacgctctccctctcgtgccgccaccgcctccaccgttgccgagcgcctttccctcgcggcatgccgtcgccgtcgccgagcgcaccacctccgcctccgcctcgcgtcgctgctgtcgaccgccgacgtctggatccggcctccatgtgctcgggggacgtggatctgactgcccacgtcccctcctccctctcgcctcacagtctcactcttcctctggccaccccagtccagatcccacttcgccgccgcactccctgctcctgccgccgccgctcctggtgctgcagatcgagggacgactcaagacggcgagcttcatggtggcacacatgggcggcggcttgcgcagaccacatccatgacggcaagggctactggtggcggcaaacgagctctagatctggcagtggcggagtattccttgtggcggcggcgactacatattcccgacggtgacggcgtctttcggcgacaacgggtagccagagagaggcgcggcagcggttggccggccggtgtgaccggcgacggaggtggctgatgaggcgcggccagggacggtggaggtcggcggcgacggaggcggccgcggtgcgaggaggcttggccgccggaggcggaggccggcgttgtgctagtagaggctagcgcaggcgaggttggcgaggcgtgtgccggtgcggcacgacgaggctggccggcgtggcgcgaggaggtgcggccgacagaggaggaggccggtctactgggcgaaagcccagcctcggttctctttgagacctcgacagacggctgcggcggtgctttcgtcgtttctcttcttgtagacgacgtctagtcatcccccttaacgaaacctccgaagcattcggtgcaagctcgctctagattcttaatctcttgtgtcggcgtcctagcttctgcaaggtggccacgtcggagggcctagggggtgagcggttccattattctctctcaccctctctccctcaattccaaagatgtggatagagcgggtttttgtgtaggctgtaagggtcgggttttgggcgacctcggttatagttctattgttggcctagcgatgctacccttctcttaggtctatgtgttggtgctatcggtatgtgggtggtagtatattttttttgttttcctggttaggatctctcagggctataatcttgtaattttttttctgctatatcaatatgaacttcaagtcattaaaaaaaagaagagaaaggagaggaacttaaagtggacttattccttgcccggttgagaagtagtagtagttatttagcccatttaaacagaaagcacgtaaatggactggagtagggagtgaagggacaattttttttggcaacaattaattatttactattcgctgtatttgatatgtgggccggtccagtggcaaataattttagcacgactgttaagagtggaaaatagtaaattattgcgggagggaaacctgtcaggtctactgatgataacttgactcaggagaggctggacatcggcaagcaggagctggggaacatcgacaacgagctagaaggtgtacaggatggaggcgtactgaaggaaggcgctggctcacaaggaaagcgtgttcgtattgctaatagaaagtatgtgggctctgaatgggccgtgtaatgcgtgagttgtaatgggcttgcccagctgagaggggttggtgaggagagagagaaaacggtatatgagacactgttgcgtgttcgaacggcatcgaactggaacttggaggcgatggcggcggaagctccgatcctgttggatcgagagagttactaaagttccagataatttcgtgtgtgttcttgattggtgcttgctgtgagttagggttctaacaatctggtatcagagctcgtttccgatccactaatctcttgattcggccgtagaattactgattggggattggattccgcccttgggtggaaaccgcgaaaaggcaacttgcctcaaccgggttggctgaatttggagcggattgggagctgtgatcctggagaaaccacgctatatcaccaagcaggcagcgcagattatggcgcaggaagggaaattggatctgctgctcaagacaatggaggagaatgagaagaagagggcggaagcggaggagcggagtcggctggatctgaaggacctcaaggcggcggtagaagcaagacttccacaagtggagaagcaggtggtggatctccatgcatctctgggtaacctcagtgcgaaggtggagcagatggagagttctctgttgaagcagagccgcggagacaaggggattggagaagtgaaggaggatccgtttactacatcaccctcaccgtctccttcattgattcatggtaagagagacctaacactcaacaccagttcgccttttgcgtttgagaattcgactgctcagtttgataacatgatgggaccgggaatggtggctggaagtattcctagtatgacttgtccgcagtttagtggggagaatccacagatgtggcgtgctaactgtgaagtttattttgatgtgtatggaattcctcctgggcagtgggtgaaggttgcgacactgaattttgtgggaaatgcagcatactggttgcaatttgttagaaatcaattgattggggtgactgggttcgatctatgtgatagggtgtgtgctctatttaccaaagataggcaggagaccctg

SEQ ID NO: 60987 - DNA, 17281 bp, Oryza sativa
  unsure (1)..(17281): unsure at all n locations
aaggtcaaaggggttgtgctttacttgtggagaaaaatggagcaaggatcataaatgttctacttctgtgcaattgcatgtggttcaggagttagtgtcacttctacaagatgaaagtaacagcagtgaacaggtggaagtacaggatgaaaaggaggatttaatagccatggccatctcacagcatgctgctagtggaactgaagctgctcattccattaggctgagaggatggattcaagaaactgagttgttaatgttgattgactctggcagtaccaactcttttattgatgaacaagtggcaatgaaattgaaaggagtggaggtattgaaacagcctctgaaggtgcagatagctgatggaggacagctattatgttctaaaattattccaggatgcacttggtacatgcagggccaaagttttaagaatgatttcaaattaattccattgggaagttatgatatcatcttgggcatggactggcttgagcaacatagtcctatgcaagtggattgggttgagaagtggatagaatttcaatatcagaatagagctgtgaggttgcagggtatctctagcagtaatccttcttgttctttgatttctgtaccacagttggtggggatggcaaagtctggtgctattatgtacatgataaaaattgatgaggttgtgaacctttggaaaaaaaaggggggggaanaaccagaaatttcccagcttccntatccagcaagtaattcaacagtttcaggaagtttttgctgaacctaagggtctgctgcccagaaggaattgtgaccataagattccattggttgaaggggcacaaccagtgaatttgagaccttataggtacaatccagaattgaaaaatgaaattgaaaagcaagtttctgaaatgcttgattcaggggtaatacaacctagccaaagtgcttggtcttcacctgctctcctagtcagaaagaaggatgggacatggagactgtgtgtagactatagacatttaaatgcattgaccatcaagagtaagtaccctgtacccatcatagaagagcttctggatgaactgtccggctccaagtggttctccaaactagatctgagggcaggatatcactagattagaatgtcacctggggaggaacataagactgcctttcaaacccattatggacactttgaatataaggtcatgtcctttggtttaacaggagcaccagctacatttcaagctgccatgaacaagaccctggctccagtgttgagaaggtgtgcactagtattctttgatgacatacttatatacagtccagatttaacttctcatattaatcatgtcacacaagttttacaactgcttaaacaagatcattggcaagttaaactctcaaagtgttctttcgcacaacagcaagtgtcttatttgagacatgtgattggtgttcatggtgtagccactgaaccgaagaagatacaagatgtgattaattgggctgttccaactactgtcaagaaacttaggggttttcttggtttagctgggtactatagaaaatttgtgaagaattttggtgtcttgtgcaaacctttaactcagttattaaggaagggagttccatacaaatggactgaagaaactcagcaggccttccaacagataaaacaggccttggtaacagcaccagttctggctctaccagatttttctaaaccctttactgttgaaacagatgctagtgactatggcattggagcagtactttccgaagataatcatcctatcgcttacttaagcaaggctttgggtccacgctctagaggcttatcaacttatgagaaagaatgcatgacagtgttactagctgtggaaagatggagaccttatttgcagcaacaggaattcatcatcctgactgaccaccacagtcttgttcatttgtctgaccaaaggcttcatacaccctggcagcaaagagcatttaccaagttactaagcctacggtataagatttcttatagaaagggtagcactaattcagctgcagatgcactgtctagaaaggaaaacttattggaggatcaggtgatggctatatcagttggggtgccactatggttgcaggaagtaacagaaggctatgataaagatgcacatgcctctcagttagtcactgaattgtctcttcacccccaagccaaaaaaaactacttttttcagaatggtctaataaggtacaagggaagggtgtgggtaggagacaacccttcttacagcacaaactgatctctgaaatgcatgataatcccataggtggccattctgggtttcctgtaacttacagaaaattgaaacgtttgttcgcttggaaaggaatgaagaaacaagtgcaacatcaacttaaacaatgccaagtatgtctgcaggctaagccagagagactgaagtatccagggctgttgcagccgttaccagtgcctgaaggggcttggcaggtgttatctcttgattttattaaaggtttaccaaagtcagagagattcaattgcattcttgtggtggttgacaaattttctaagtttgctcatttcattcctttagcacaccctttcactacggcaacagtagcataagctttcatgagaaatgtatatcgtttacatggcatgccaaaggtaatcatctctgatcgtgacagaattttcactagtcagttctgggagtgtttattcactatggcgggtatcaagttacatatgagttcttcatatcacccgcaatctgatggacaaaccgaaagggttaatcaatgcttggaaattttcttacgttgttttattcatgccactcctcgcaaatgggctgcatggctgtacttggcagagttttggtactattcgtcttatcagtcgactgtgcacaaaacaccctttgaagtggtctatggttatcaacctagtcattttggtataagtatggaagattgtgtagttccggatctagctgaatggctctctgacagaaaattcatgcaccatttgattcaacaacatctgcatcgtgctcagcaacagatgaaattctatgctgacaaaaaccgcagttttagggagtttcagttacaaaactgggtttatctcaaagtgcagccttatgtgaaatcctctgttgccaaacgtgctaatcacaagctctcgttcagatattatggtccctttcaaattttgcaaaaagtgggtagtgtggcttataaattggatttgcctcctgattgtttgatccatccagtggtgcatgtatcgcagctccgagctgctactggattcagcccgccagttcagcaagctttgccatctcctttggacaagttgcaagttcctgaatagttcctggatcactgtattgccaagaaaggtaacactgttatttctcagctattgaccaagtggacaggtggtgcgattgaggatgccacttgggaagatgaggaggacttgcagactcgttttcctcgtgcaccggcttgggggcgagccggttttcaaggaagggagattgtcaggtctactgatgataacctgactcaggagaggctggacatcggcaagcaggagctagggaacatcgacaacgagctggaaggtgtacaggatggaggcgcactgaaggaaggcgttggctcacaaggaaagcgtgttcgtattgctaatagaaagtatgtgggctctgaatgggccgtgtaatgcgtgagttgtaatgggcttgcccagctgagaggggttggtgaggagagagagaaaacggtatatgagacactgttgcgtgttcgaacggcatcgaactggaacttggaggcgatggcggcggaggctccgatcctgttggatcgagagagttactaaagttccagataatttcgtgtgtgatcttgattggtgcttgctgtgagttagggttctaacaaaaccctagcctagccttgcaaggataaggagcagacgtgaagtcgtgaactcgtcgtgccttggcggcggcggcggcggcggctgaggcctcctccacctccttcctagacgagccttctccttcctcctctccaaattgcaccttcgtcttcctcctctactagaaagaagcagcgccttgtcctccgatcctcaacgcccgccgccgcttcaaaccaccaccatcactccggatgccaccgcccctccctgatcgctggggtatctctgggcaaggagctcgctcggcgaagttctcactgctccggtctctctatcggagcctcgtcgcggtcacatcctgatttttgtttcaggatttataaattatttaataaattattatttgaatttatattaaatgttcattaatttacaagtgaagttaaaggtgggaaataaaacttcctaaatataaagcatggatggatttattttttattaaattctccatggttaattatactctcttgaatattctcggatttttcggagctcaattcctaatttttaatcatacaaagagcatttcagtaattacccacatattaaattaatcattaaatggtctaattataattttgttaagtactttgagtgtccaagtattttcaggatttttcttgaaattatttgagcattggaagtatttttaacaattcaaagatcatttaagtgattattttaattggaaaaggttctaaaagtcctcttttggctttgggccgaaaatcggcccaaaaccttccctctctctcctcttcggcccagtcagcccgcagccgcccgcgcgcgcgctcggccactgacaggtgggtcccacctgtcaggcctgtcgtcgtcctcctcgcgccgtcgcccggccggaaccctagccgagctgcgccgccgtctccttccaaattcgctcgcgcctttccttctccggtgaaatctatagaggggaaatgatcttcaggatctcctctaccttttctcttttggaatcatgggctaaaatcgtttggaaatccgtggattcgagttcgattcggatcgatctctctcctccgaaccctagactttccttcgcgttgccggtcgccgtgggccttcgccgccgcctccttgcccctataaaaggacccccaagcccgccgctacccgctgccaccctcgctttcgcctctcgtcgccggtagagccctagcaccgtgtagcctcgcgccgccgtcgtcgccgccgctccagccgtgcgtcgccgttgctccagtcgtcgccgtcgttcgggaaggccgccgtcgtggtcgccgtcgcgtcgccgtcctcgtccgcccctccatcgttgctgtagaccgccagagcaccgccgtcgtcgtcaagccgatcttctccgccgccttttcctcgacgccgtctccgtccgttgatcttccgccgccgttttggtcaccggtgagttcgccgcgtcgctctctacgtgctggtgccctccgtttgtgccgtcgcgccgtcgttcgccgacgagcttgcgcgcccgagccgccgccggtggtgacgtcaccgctgacgttatcgtcgtcgtctctcgtggtccggccgtggaccggtcgatctcggctgtccgttttggatggaaagatctcggccgttcgtttctgtgagccgccaccgtgcacccggtccactgcaaaccctagccgctgacgcaataaacccctttttccttttcaaaaaaaattcattattgcgtcataattcaattaaaacccatataattgatttaatccgatttaatctttgaaaattcataactaattcatcttagctcggatttagttggttcaagtctctaaatttttctaaaattgagatctacatgttaaaaatatccacatgtacttttcatgcttatttatgtgctgttttggtgtttttgctcttttctgtttagattccgacgtttcaggagagtccgttttcgcaggagaagaatttgagtagttccaaggccagcaaggcaagtcacacagatcctaaacacaatcctttgagcatgttgatcctatatttaaattctctatttatttcaactgtgcatttattttcgaatgtcactgggtggtgtgaatctattcctttgttatggcatgtttgcattgattactttattccttgataccttgggttattataacttgactagttgagctttatatattggttcagctagatattagatatgattgcttagccatgcttagaaacattaacacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcgaggggtactgtcacagctcctttccgaggtaccatggtggtattgaggcacatggtgacatgttgtggggctgtgtcttgtgggtacagtggtacacctctggccagagtaaaactattcgaatagccgtgcccgcggttaagggcgggtctaacaatgtctttcgtgattagtctcacacttctcatcataataaaagatgctataactggtaataatttgattagctcctggtttggaatggtatattcctggtttggagatagaactgtgcagccgggatggttgttcaaaatggttgggcctatgcaacagggtatgttgtatagcgttggattaatattgtttatttattacttaactgttttattaaattctgaaatgtttattaaatgttgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcctgtggagtggagtcgtctgtgccgtttatcttattttttccgctgcttagatttttattgattgagaggaactatctacctctgtaatgacattttattcgcttattaattagagtaataattgtactctattaccaatttgttattgtgtgcctcggctgatttctggacaagggttcacacacatgtaagtgtttggaattttggatagaaattccgggcgtgacagtcgcctacggagacaagtaaagctccaactcagtcaatgattgttgattttgattcatggtgagggattaaatatatccatgcgttttgctgtggggaaaaagcttggattttgggggcacttcaggcagatgcgcggttccatgtttaatttcacaagtatttgcagggtcccagctccacttgtaagtgtttttggtgttcatgctaggtttgggcttccttggtaaatctgctgaatacctcgcgagggacaaagacaggatctgtccagttctttttttttacttgtgcaagacagaagattatgtaatccctattacaaaacggaaaggattccaaatacacaaactacttctgcgtaataacaatatttatccagtcaaggttcggagtcctgtgtcaaagtcggtgttggtacatatgataattactattatatctgtcttctgtatagactagatccgtgatgttctgttttgtggttgtggcctcctttgtagcagcagcttatggagaacacgatggcggccaagcggagctggatggagcaccatcgtgtgctcagcgacgactcctcctttcacatggaagacctcccggaggtaaaaaaaaaaaaaaaaaactacttttccttgatctttcgtcacctcctaatttggtttggttgggagccggacagcactgggctgttgttggcctgcagctgccttctcactcccactcactgaatgattgatttctggcgagggattgattctccgttccttttgctgaggggaaaatcttggattttaggggctgttctagccttctgctgaggcctcttagttttcctgttttgttctggggcaggtggatttctgttttctggggattattgggggaaatattgttccttgtttatttcagaagtatttgcaggggtaatacgacattttttggggagtaaaataatgctttatatactctcagaaatatactgcctaaagtttttgtggacagaaccagtccaaatttttaagtagagattacttgatccctattacagaggtaaatggttccaattgaacgaattacacaagaatatagtatcccatcgaggtttggagttcaatattggtgcaaggattggttatataatgtgtcttcctgctgcagctgtgtatggactactcatgatttgttttgttttgtcacatgccttcttgcagcagcagccgcaacttatggagaacgtggcggtggccaagcggagcaggctggagcaacaccgcacgctcagtgacaactccttccgtgtggaggatctccctgaggtaatattctttttttttcctcacctgtcctcacctcccaatttggttgggttggggaatcatgatttcatctttaggagtaaaatgattattctttgatgctttctttgtcaaccccttactttttgaacctgcacacagaatgatcaagcgtgttttgatcttatatttgattttttgctttacttttctcctctcttatctgtggctatgtatgagggatggagtataaattcagttccaccatggaggtaacaatcccacttacacgcacatcagtagtacttttaaatgcctccatctgtaacccgctcctttggagactcttctgttgcaatttgtgcacacagtacagggattttcaagtttgaaaaagatggatcattcactaggaccttccaagcaagatgctggattttttcctcaataaaatatcatgtagttttatctcctcaccttttctttcttccctgcataattttatcaaaatccccaattttctcctggtctttttctactaagggcttataagccaaaaaggctaagcctaaacaaatgatgagttttttcgttgggattttaaaagccgtaagccacccttacattgttaagttaaaagctaagtacgagtagttcttttttggcttatttgaagtggaggtaggactccaccattgaacttgaggcttaaaagccaccagctgtaagccaaaaagaatcagcttaaaatcctaagccaaaacaaagatggcctaaacattagctatctctgcatggctttgcgcttgacatcagcatttgcacccatgcccttcaattcttttattgaaattcctgaccctactcttcctattttgccatatgtaatcttaatttcttatattgttttctacactcaaaattagaggcgggtcataaattgtaagtaaataatcatctagcattctctgctttgcatgccttaaatatctagcactccttaatgttgtatgtggcataacatatactccctccgtttcatattataagactttctagcattgcccatattaacatatatgaatgtgggcaatgctagaaagtcttataatatgaaacagagggagcagttaaaatgtgcttggcttcaaatcctcatcattttacctattgggatgctgcgaattccttaacaaggttgttatcttttgttctcctatattttagaatgactttactatcagaagccaacatttatgcacaccacattgttctagatagaaccttgcaaacctgatttcaaatattatttaggatgcatcagttataaacctactgcgatggaccacaattcatcaaggggtaagaaccgccaagaggatagcggtctgtgtcagctgcttaaaatggaaggagacgtagggtggggcgacgattgatggactgggaatgggacttatccttcattgcttgtgcactaattgatgcacactatccttttatagccatatgtggtttaggggtggatgtcaagttggctcggcttggttcatctcgtctcgtaggcaagctcgagccagcttgtttagctcgtgagccatgggcaagagataaaggcactcaaggtaggagatgatctcgagttcatcgatacttggaccacgggggaggagcatggaggagatgagctcgagttcggcggcacttggaccacgggggaggagcttgaaggagatgagcttgagctcgctagttgaggagacaagctcgagctcataggcacttagaacacggggaggcgttgctgctcactggtgggtagaggcgctagggtcgggtggcggtgcaggcttgaggcggcattgggagtgggcgcttgcagcatctggtagtggcacttggtcgagtggcagtgtgggcaggtggcgagtggcgatgtcggacgcttggggttgtcatatgggtgatgctgggccgagtggtggcaccgggtgctggggacaagcggctgtggttgcctttgcctgtgaggatatggtttggtgtggtgtgatggctttggtctgggctatcacgtggtatatgtggtgtggtgggctggtccctagtggattgatgggctactgttggtggtgggccatggtttgatgggttggatgtaacctgtatgctccacgcctccagctcgtttggctcgcgagctagctcgagctggctcattatctttaacgagttaaaatgccagcttggcacgttatgaaaatgcaacgagccaagtcgagccgagcaagctaacgagccatgagctttttcgtccacccataactaggttattagcagctagggcataagatcaacaaatagatcaagtagtacttactccaatcacaaatatgaacttaatctaggctcaagtcttttttttaaaaaaactttgactagctatgtttataaatataaaaggtgtccagccaatagtgcaatacatgagttgctttggagaatgaattttgctctgtatcttttctttgcttgcctgagttgcttcctcaggaccttcgatctagaaatataatcacccaattgtttgcccttttcacaaaacattatgcattcaatgtttgttactccttcaacctctttttagctttttctctccatttagttgcccatagcgtgagtttcctcctaattgtgttttagatccctgggtcaggttctgtcatgcatttgatttccaactttctagaaatagaatcacctcattgttttgattttcttcattgtattcagtgttccatcctagctaaatttggtgttagtagatgcattatttttagtatttttggttcttctgtactatctcttatctatttcgtcatcggatttgaatgtgctaggtgactgggaaaagaagaggaaaaacccattgaagtacttttctcattgtgtcctgactcaacctattgagtacttaatgattatcacgcctgtctgtttctttgatcaaaactcaaccctcatcatcctcttgttgcaggaaattcaatctcttctattatctctgctgtcactgaaagaggctgctagtacaagcatcgtgtcgagaaactggagaaaactttggacacggtatcctaatctatgctttgatggcagcaaggacgggcctgctgatatggatagtgtgaaaatagaaagaatgaagttcattgatacagtaaattctattattcagcaacacagtggaatagggctcaataaattcagtatcaggtgcaaccttctgaaggacgactcagacattcttgataggtggattcgctttgccactgcatcaaaggctaagattatagatatgaacctgtgcacaaatagaaataataaaggaccaaccaaacatttgtatgacttccctcttgaggctttcggtgatcaagatatcccttttatccagtgcttgtttctcaacaatgtttctataaagccacactcggatattggctttacgaaactcaggagccttcatttgcactgtgttcaaataattggagatctttcaggcttgctatttaattgctccagtcttgaggacttggaggtctttgcgtgcttgggtgtgactgctctgaatattccacaccaactcaataaacttaggcatttgctaatttgtaatatgcgtatccagatgctggagtttcatgttcctggtctttctcattttgaatacaaaggtactatgattcctataatgcttcatggttgctcaaaattacagaaggcaaccctgaattttcaccagacatggcttgaagaagataataataaagtattgggccatgtattccatggaattcccagtgtttcggcagttgaggtgctcaatttacttgttgatatttgcacaaagcaatcggtctggtcctcacaggtacatcctaataattatctttgctcacttagctgttcaaatggagatgcgcttcctgatttgttctggtaatgtttcaggtgcatacgttgacagcaagaccaacaatcatgtttatgaatttgaagcatctgacttatgagatacttatttttactaaagatccaaacagccacagtggagttcttcagctggctcagtatttagcttttgcaccgcagctggagactctagaattgcatgtgagtgctctcctgcctttcttgtttttgcttatgcttctttctttgttggctatgtatagattgcaatagttagtagttacatatatttttgtttcgaaaaacagatgttgtatcattcgactcactgccgctgctggcatgagggtgcgggagtctcctacggacatatgccccatcatcacctcaagatggtctacatgagtgggttcaggtgctaccgggctcaggtcgagctgctgtttgccattcttgaaatgggtgatgagcttgagcatgtgaccattgatccaatgacgagagtaccgtatagccctgatttgatgaatttaggcatacctgaggacgagatatgtcaatgggcgaaccgtacctcacaacggtttggtaaagcaatctctgttgtaaaacctccctaggtggtgttggtagtcctgtgcatatacgacttattaccacctagataagtgtttgttcagattcagtactgaaattgctgacacaggggtttctgttttgtttccatgagtaaattgttttttattttattgtttgacaataaaaggcttggacttgtttcttaattttgtgacaactttcatatgtcagttttatttacgagtgaagtacacaattgattcttagactgcgagtgtcatctagctctctaacctctcaagatatactttttgtcgtataggtttaaaaggggttcaaccgacttctgtgtattgatctacaatgtcaatcacataaaaaaacaaaattagaaaaaaaaagcatcatcttctcttattatgttaaggtgagaaaatattaaataattgcatatttaacacaagtttgaaccggtattatggatctgccactataaaaagtgtaattggatatttaccataaaaaatggttggaatccaatatattgccatgggactgacagtttagatgaacactgttacaagattgacttctatgaaaatcaggacaagaataccccttcccaagaaattgaaagattaacacatcatatgccaaaactcacgcatcacgagcttagatggtgtttggatccagggacttaattttagtctctgtatttagacactaatttagagtattaaatatagattacttacgaaactaattacataaatgaaagctaatttgcaagacaaattttttaaacataattaatccataattagagaatgtttactgtagtatcacataggctaataatgaattaattaggctcaatagattcgtctcacgaattagttcaagattatggatgggttttattaatagtctacgtttaatatttataattagtgtccaaacatccgatgtgatagggacttaaaagttttagtcccatctaaacaggtgcggtggtggtggcgagtgcacggagatgttgcaaacttgcagaggctctgaatattttgtggcacgctctagtccattggtagtccaaaaggaaagtaatcgtgtgttatatcagattataacatgggtgattagtctgaaacatgcatgtagaaagcatgatgaagaactcgaccagaaatgagagagagagaggggaggggtgaagcaagacgcattcatggccaatacatgtaaaaatatgtagaccagtggcatattttaaattacatgtaaattgtaatggtattgatccaaatatgtaaattatagtgacatatttcaaaactgtcaaatttataatggcatgggcatgtatccaattaaccctagggctaacgggtcagtttgggctggttacacggtttagactggctgaaccagtggttagcctgcttatcaagttctgagatcctgaagggagttcactaagaattgagataccttgttatcttgatcatcaattcagagacttacaaaacactgcgcaaccattcaccaggcaattcacgacgaggtaaagattacgcatgtcaaactgatatttcagtacctcaatcagacttcaaaaggcaaacatgtattttaattgcatgcttcacatctcatttacataatcagacccgtgataaaagagtaccacttctaaatggaagcaagattaggcctgaatcacacccccaagttccctgacaaaacataaagagtatcactccgagttggaaacaacagattataattgaaatcgcaacccctcccccacacccgtgtctggtcacctcaatctcaatccagtgcctcaacctgtgcaaaattacatgccaggtaaatcaacaggttgtcaaaaagaagagtacgtaatattgatgaactatagttttctcattagtgttttttctttcaaatgcaccattggtacttgaaaaaggagtaccaaacaaaaagaaataaataccttagtgtttacgactctataaacagaagtcaagggatgcacagtatctttggaagcgctttgccctctgttcttcaggttccccttccatctccataaatttcatgatcgccacttcctcaccagctgcatagaatgacctatttcatttcatggactaacacttgacaatatccgaaatcggaccaattgtctgtctatacataccatcatctgaagaagcatcagatgcttcagctggggtagcatcatctggtacagcagttgaggcagcagctggagcagcagtagaggcagcagctggagcagcagtagaggcagcagctggagcagcagttgaggcagcagctggagcagcagttgaggcagcagctggagcagcaggtggggcagtacatgggacggcagctggggcagaagatggggcagcagctgggacagcatagaggagcagcgttagaacaaaactggatatcaaaggctcttttcaggtaccattgatggatcatctgattttttgtgatagctgtacaaacaaatgaattgacttgtacaaacttcaaaagttgttctaggaaagtcttccgacaaaattttatatagaaaattccagtgcaaaacacactatttaggagcttaggaagcatgcaaatgaaaatccaaaaatctagaatcagaaaggaagcctttatatcaccttctttcttctcatggattaccgtaatgtccaagaccccttctccagtggtgtcaccaggcatgttaattgggtagctccctattagcgacttcttgttcattagacgtgttaggacctcaagctgagacctgatatccatgacaacctgggatcttgaagtaggatctgtcatgaactgttgaatggctgcgtgtcttctcaaggacttcctggactttatgctcaaattggaagcggccgatcacaccaagcaaggaagtgcgggagttagccaaggtatcgttcgacgtaagcttgttgcccatcatgttcctgatgttctgcacgaggccatgaataatgggccatgagacggtcccatcatcattaactgccacagcatactcatctggtctgtggtgtttaaggatccaaatcatgtcagcggagtgagcagatgatgccccttcacccaatccaagcaccaagactctgttaagagcgtccaccttcatctgccgcagcagctctgtcctgcatgtgcagagctcatgttcctgagcaaatttggatctcaggttaaacatctccaccagattccccccagcctggacctgccgaagggcttcccgaaggctacagcagtagccgttcagcttggacagcattcggcttttctctttagccacatcagggttaagtacccgcatagagaatggagtacgagcaatcatatactccatgtcctggacacatctcagagaaatgaactcagagtagagaaatctaatctcatgtaagcctagagattgataatgatgtgttatatcaagtgcatcactatgagaccaaaccagcccctgtgctttgccatcagataactcccaagcagacaaataagttggaggaatggaactcagtaaaaatctcacgggcaatctatacttgtcagatagcgcttgaacaagctcactctccgaatggggtgggggtggatccacctgaacggcgacggcggtggcgacggagggggtgggaaggagactgcggtgggcgatcggcgaccaggaggcggcgccgaagatcggatggggtggatccaccggagcggcgatggaggtgggcgggataccgatcggcggtgaagacgcggcgccgaagatccgctggggtggatccatcggatccgcggggaactggcgatggatggaatgggaataatttggtgggcgatggcgatggcgatggcgatgggcgccgaggagggctagagttggaacttggaaggactcagcttgg

SEQ ID NO: 60988 - DNA, 3689 bp, Oryza sativa
  unsure (1)..(3689): unsure at all n locations
cgcggtggcgcgcgggatgaaattggggacgccgtctcccgccaggatgatgggttgggaattatttttttttacctacaggcaggctcaagcagcatatccgtccgatcagtttcacatggtccagattttggcaatgtcacgttgtgacttagctaggcaatgtcacccaagctgagtccgggttggaattgatccgacgggattgtggtcttggggatttgccggcctcgtggctcgtgcacgttggacgtgtgcgcttaaccgcgtcgctgtctgggtctagtccaaactccaaactgaccgaatcgacctcttctccggtccagttgctccaacacggggtgacaactttcggattccgtacctattttcaaaaacagaatctgtcggtcagaattttttggaaacgaaaacggatttagaaatattttcttggaaacgaaatcgaaaatcgaaaatgataagggcagtttccgtcggaactcgaatcggtcagaaacttttcggaaattttctcggaatttccagaaatcacaaaataccatgtattctattttttaaagcactgaatagttaataccatagtgtttggttgctatttttttaaaaaaaatatttgttatgcaaatctaatattacataagaatatttttttcctgcattgggatttatcaacagcattactaatttattccgtagattatgttttgtgacgtaccgttgatacttaacaattagacttatatgattgtgttttatgatgaattgttgaccgttaagacttgagaattgggtttatcagtttgaggggtttttttattccgataaattttcgttaccgtattcgcgccggctcgttttcgctccgttttcagtttcgataatattcgattccattttcgtatccggggtttccgattccgatttcgattctgaaaaaaaattaaaacgaaaatgacaaagatgatttccgtccgtttccgtacgaaaatgataagggcagtttctagtactatttaacatttaacactaatgacagtaattagaaaatattttaaagatttcttttttactaacagattgaaaatttttttaagttagatttaaaaacttttgatttaaggttcaaattttaaagtcaaaatttgaaaacattcaactcagatttgaaaactttcaactcgagatttaaaaactttcaactcagattcgaaaactttcaactcgagattcgaaaaatttcaagtccatatttgaaaattctgaaaactttcaactcagattcgaaaactttcaactcgagattcgaaaactttcaagtccagatttaaaaattttgaaaactttcaagttgagatttgaaaatcttcatatccaaatttgaaaaaaaaaagttaagattcaaaaattttcaagtcatgatttaaaacttgcaaaaaaggaaaaaaaaaggaaaaaacacacaaaaaggggaaaaacacgtgggaaaaaggaaaaaaaagaaaaaaaaatgaggggatgcgacatggtgggggccgcgcgcgccagatacggactggcacgcgcacgccaattaggaattctgccaacgctgaccaggctgggacaaccttttcttctccgaaacccaaatgcaacattacctttggccaaatttatttattttaagggttaattggatccattgtaattttactagtttcgaaaaaaatatcatttgaagcatctaggcccccggtgttaattttggtaattaatgacaagcactaattgtggactaaccgttgtctttgagctatacattttaagttaggtccacgtcatatgtgcgcatggatgattatcaatggattaaaattgacggcgcaaagcaaagggaaagaagacggtaaaactagcgttttaatttagaattgatcgaggtgtagggcgatcaaatttgctagtttaattttagtttcgccgtactattaagaggggtaatgacctagcaaaaagatgattttaattgccacattaggtcatagcattttcatttgtgaaaattcactacacaaattcattgggtttggcctgaccagtggcggtcagaccggccatatagtgccggtctgaccggcgtgccctggccggttagaccggctacatagtggcggacagaccggcggcactttcccggtcagaccggcctcatggagacagagatgatgctgctcgggatggccgatacagagccgacggagccgtagtcggtcagaccgagccaatggcggtcagacggagccgaggccggtctgaccgaccaccccatgtcggtctgaccggccagaccgatggggccctctgacagggctacaacggctagttttctagccgttgcagagtagcacggtctgaccggccacatacctccggtcagaccggcagagcacagagttgggggatttcgcccccaacggctagttttggtgggtgggagtataaatactcccccaccagtagcaagggggctctcttggcacccaattcaattgcatacaccccttgtacctctctcacactcacttgagctttgtgttcatccatctagtgtgttagagggttgtttagctaagagtcaagtgcatttgcttccattgtagagctagtgtggcacttgatcatctccacaccgggtcattgcgtgttactcttggaagttgccgcctcctagacggcttgtggaggagttgcccggtgacctctccgagaagattgtggaggaggcccggcgccggtttgtgagtggtttggagttcaccaccttcggagtgaaggaagaactaccccgagtgatcgaggcttgggtagtcctctccgtgggccggctcccgccttgcccaccccttgatgaagggggcgtgcggtggcttcgtggttgagcggtggagttgggctcgcctcaacggggagtaggaaaccggcaacttaggttagatttgattaggtgttatttagttttaaatcgcctattcaccccccctctagtcgacatctcgatcctacaagtggtatcagagcttggtctctcttgattgggcttcaccgcctaaagagaagatgtcgaacgaggtgaaccatgtagggaaggctcccatgtttaatggcacaaactactccacttggaaaattaaaatgtctactcacctcaaagctatgagcttccatatttggagtattgtggatgtaggctttgccatcaccggcacacccttgacggagattgatcaccacaacctccaactcaatgcccaagccatgaatgccttgttcaactctttgagccaagaggagttcgatagagtgagcaaccttgagaccgcatatgagatttggaacaagttggcggagatccatgagggtacaagtgagtacaaggangcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 60989 - DNA, 11028 bp, Oryza sativa
atgattatgcatgcatggcatgtcatagcatattaaaacagagaagatctgtgtgttctatagcatggtcagatgttaacaggagctaagtacacgataaatgtggaagttcaaatacatgaaagattttactacaataccatacttcatgttcaacaaactcaatttagagcatattatttgtgtgaaatagatattgaaatatttacatgctacaaaacatctacgggaatccatattgcaatggtttcactaatagattaaaaaccgacctgcttctggtggatgccacatggacgacccaactcagtccacacgtcctgccagagatgccaaatcaagaaataaataagaccatcgcatcaaagtggtgagaaggggaaagcagagagagatagagagagtagacggcataatttgctacctgcggtgatgcaccgaaaggaatatgttgcccgcctatcgtgaacaaaagctcttcaccaagctggaaacatgataatatcctttttagggatgccaaaagattatatggagatacattttccaaaaaaaaatataattcctttttgttccatatgtgcatttgcttaaagaaaaggttcctgggtaagagatgagggttgtgaagtatatatatctccttggtttctatacaactactaaggctgaaaatattatcgatataatatggtgatatacctttgcatgcacttcctccatgtacaggctgcctgcaggtaatgcaggaacaactgctttatccatcagtgatccaaccccaaccttgctatccgttgaactgtcatatatagaaacccggcaagtaacaggagttgttccgtcaggaaattccagaggcaaatctgccactgccataacaattagggagctgagctgagattctgagaaaatataagtatataggacaactgaatattgatgcttgaataattaaatgtggcaacttggcagcagtgtaccttccccattggtaaacaaatttgtatattgactggggatagggaatgcaaaggataacccctacaagaaaatgtgagtaagatggataccctactgatcatgagaagaaaaggcaggaaaaaaatgtaaaagaataacacaaggcaggctacttgtcatgacgtactggatagaagagggtgtaaatgcccctctctttgtcatatatacccgggaaagtaggtccgaataatccataaacagccacaaaagtggctaatgttgatgggccactgaaagagaaaaggagaaaataaaattatcaataacatagcacagagagttgggttaaatggccaaggtgattcagtgaaacgagtaaacatgccaaatattggctcaacgaataacaagctcctcacccaattaaggactttgcatatcgcagttgcagtcttttcacgtcatagatctcaatgagacgaagcctctgtaaggggagaaattatctttatcacttgcttaagtacgctgaatatgtttcaccaaccacacaagttcaggaatagcaattctttttggcgctaaaactagattattttttttcctagagtaatgactttcatgctctctaggatctgcattacactttacaattaatcagaatacatatatcgctccaagttcaattcgatcacataagaggtgcactacagtactctatattcacaaaaacatttttcgtattaacatgttaggcacaaattagccgaatgatgcctgagatgtaaccggactaccaggaaatcaaagcacatgtttcatgtttgtaccatacaaacttacctgtgaccaaggatcgaagcgcaggtggaacccatggtcaggaaagcttatgacaaaatccaactttagaggctcctgaagccacagaaacgacagcaaacaatcagttgagctttactggcggcgcatttggtagcaaacagagccacacgctatcacgaacctcatcgaagtacttcacgtggacaacgtcgtagagtgttggctggccctctatctgcgcgaacgcatcggaaatcggcatccctgcagcagcagcagcaatcgcgacctcccacgtaagaattcaccagccacagaatggaagcccggcgattgcttccaacacaagcatatacatatccgtggcaaagcgagaggaaacaagcaagcaaccgacgacgacggcgatcccaaccgtggcggaaggtgggtggttagggttgggggggaggaggagctcaccgagggtgaagggcccgacgccgttgccggggcggaggtcgagcgtgatggcccccatggccgtgccctcgcagcgccgcctcaccggcaccgtcgccggcgacggcggcccgacggcccccgcgccgccgccccccaccatcgccggcgatctgtgcgcctgcatcgctgggcccacctcctcctcctcgccgcgaacggattacggattattccttgcgctctctcctcccctctcctctcgattcgattcgattcggttcgcgtgggcttgcgtctactcctccctcttcttctccccctctccgtcgactgctttgcttcgctttggtttaacgagaaactaacggggcttgggtcagactgacaggtggggtccgagtagtggtgggacccggtcctcagtgagagtgggttacactgacaggtggggtcggaaagagtggtgggacccagtcgtcagtgagggagttttgccgtcgcttcggtttcgtgaagaggaagaggagcgtcgccgcccgccacgaaggttaagtaggtagacggtggagatcgcttgtgccgccgcgtgcgctgcatcggggcaaccgttggatccgtgccttccaagactcggaatcgcaacagttggattcaggacgaaccgtttagggatagagaaaaattcacaaggatttcatacgaatacaaacatttgcgccatttttaacggataataaaaaggcaacggcccagagttgtgacgccacgctgacaaccaaatgcaagtaggttggatggatcaatcgaacgtaacacattaagcagtttatgcttgactgaaagataaatgatgcataggcatagcgatgtgtatgtaacaacaatgcactagctgatggaaaaacgaaacaaaagggtgacagaccagtggcttcgttcttattgatcatacaacatgtcgattgcacgttatcaactggaaaaagggaaattaagttgtttgcaccctggaggtgctaagttctgctcctagatgcagcagggctcctgttcatcagtcttcttttccatagttgtagataatctcgatctgcaggagtcatataatcaccttataaactgattgcgacactttgatgcacgaaacacaaaatcaaaggaaaacaatgtgacagcagcaaaaccggaacaagtatggcagcaagtaaatccttattcataaagctaaaatgcatcgcaaactgcacagaatttgcttcttttcacatatgtttatccataaaactaaaatttgcatactattcacatatgcttgtcaagttttgactgaagcatacatgccatataagtaatttggatacaactggaacaaaatactctctggtagtaccaaaagaataaaaattgagctagtaaagtggatggtgactaagagaatgcagcaccaaaaccagaacaggcaacttaactaaccatacagtttgtggcagttacctctttattaatcagtttatagtcacacatctaaaagcataaaataagatttagaacaaagagttatgtgtttcgacaaacagagatgtactccaatgtggactaatgtttgaattaaggtgatctaaatctgctgagtaattttgttaaacatttagatacaaatctccaagaaaaccattataaatgacaagcactacatcaatttttattaaggacaagcaaatattggacgaggaaaaggagtcaggcatgataagataaaaaattatgaatttatgttcttacccctttaggtggaggagggtttcttgtgaatttactgccaccaggagcccatgggactgcagagattcgaacaagcatataagaaccccaccttattgatcacatcatcaagggcatcataatatgcctaaaacatactactaactcctaagggaagtttgaatatctctagtacaaggcagtagtgtttacagcaacggtgaatacaaagtcagtctgatttgtgagattcacatatcagctcattgcaccagtagtccagtacattgacttgaaactagcaatacatctcagaaacagctgcagccttttagtcccaactcccaagcaagttggggtaatcttaaacaatataggtagaaataactatgagctgaatggtgatttggcattgccatttgaaagataataatctgtaaggcagttactttatagaagcaaatctgtatggcaccgcatacttatcagcagggatgttcatatatggttccagtgaaaccgtgtaatcacatcagtggcaacgctaatcactagctacttttgcttaagtttgttttggaagggttcttacaaatcatagttgaacacccctacttatcttgtacccattttaagagttctgaagccttgaaagtaaaaaattaaacgccaaaccaaacagaaatgctaccatcctacatgacttaacaagagaaattcggcttgaaagagaggtttcggcagtgaaagcaaaattctccagcatttcagagcttaccaatgtagggatcgggatgctggaaattcctgtactgcgcttccgcatcatcgataagcctatcgatcacatccgggttgtcctgcaattcccctcacaaaatcaaacacacaaaaaaccattcgtaaactacaactcgcgagttcatttcgcgacacaacacaacaagcggaggcggagatgcgggaagcggaaacggaggcgtaccacatctctgttcgcctcgaacttctccctgagatccgacgcctgcgagggaggggggaggaacacgaggtcagatccgcgagcacggggggagcagatcggaaaggggggagaggagaggagagctcacgtcctggtagaagaggtggcggtggacggcccagttgagggtgtccttgagggcgcggcggtagagcagccgcaccctctccttctgcgccgcccgccgcgccaggaaccccgccgacgtcgccatcgccgccgccgccgccgccgcttgcttcctcttctctctcctctccgatggtgtggtgggattcggatgcggaggagaggagacccaactgacaggtggcccaagcggaggagggtggatactggctagcaaggccttgatgggctaggccttttgtatagtagtgggctgggctttagcacacagggtattattgtagttgggccaatttttgatggatttgggcttctactaatctggtaaggacctcattgtaaaccacttgtattttcctttatttttttatcttttcttacatttgtgggtatcctagcgaaatccgtaaatatttttctgctccctccatttcatattacaagtcactttgatttttttcctatttaaatatgtttatgtttgaccaagtttatgaaaaaaaatattgtaacagttctaatacaaaacaaacatgttctcaacatatattcaatgaaacattctaaaaaaaacatatattcaatgtaccacaagctgatccttggtattgcctggcctctattcaaaataaacaaattctccaatgacattgagctactaatactaagcaatttcttcagacagaaattctcaagaaaaagaggagaaaagaactcatatgagagtaaagctgtgttcgctatgggttgttcccaacttggaacagtagcatggaaaacggagcgatccattagcgcgtgattaattaagtattagctatttttttcaaaaatggattaatttgatttttttaagcaacttttgtatagaaaccactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtgttaccaaccgggactaaagctagagctgaccttttttttttgcatgcccctgttgctgcatggtttatatatatatatatatatatatatatataaaccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacggtttcgacgtagtagtactcgctgctagctcagaagctaaggaccagtgaattgtgtttccgtcgtagtagaattcacccttgggatcaaggatttcttcgttgatgaatcccatgagttgttcttgaaccgccgcgataaattccaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccctttgccgcggaccaaatgatggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtacccgggtccttgtttttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgtcttcgaccaactcaacttcgaccttagagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcaagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttctgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccacgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacagacgactccgacaacacgtcttttctgcaagataaaaaaatgtattaggataaatgcgaagtaacatatatatatatatatatatatatatatatatatatatatatatatatatatatatatatatatatat

SEQ ID NO: 60990 - DNA, 3573 bp, Oryza sativa
gttctcgttcacgttgtcgcggcaacgtacgtttgacgtgttcgtttctcggctctcgttcgttcgatcgttctcgttttcgttcgttaacggcggtgtggcggcatcggggcggcggttggcgcggcggcgtggcgaccgcggcggcggcgtggcgttgtggggccctggcggcggtggcgtggcgtggcgtggcggcggcggcgtggcgtggcggcggcggtattgcgcgcgcgtctgcgaaagcggcggcggcgtggcgacagcggcggcggcgtggcattggcatgcggcggcggcgttgcgcggcgtccaaagcggcggcgtcgaacgcgacgacgttgaaggcgacggagagagatcgagatcggagagatcgagatgcatgaagggagatgcgggggctctcaccccatatatgcggcggcagcggaggaggcggaggcggcggccaggacgactagctctagacgacggcgagatacggcggcgtcggcgcggggatttgccctaggcagtggcggcgaaggacagaggccgagagagatcgatcggccaaacttttaagtgttggtgaagaagacgagggcgcaccgggaatatatatacccctggatctttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaaccgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccgttggcaccggaacagaggaaccttgagaggaccatagtcaagttcccatatgtcctcgatggcaccgtaatacgtggcagttgttccatcgtgtcccatggcatcgacacgaacaacgctgttttggttcatgctcttcatgtcttgggctctcgtgtagaatgtgtacccattgatctcatatccctggaatgtcgcgatagacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcgacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgtgcaaagaaatgacgataaaccaggtatccacccttcccccagtgcttaagatgcgtactttttatttcatccatacagtgagtgcaagccttgtacccctt

SEQ ID NO: 60991 - DNA, 1122 bp, Oryza sativa
gtatttggccacctttccggccaaagccaactcggcctgctgtttgttgccccaaaggaggacaacggggagacaatcgtcgcgcaggatgcgcttgtaatcacgtggaactcgtcgccagacaccgcagatcttgcccgtggcattctgatagacactgagagtgcccgccaaggggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatccacctccgaactaagaccttccatttccacctctcgcttccacccaggtggcattcattaatcgtgcataaattgagggcaggtaaaaagtagagttttttgaacgggcagttttacctacatttaaataaggaagtgctttgtatttgaggatgtgcggactctggggttctgaattcatgggt

SEQ ID NO: 60992 - DNA, 1253 bp, Oryza sativa
gtgtttattctgcattatcttgtatgcaattgcaagcaagtccatttcaggattataattagggaaaacagtaagatcaagttgtttcatgttattaattgccgaaataccaagtcttccaagatttctttgttacattatagtagaagttttctgctagattttgttctggtatcctggctaattatcagcgattacttacctccgttattcgatttttattcactataggtactacattcgtacggaggactacattaaaattgtcttgctgaaattgtcttgtttcttgagctgaaccatttttggtagagcctattcacttaaaaaatggtactatgatgaagtcaaatataaatgaatttggtacagcctattcgcttaaaaatggtactataacgaaatcaaatagcgttccaaaattgctcaagtgaaggtttatcaaactacagtgatgataatgtcttgtttgtctcagttcaacgaatttttacatttccctttttctgaatccaaaatatatagaaaggtagcagtattaatgtttttatgtttcaaaagttcaacttaaaagacatatgtaaaaactcatgttttcataatcagagggagtatttgtcaaactagccacacagaagtgcatctgaagcaacttgccccccccccccctcccaaaaaaaatgcttgcttgttggcttaaaaaaacgcaagcaacatttgaatttttcatattgattttaaacaatccaaagcattttttttctttttttcagccttagcttttaaaccactaagaatagaaacacaagttgtaaccccgtaaaatctttggcttctcatatttacgcaattatgagattacttattttgataaagatttatagcatcattcaagtaaatacaaagtgagatttaagaaacataagctgcttgtgatatagctgcacctaattaagaccggttaatgctatgactataaatagggaccaagatgtcctatgaaataaaaaaaatagaaatagcataatccaagcaaacccactttctaaattatgattggccatcatattagcaaaaaaaaagtatttttttaggttaatgcacaaaaacaattcgagattaactcatcgaggagtacttaaaaaaaaggtgctaatgtctgcgccctaagattacttttttgttgtctcatttatttttctacgggttatcatccgaaaccaataaattcgacatagctgatacattttcag

SEQ ID NO: 60993 - DNA, 13082 bp, Oryza sativa
taattacataaatgaaagctaattcgggaggcaaattttttaaacctaattaatccataattagagaatgtttactgtagcatcacataggctaatcatggattaattaggctcaataattcgtctcacgaattagtccaagaatatggatgtgttttattaatagcctacgtttaatatttataattagtatccaaacatttaatgtgatagggagttaaaactcaagttttagtcccacctaaacacggttcatcaggatacaagatatcagcacagtgttgattgagtaggttcatcaggaagcagagtaatagcacgtaacagagttgggtatcctgtatacagcagttgtccccaaggaagcaactctccatcacatcacatcgcggaatctaaaaaagaattcatcaatcctccattttctaaaagaaaaggaaagaattcatcaattctgccctgccgcagctgcgtcctataaataccctacacgcgtagccatcttctgcaatcatcaaaacacctgtaatcatcttctgaattcatcaattcagagttcagagcagagtgtccctgcttctgtgcagaggagagagatcgagctatagagctagcctggctgctgccatggcgaccggacgacgcctctccatgatcctcctcctcctccttctcggcttggcttccggcgacaagattctcttccaggtacgcagccagccacggactgaactgaagttgtgaccgatttcagttcagtttctgaacaagctgttgcgttctcttcaggggttcaactgggagtcgtggaggcagagcggagggtggtacaacctgctgatggggaaggtcgacgacatcgtcgccgccggcgtcacgcacgtctggctgccgccgccgtcgcactccgtctccacgcaaggtcggtttctcctgctgctcctccttgtctgaaactaaactctgaacattttggagttggcgaaatttgggatcctgcaagcgtggagtggacagcacgctaactaagctaccctgattgcgaagtgtggataatgattgtcactttggcctttatttcatttgggttggaatgagatgtttcactgatttagttgaggaatttttggctagataatatcacactgacatgcgtaagggtcaatcaatcttgcaaccccattctaatcttatacagatgcaatacaaaggtaagctgtcagcagttagaaaaaaagattaatgatatataattagtgtaataatgagtactagtaattaagctccttccaggaaaaaaatatgtttttttttcactttccgaagtaactaatatgccactttattatcatgtttttattttctaaaaacaataaaaaaaaactactactgtacttcctgtgggtacgaaaacatatcatttctaaacatttaaactggatgtgcaaaaatcatgtgtaaatttagcatactttatccgttccacttcgggtattcaaaatacatactaactcagggtctatttggcataactctagcttcagaagctccagcttcaggtcaaccttttccgaagctggagctcaaccaaacgattttagctccatagaaattgatgttgattttacaaagttgaagttgattaggacgtgacatacacgggagcgtatcctatgcacacagaccctcgcgtgtacacaccgtgtacaccaactaaaaattatcacaaaaaattttaggaaaattcatacatgtactttcaatagtattacatctacgtgcaaagtcgcatcttcaaattcattctacatagagaataacaaaaaagataaaattctgacaaaattgcaaccttaaaactgtcagattttttgttttttttttgttacggctaaaatataatgaatttgacgttaagattttaaccctaggtgtaatacaattgaaagtatatgtatgatttttttctagattttttggtgacattttttagttggtgtgcacgtgtgtacacgtgagggactgtgtgcataggatatgttgccgacatacacacatgtagtgagtatgcataaggcatgccatatttatatcttggtctctactttatcttacatcattaaaatgtcaatggtgaatttcatatctctgtaaccatttaccattattcatattttcatatctttctctacaatcactatgcctcattctatctttttttattgaataaatgtatgtccaaataacaacttttttgttatatattcatgtagtatcataatcagcgcctagatctacaaacttagccatgtagtatccttttggtcttggtttggttatgcaccaaaatgagcgattttataggttcgtgtactagattgcatccacctgataagtttgcatactgccaatgcaatttactcgttattcaatgtggcgatgtgcgtgaagggtacatgcctgggcggctgtacgacttggatgcgtctaggtacggcacgtcgatggagttgaagtcgttgatcagcgcgctccacggcaagggcattcaggcgatcgctgacgtggtgatcaaccaccgctgcgccgactacaaggacagccgcggcatctactgcatctttgagggcggcacacctgacggccgcctcgactggggcccccacatgatctgccgcgatgatacccagttctccgacggcacaggcaacctcgacaccggcgccgacttcgccgctgcccccgacattgaccacctcaatggtgtcgtccagcgggagctcaccgactggctcctctggctcaagtctgacgaggttggcttcgatgcgtggcggctcgacttcgcaagggggtactcgccggaggtggccaaggtgtacattgaggggacaacgccggtggggttggcggtggcggagctgtgggactcgatggcgtacggcggagacgggaagccggagtacaatcaggacgcacaccggcaggcgttggtggactgggtggacagggtgggtgggacggcgtcggcggggatggtgttcgacttcacgacgaaggggatcatgaacacggcggtggagggggagctgtggcggctgatcgaccagcaggggaaggcaccgggggtgatcgggtggtggccggcaaaggctgtcaccttcgtcgacaaccacgacactggctcgacgcaacagatgtggccattcccctccgacaaggtcatgcagggctacgcctacatcctcacccatcccggcaacccatgcatcgtaagtactcctactactgctacctctgtttttaaatagatgacgtcgttgattttttatcacatatttggccattgtcttatttaaaaaataatgtaattataatttattttgttatgaattgttttatcactcaaagtactttaagcatgatttatatgttatacatttacataaattaattgattatttggttaattgactctcgaataacatgcactattaattgattattgtcatttcagttgactataaatatttttttaagaaacacactttggtaatagctatatttgtgaccctacagacttcagtagtaaaacatatttataattatttgtaattttttccaagtaaggaagtagtcaaagtttaatattgaatacttcatcaattttttgctatttattagccgtctaatacttttttgcccttatttatcagttgtctactaaacttgcataatgcacgtgtgtacatatatatacactcatcagtcatctaaaattgcacaataatgtgcctgtatatatgtacatgtagttctacgaccatttcttcgattgggggttaaaggagcagatcgcggcgctggtggcggtgaggcagcggaacggcgtgacggcgacgagctcgctcaagatcatgctgcacgacgccgacgcctacgtcgccgagatcgacggcaaggtggtgatgaagatcggctcccgctacgacgtctccagcctcatcccgcccggcttccacctcgccgcccacggcaacggctacgccgtctgggagaaaatcgccgccgccgccgccgccgccgatcatcgcacctcttccagcgcatcgctctgattgattagcgatatgatgcttgtgtgccacctcttatgttttacttctgctgtatatggaacaggctcttctacctttaaaggtacgtactttcgtcactgatatgtgggatcgataaaccatgggtctaactgttagtgataaagccatgatgactttgaagatataggatttcaatccctgtatatagataagtacatatgtaatatacatacgcatgattagtgacatatatatacactacattgccttggctgtgatcgaccgtcggtattggctggagatgtaaaccatttatattatcttaagagaaaaatatatacacagttaaccgagcactcctaccatttcataattctttgtgttttgaacaaagttgaggtcaaacttttataactttgattatcaataattttaaatatatttagtttaaaggagctagagatttatctttcaaagtattataagaaaattaaacatgcatttatttattgtatatattataataaaaaaacaaaatcaaatatatattttggagaacatgtcattgtccaaaacgttaagaattatggaaccggagagagtatatatagttgtgtctccaagctaattaaatcctgattactgtaatgtgggatattaaataaaggcactaatctgttcattttaagtgatttggtataataattgtttatagctcgttaagtaaagacagatatggtattatattccattataaaaaaaagcattaatctacacaattcgaactttctacttatggctattatgactaactttattttcatatccaattgagattagataaagagatactccctccatactcataaaggaagtcgtttaggataatgtttaagtcaaaccttgggaatataaatcatgaataactctcaaattattaagtttgaaaatgtaaaaattatatgaatagatttatcttgaaaaatattttcataaaaatatacatatatcatttttcaataaacatttttatagaaacaagaagtcaaagttatgttttagagaccgtgtcgctgttctaaacaacttcttttacgactaatgagggagtagctcattaaagtcacttgaacgtggtggctcgcaccgacacaaaccccggccgacatgaacacgcttcaccgtggcggcacgatggtgcatggtcatgcatcgctcgatgcttgccggccatgtctgttccaaattccaatggtgttgacgcacacgagcaaggatacggaggattgagggacgccagctggaacgtacatgtgtacgtcaaatgatcaagggatgaaatagatttgaaaaatagaaggtcctcatcagttggtctactattattataagtcataacggcttgttagcgattaaaaaaataatatatgagtaaaatttttgtatatatgttcttagtgattgaaaagctaaaattgaaaaaaaaactatgttgaaaagaatcaaattcaaattaaaatcaagttttaaattttaaatttggctttggcttataagccatgggcaaacgatgaggcacgaagcttgttgagcaaatagctatacaaatacatgatgaggattgggtcagctaaaatttgctcacaaatatatatctcgattgggtaaaaccttacgcccatgtgactattgttcagcctaacagttcacacttttggtcaggcttgatgaaatataacatagcaatttttcaactcttctccatttcaaccacacaatggtacatattgttggcaacttttttggcaagtagacaaacataatcgcaacacctaaacgctttgcggtgattgtagagtcacaaatcaccctaatcactaccatatttcacatgacaacaaatgatccattatcattacaataaatttacgtcacgaaacatgagcatatctattcacccaacaaataacataccaactctacaaaactattttccgcatcactagcaaaccatatttcagctatttcacaaatcttcgtatctcaacaaacatcaaattttcacagtgtatttgacctaaacccgataatttttttattttttcaatttctaaactatttttggttttgtcctcaaatttgaatttatcttaccctatttttaaaaaaaaatcttcatcatctgccactacaaatcaagaactacatccatgattttttttctttttttattttttttggaatttttaatttgctcaaatttcatccaaaccataccacggtaaaccgttaccgtgtcccagcataagcgttattaggtaaaccctggcactgttagagggtaaaacgccgaaggttggctagggtggtgacacgtggcgtgctgtgggtgtggcagaaaagatgagcacaaggaggcgatgtggcatttcggatattcaaaatacataccttagataatttgtttgataaaaagaattacgcgtttccacatactgtattgttgagcatttttaatttagaaaatatatcctatacacacaagttccccgtgcacaccaactaacaaatgtcacaaaaaattttagaaaaaaatggacacttactcctaatagtattacacatatatgcgaagtcttatattgaaattcattatattatagcggtaacaaagatgtgaaaaatctaacagttttaagggtaaaattctgtcttttttgttacgtctaaaatataatgaatttgaagataaaattttatacataggtataatactattgaaagtatgtgtttaattttttctagaattttttttaatatttgatatttacgaagtgtgcatgaaagctcgtgtgcacaagatatgttccattttaaatttacaggattgataattaactttgttgatgtaaaattagttaattaatgtggccagacacgtcgaggggcacggcggcggagttgaagtcaccgatcggcgcgctccacggcaagggcgtgcagacgatcgccaacgtgtcgctgatcttcgaggcggcacggccggcggccacctctgctgggccccccacataatctttgtaatcacatcaacgtgaagagcacaaaatctcacacaaatgtcaccattaacatgtacttccaccgtttcataatgtaagtcattctaacatttcctatgttcatattaatgttaataaatctagacatatatatcattctagattcattaatatcaatatgaatgtgagaaatgctagaatgacttacattgtaaaacggagggagtactcgcgattcgcgaatgcaccaggtgctgtagggtagtaggcatgctcagcacttgtgacagaggtctgagaaatcatacaacagaaggtccatcatattcctatactgctaattgttcaagctggtggctcgcaatggtgacatgatattattctcagaagtcgcaagtatgacctcaagcaggtgatattgtgtgttacatcatacctcctatacattgctggatggaacccagtaaaatgaactcattgcaatagcgggagaaggctaggggggaaacatgatatgaagtgaaggcaccaaacagctagcggaatagagtgcaacttggcctccatataactgcctacagagcctatctatgtgctagccaggtgtttcaggaagtagtggattagacactcccccgtttgtctactcttcttcaggattaaaaaagaaccagatctaggttttactttggacgtttgcggtaaggatacatgatatcatccatggtgtctttaatgtaggccccaactttatttaagttccttgctacaccattagccacaagtccagcattcctctgaaatctgcaggttcatcgggaaatccgtcattcattaaattttgatgccgatcttaagggatctaaacataatctaaaacagaagaggaactcacttggttaagaaatcatctcctctctgtgcaggcttatatcgccgtggttggggagctgcagtgttatcaagataagttaagtcttcaagaatagaaatgaaatgtagatactttggacagttactcataacaaactcaaagagattcatattaatgcaatttccgaagtgaccagattgtttcaccaataaagtcaggaccagtctgagatccagtaactccgattaatgagaaattggtcatacaagtagtggccaggaaacatttctacacaaccgtgataaaagtacagtgtgctaccatgtgtgcaggttggtcacaaagggtcaacaagtaagggcaaaattggtctatcatgataacatttggcggtttcaattttacacaggctcaccaaaaataatagggataatcaaggaggcaacattcgcactcgaccattgttgtgcactaacaatcctcattcaaagttttttctggagggaacaggcaggagctctgccatttcattgataggagggaaacatcagttacaacgctaaaaaaaaaggcatactgtgtagaattcaggtatatgtataataggtccaatatctaaaccaactagatgtgacaacaggcaaggctcatcaggtagaacacaatagccactacacagacaatcaactttgctagactaaatgtgtcagtgattagcatactgtggtagaattggtgttgctgttctacgtgctagtcaagcaataaaaataaaatatattcctaccttccttttatggtgagatgaagcctgattagtcgaagtttttctatcagccaatagctgcatgggcatttgcagtgcaaaaagatcaggaaaaaacacaaaagatatatatttcaaatggaataggcgaatagcatgggtagcatctgtttgtactgtcgttcataaaaaagaaagaagaagtctattttgtaagcagaatatgaggaagcaagctaccacgaagtctaaccatttgtacatactacagagctaagttagcacactgatacttttcacagcatgtctgaatcatcacaataattctttatggtaggagaactgtttcataactgcttactctgcacattatgtcatactaacatgctccaacatgtgaactgacaataatgtgtgcataggttcagagcaataacatggttaagtgggaaatacctcgattccaacacaaataggcagttgcgggtgcttgtcacctttcccttcagaactcttcttgtcatccagatacatggaatagccgatacatccatatctgaagtcggaaaggttgcgaccttcctggatagcttccatctcaatttctccaaccatgtgatcagggactgatgcagaaacatagaacagtcagccaatgccaaccattgcgaccgaagaaaacaattcagattgagcatttaaacaatccataaaaattaggccaacagttaagtactccattaaatgacagcaaattcagagtaaatgacaacaaaacatttcaaaccaagcaaggagttacggcgcagtgcgatggcatgtaacactgtccagatctgcagttctgctgctattaggcattagcagtggcagtggcatgctaactagcaacaagtcaggatgaatacaaatatcgatcgtgcgttgtggtgtgtggtaaggatcatggttacttccaaaagttacagttgctactatgaccgcgccaatccagcagttgcgattgaacatctacgttccccattgttcctgcgtgcgtgcgtgcgtgtttgcagggtcactggaataaggtgccagaaaaagctccggcgctcggctcagaggcagccgcggctgaatcagcagcagaagaagaaaccctagaactcgtgagaccctaaagctagcgcgcagtagcatagcatatgctcacaaatgaagggaggggcactaccttgggggatggcgcgggtgatgccggcgcagacgggaccgcggtctcgcgacctgagcgacgacgagtagaagaggtagcccttgcaggacttccccttcaccgccccgcccccgccccctgccgccaccggcggcggcggcggcgcgtctgcaccccgcgcctcgccggctcctcctccgccgccgccggcgacgcgctccatgccgggctggcgggcggcgagctggagggatacgcgtgtgcgggatcgggcaccggcggcggcggcgtgaggcggcggagttgggaggagtggagcggggggcttcacctctttggctactccaacttccgtttatttaccatttcagcctcccaaggaaacataatggatgagatgagcccgtgtttgtgttgtgatttgtgaagcattcccttttcttttctttttttttgacaatcgtgctttatttaatttaagttgcaattgtgattttgtccctttttttagcgtttgtgattttacttttagtttttttaaaatgaagctttagtttgcccctgctttagatggcgttaggtgggtccagattttgtaagataataaaatggataaggtaaagaaaaaaatgtttacaaaatatagaaagaccattgtacccctgtaaaaaacacttaccagttaccaccacctaagccatccaacccattctcctctcccattccaaacaggtggatgcaggcgacggagacagaggtggcagcaccggagcaactcacgagcaggctgcgacggtggcagcgctcgccggcgtgagcagcggctgctcggtagagagcaggtggtggctcagcgacgctgtagcaggggaaggggtggcttagcttggctcagcaacgctgtagcttgctgcgaacatcgttcagagtaggagcagcaacaaggacacacgacaagcaagctcatccacgaggccaatgcaagggatgctgcctcctgattttctttttttttccccatctcatagttgagagtatatatttgggagaattttgtttggtaaatattttttttcctgtgaatgcgatgaatccttggtgaattttttgcgccctgtgcaacttctgtaaaagtgatatccaaactctatcaaaatttgtcaagtttggtcaaatttgagagaaaatgtgaagggtatatatgtcttcttgcagctcatttgacactgttagttggtcttaacagagtaagggcaaattgaaacttcgtttgaaaaaagtaagggcaaaatcacaaaccctaaaaagaaggggtaaaatcacaattacaatccaaaataggggtaagaatgtaattgtccctttctttttccccttcctttttacagtttgaaatttcatattgttttgtatttgaagtaaggatgtgtaatctaaaaacggcaaatatacaaagacagtgtatgaaaaagagcactagattagaaatgtgcatcaaatcgtacagtagctctctccttttcagcttattcactgaatcatttattccacgctctagaaaatattgtttttcaaaaaatctatcgcattgattaaattttagatttttgttttaagctatttagtattttgtattaaaataattaatttatttcgataattataagtagataatccgtgaactatgttcaaccattcatttgctgacaattggcttcggccttgcttatgtttatatttaccaatcaaaatatgaatttttaattttaaatttaaagttgattttaaggttttttatcgaagtttatatttcagcctttgtttttaaatcgttaagaacacgtatataaaagtttattcacattttttttggcaaatattccgttttgcttatgcttaaaatcaaccaaacgatggcttccaacgatacatgggcactgaatgatttaattcagctgacagaaaccatctctttgcatatcatagtaccagacaagacaaacgatgaggttaattggatggaaaggaaagcacgcccattatttcatcactgggatcgaattaaacagcagtacagctggtatatctgaattcttgtttcaacaaataaatatcatatgtacaaaacgtaagattgcaggatacaattagttcctgtacaatgagttgtatctacagaatgaatacaaggtagtgatgcttatccatgctgagcgctgcggctgcattccatggccagaaccaagcactgtcaatgagttaacaaagaattagtctcagagtcacaaaaaaaaatgcagttttcgatcaggcaaaaacgactaaatacctttctagagtcccatttggagtagcagcactgtctaaccattaatgcagatgcggctggatatgcatcaccatcagctgttagcactgagattgaaatttttgtcccgtttcactgttggtcagtgactcagtgttacagattttgcatactatgtgcagcaaggacaaatacatacctcatgattgaaagagggtaacagttgcaatatatccatttttcatgacctgttaatcagtgaaggcagaacaaacggtttcacttctgagtaatgacaatacagtttgcacagggaaaactctattcttatttgattaattaaaaaccacctcaaaagcaatattctgatatccatagacaaaagttgacccaaatggattattcatggagccttgcgtctggattgctgctcgaccacaatcaccaaggatctcctaatataacaaccaaaatagatggttttgttaacacaaggcaagggaaaaggttaaagagacatccatacttggtcaaaaaaaaaaaagaaccataacaaaaaaacagcattgtaactcaaagcatagatacatttacagcagtcataaacagaaacgacattcctaacataagaactttggccattatgtttatctggaagaataaattggcattcactattcaaaaataaagggatctctcataaaataacctaggaagttaaggagatataaaacagaattgcaacagaagatgaacacaatgttgtgaacttgtgat

SEQ ID NO: 60994 - DNA, 4548 bp, Oryza sativa
gcgtgtcaagtaatctgagatcaaatattgcctgtagaaaaatcttaagtatattggttaaaattacatataaaagtcataaaaaaacatactccatgacaatgtagacattgaggccatcctcacatgcatcatagaatttgacgagattattgtgccctgataacgctctcaaaatttttacttctctacgaacatcctcaatggatattgccgttgtcatctgccaaacacaagagtaaattgttaaaagtaagttgctaaaatttttgtttcagttcgaagaactaggcactgcaataaatttataggtgccgttgtgaaggtacttgcaccattgcagttcacatcaatgaaaagagaacaaacaaatcaaataatacgataagtaggacccattctactacattgcatgctttcatttataaattattttataaagttggatcaagggaaccggagcaacaataggacacttgacaattagctgccctgcggaaatcccattatttatcatgttaaactgctgctaggttgagttgaagactgattataagaaacttgcgctgcatagagtaaacttaatttctaaactctaaggaaaccatttgtgtgttaaatatcatgtcggtttgatctttgacccaagaaagggtctcctgagatggttactaattgataagtgataacaagattaaccgtatgagcctcccactagggctactggacgtgctaccgaatcttccagttagtttaaaaatggtttgtcattatctcaaggtcccagatttttggcatttaatgcagtctgccagcaaatatttagcttgtgatatatttaactgtttagacaacaaacatccagaatgtattaaaaatatttctaaaaactatgaaacagttttcttcaaataattaaatgatttttctgaaaggctaaaagtaaagcagatgcctattgatgttcagattccataaataaaccagttggaaccaccgatactcagctatgacatatctgatatcctaaaaagcaatgtgaatatctgttgtggtggtagacaatcaggccaattcatattcagatcatgaatcatttcgaattatgtagtgcctgatccatgaagcccctgacaataaataacaaccaaagggcactctacccatttttgttgtatcactcaattaagtaacagtaccatatgccatgtgtctcctaaatcaactctaagctctgtagcctccttggatctttctccacttcaaatgtctttagtacatgtcagcctgcagttgctgtgacactacctcccactgattgtgaattgtgactggcaaatggtgacacccaaaacctctctttcctatgatgtgcttttcgaaactaccgtctcatatggactaaaaataccgataattgatcactagaccagtgtattcatgtcagcttttccccagatgtgtcacatgaaaatccacctcaaaatcgacaatccttaactaaaagccaaaaaggacagataaaaaaggtaggttaggacatgtactgctgattggttagaatatcatttatcactagcaacgattggctaagtcaccaatttaatcaatgtactagctgcatccaaaagcctcttcacaccacaaattaagacttgggtaactgttcgtccctcacaaatgcaactatcttcccctactgtttccagtcaaaaaagaaaaacaaatgtaactctctaaaggaggaaaatgcagaaatatcctggttcaaccttactgtctatttctctgaaagacaaactcctcaaaaaaaatgaaattgaatgagataatcctactccagaaactgagcaagattaaccaatcgccaatgtagaactaatgtggcaaaatccgagattcgcaatcttccatttgtgccagtatccttggggggggggggataatataataagacaaaattcctaaatctcagttacttctatccttcaatctcgatcatacgaatcataacactgacctagatttcagttatttcttcaaaaatggcgcgacggcaacaactaaattttgaattcatgaaacaaaaaggtgaaccagagcttaaaaaagcagcttatcaccaccagcagcagcgagctctgaccttagctttggcgatgatcttgacggcgacggtctgtcccttgtactcgcccttcttgacgacggcggagcaagtgtgtccgaagtggcccctccccacctccttcccgagctcgtacttcgcgccgaagttcttcgagaacccgaacgtcttgtccaatggcctctccgtctccgccccatccgcggcccctccaccgccgccgccagcgcccacgcctccctcctccggtatcgtcccttccttgggcttccccccacccagcctcttggcgagcgtggcctttatgtgcttggccggcgacggcggcgggaacggccgcttgaagaacctcctgggcgtcgacctcgccggcgacggcgacaccccggccggcagcgggctcgcgcccccggacgggtacgggctcggccacgccaccccaggcgtctggtgccccggcgtcgtcgatccggacttactcccacgccgcctcggcgtccccacctgctgcgcctgcgcctgcgcctgctgccgcggcggcgtcgacggcagcccgttcgccggcggcggcgactggtgctccgtcaccaccccgccctcatcgtccgccgtcctccccgacgcgcccttgccgtagcactgccccatggcaacaacaacaacagcctgtcggcgcgcgcgggcgcgggcgcgggcgcagcggaattagggttagggtttggggccccccgcaccgccgcctcgcgaggtggaggtcgaggaggtggaggcgagtcgctcgttggggaagaagaagaagaagaagaggagagagagagagaaatcggaaatggcgttcgttaccaatttctctctcctcccccacctcacctcgggcttacattacatcactccagggaggcgactgtcaattccacgttttcccaggggccaatgtgcaaaagtgccaggaaatatttttttattgtaacgcctttctggtggcgggtcccacgagggggtgggcccacgcgtcagtgacccgttcgtggcgccgcgtacggaagccgtgcgtgggaaacggaaaagggggagaaaggggaggtggcaatgaatgagtacggggtgaatgacaggtggggccgtgtggactcgtggcgggaggtgggtggtggggggagtgggtgtttggtgtttgtgtgtgaggtggggtggtttggggggcgctccagaaacacggcgggtggccggggcagttgatgcttccgttgtccacttgtgtgtctgtaccccgtttttattacacccccaaaacctgcctctctctctctctctctgctatcaaggattagtttgtttcttcataaccttgattagtttataatgaaatggatcactagtttattttccagtacatttgaccaccatttcaccgtggctttaacctctcacagtttgttctacggtttaggtggttttcttttctccagaaaatgaagatgatgaagattaagttttttacgtaaaacgaggtggtatttacgtatgatttattaagtataaattattacaaacttgaaaatagattaatatgatattttagagaaactttcatatagaaagttttcacacaaaacacaccgtttagcagtttgaaaagcgtgctacaaaaatctttaacttcatccgactcttattggagaaatgaacaggaccttaatgaaatggattactagtccttaaaagatgaacgaggcaacgagatataataatatatgggtaaattattatacatgtgttcttacttcttagcgatttactaaggggttgttcggatttatgtcattttaaaccataccaaattttggtaaagttgccaaaactttgcgtctatttagttttttttatcaaactttagtaaacacataaaaaatcatgccaaaacttggcgatattaccaaattgccaaaaatttgacaataatgtttattttgactataatcagaacaacccctaaatttcaatgctgaaaaataaactacgacgaaaaatgcttaaaattaactctaaaattaggttcgaaattcaaatttttgttgcagctgatgagcccacaaacaaactattcctctagagttctaaaggagctcttggattaaaaatgaggtattcagatattgctctgaaaattcaggttcaggcatgtactgaaaattgcatgacctgaaaatctttcagaagagtcagtgttgcagtaatcatttcgagcataatacgacttcgttgagttcttttcgggaggagtaacgaactgcatatattgatttctaaagtgcattcaaagaccggatcaaatgtgttcctggaatttgcccgcacggtgagtcttgttcgtttctgaatcttcctctccatcttttccatctttcgatgtgttcagt

SEQ ID NO: 60995 - DNA, 739 bp, Oryza sativa
ctcggcctgggtgtttgttgccccagaggaggacaacagggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagc

SEQ ID NO: 60996 - DNA, 14164 bp, Oryza sativa
cttacatcaaaagagagagagtggtaagagttcttcatctccactgtttttccttccagttttgaacaaacatatggttcagggcaaggaaattgcccagcagttgtgaatgccttcaccacagctggagtcgcctttgcacaatcgtcgtacccagtagcaacatagtaggtctccaaaccaagagcaggaacagaagctctccaataaagacggtgctggccagtagaaaccttttcgccactaacatactgccactcaggggaaatttgacttctcaaacaggaaccatttgaattgagaacagatacatcaggattacttacaacaaccataacaatctcatcccttgtttgctctaatgggttaaaaaggacaacagaatgtgccttccctccatgagggttgagaaccttgtatacaggttgaacatcatattttgaccgttcctgcactggctcaaaatgcgatagtaaggtaggatcagatctgtcatggatatcacctaaaagcacttcaaccgccctggacataaagagctgcaagtcttgcaaagaagtgtgcattcgagtcccatagtccactacaacatgatccttagctgtgccagttacaccatcatgatgctggaagagtgccaggttcctcctagctgctgttagcttgtgagaaaagctgatggggagttttacacattgaagcttctgacagtatcctagaacaaaagaactcagaatctctgaggcacgtagtgtctgttctagtactcggtcaactgctttgaagtacggccttgatacatagtaaccactccagtaatcctgatttctatcagcatatgtaaagaaatcacctgaaagtgttggaaaacctggcagctcagaagaaaccagttcaccagggcgtgtatagtttatcctttcagcttcatctctcagcgtggagaagtaatcctccagggtaccaaattttacttcagccttaagatggggattagagtttatgtaatcaaaaagcttttcataattgcggaactgtgcttctgcttcctctgtactaacataccggaaatcatcccccaatggaatgagaagtgtatttgttctgtacagcgtagactttttcctgtattgatctagaagtttcattgccctctcttgcacattgttagcatttgtttcaactggatcaaatctccacgggcaagattcatagctgaagctacgcattcgagcaaagtcaaactggcagcagatagctggttctggtccacaggtgtgtggaatgtcataagaatagaagggcatcatatgaacaaatatatcagttgtttcatctatatcccagttctgcctccataaatattcaaggttcttattcatcgcaagctcctttttcaattcataatgcgttcgctggattaacatgttgtggaaacccattctcctcagcagataagccatggtagctgaataaccaaatggatcaattgaccaagaatttttaggaacaactccaatggtatcattgagccacatgtttccctccatcatctgaggacgaagaatagaaagattggcataattaaataatgttccagcccatatactatagtcacataactgacaattagagatttgttcattatatattgcaggttggtcagagtaacacaactttggagtaaaaaatagaagtacgcaaactttgtctccgtaaaaaaatcaggcactatgaaaattgaagcatcaggtttccattaaaacaaaagatgtagctggatttgaacaagatataaagcatatttgcttcatttgttagattactcttctgccctgactccaatgttcaggccaacatagatagcattagcaacacaaagaaaatcgacattaagctatgacacagcttgatcgattaaaagagggatttgttggagggaattgtgtaccttttggagtgatttttaaaaagtattaatgtaacttcaacaatacagaaccaaaacgttaaaaaaattatatggtccatatgtgaatacaaccaggatatcttaaaaagggtaaagtctaaggactaagtgcgcaccatgaaattgatgaatctagttgtcaagggtttcttgtaaaaaaagacaattctgagttcatgcatttgataatcagaagaggtgtggattgctccacaaattattaaacatgaaactgaatagtgaaatcatgcaatacaagcacattgcaacattctgtctacgatactgtccctgtatttttcttcaagagcaccatctaaacacagaccaagtcaccaagatggtgtaaactaaaactgtattaacttcattcaattggagaacagaataaggtgcatttgtccactccatactattgtatgcttgttaaattgtactatcgatgcaaagtgtcagtgctaataatgaacagtcaggtgagttcaaatagctaaagcagcatgatagcacgtagcattaaacatatgtttgcagcacgtactgaagtgttttttcgatatgtacaatttacttttatgggtatttcaggtcagtgatatacacaataggaaaaggaataaataatgtgatttctttatgcatcaggtacaaatgaagctaagaacctggcgcatttagcaattagcacagaggagataaaagaagatgtgatgcacaaagagtcaagagtgtacttgcctgctctatgatagcaaaatagtgggagtttgcctgcacaaagaaagaaagatggttacatttagcttcttcttcaaaaggaaaaaaaaaaagaaagaagtgtgaaatacttctgatcagaaatccataacacagtaaacaattgaactaaaatagcatctctccaaggacttctacatcatccagaaaaccgcaataccggacagatcattcatcaaactgacaattgatcttaatactccatttgtgtaactctgaaacatgctgttctcaaggaaaaataacatggaaattatgcagcagtcaaatattcaaatcatgagttctattttattatttaaacaatggataccaagtatctcatggcaagaggtaaaatattgaaggaaaacatattagacacatcagagttgttgctgatcctttatctagtgctgaatctccaacatgtttactaacaaattggaacttcagaagcatcacccgtcaaaagcgcatttgcataattcaaaacagcaatgtgtacacaacataaaatgcgaataaaactgattcctgagcattgaaactacggcccaatcaggtaaagcatgaaatgaaatttcactccattcataaccaagcaacaaatgacaagcataccatgcctcaaatgccaacaaatacacaaaaggcaacccaattagacaagcaaaaactgccatctactcctaagatcatgtataaaccacaaatgtttccttccgtctcacctcgtcattcatgacccaccctccactgacaatctccagctgtccatcacgcacaagcttggtgaacgcctcctgcttcttccgaggggcgtcgcgccaccacctctccaggtatgacatctcctcccataaaaatttcctacgcgaatcctacatgacaacaaaaaggttaaagttaggcatcaaaaaccgcactaaaaccctaacaccgaatctgggtttagatcgcagcgaccttggagagcgactcgatgatggtgtcgaggatgtggcgcgactgcttctcgtagtactcctcgacggtgagacgccatccggggtcgttgtgggagtggggcgcgacaaacaccttgagcttctcgccgtcccactcgtcgctcttgtaggagacctcccacccttgcttccacgcgccgccatccacgtccaggaactggatccggtcgtacaggtccttggtggtgatgtccacgtgcgcctcgcggccgatccgcgcggccacggcggcggcggccgcctccgccgcagccgagtcgcggcggaaggccggcctgcgggtgaggcgcgggcgcaggcgggccggggaggtcgcggcggggcgggaggaggggaggccgaggcggaagaaggcgaggaggaacagggcggcgaaggcggcggccgcgacgtagaggacgcggcggcgggaggaggaggaggccgacgaggaggcggagtgggccccgcggcggcgggaggcggccggggaggagaggcccttggagcggaggtggtggtggcccttgggcttggaggtcgtcgggaggagcgcgcccgagcggccgcctccgccgccggagaagaacggcatcgccgccgccggcgaggcgaggcgggtgggaggaagtgggaagttgggtgggggggggggagtgacgacgacgtcgcgtcgcgggtttctccggtgatatttttcggcgaaatggcacgctaagggacagacaggtgagagagaccggaggaggaggaactgtaccatcactgacatatgggtcccacatttaggtgggccaggacagtaagcgggacgtggcaacgcgctgtactgtgatgtttggattagttgggtactttggcgtacctgtcaaaaaagaagagtcagttggacattttaaagaatttggtattctctggcaataaagtaaacttctagaaattctcatatgcatatatactgattagtaataataaatacctgattatttaaaataaatctgaaatattataaaatgctatatttttagtgttacaatatttacaacatggtacctagattctaggtctggaatgtcttgtatcatacttcctccatcccgtaaaagaccaacccagtactggatgtaacacatcctaatattatgaatttggacataattttgttcagattcgttatacataatgtgtcacatccagtctcagatttcttattttgatacagagagattatctagtacttagtagttaggataaccacgatgtttatttatcaacttggtagtaagatgggtttcagtatcatgcaataattgttactagcaggtttcataatgtgtaataccttaaatggtaagtaagatgggatccacattgaatgcggagattgtcattcatgcatacccaagcaaatactactcatatattttaatggtttattgctagtagtaagcatactaccggttataactaataccacctaccacaaaagtatcttactaccatgtaataagctaacattaattgctttttacattttttttctcacatcgtggttgcttttaatgcttctccatcttaaaatgttgctacctaatacatgattggacactttataatataagacattagcatgatacctaggtaccataatctaatacccataagtgcgtgctgacgttagcacataaagaattctgttaggtaagtggtacaccgttctttagtcattctcttaaaaaactgggaaccctaagttatgtataaggaggagcggatcataataaggctatagtgagtgaatacatggtcatggaattaatgaaatagtccctacctcatttgccacaaatgtatttcatggaaatggtacagagtatactctaccttgtcattggtcttcatgtctgagtgtgtttgagggtggtttagtgtataagtgtggtatgtatgtagtgatgtttgtgcacgtgtgtcttccgtgtaataaaaaaatggcttatatcagcaacaaaccaaacatgatcaatacaattctgcaatatcaaaatttagcttgggacttcttaaatgactgtaccaaggaattctaccatactccgtgcaaatatagttgatcctacggagcccacccaaaggttcagaccggaatgtaggaagtggtgatatttatttatttgtttctatgaaaagaaatatgacatctacgattcatagcggtaagttgcaagtaatattgcgcataacaaatatttattaataagaaatggcattgttaaaaaggctagcttagaatttagtcctaactcttaatctacctcctacctcaatgtcgcctcttcatccagctctatcaacaggccccttctctcataatacaaaggttttttcctactagagaactatagtataaagatctaaagtggctcttagattttcttttgtttgagagttttgtaacatttttaagcagtatcatgagttttagtatgaaaatattgtaacatgtttgatgcttgtataagttggtttttataaaagttgaatatgctcggtctttgattaaaccaagctcgagcctgtctgacctcaaagatcaactcaagctcgactcagctcaattcaaatctataatctatatcgtgcttgagcctacgtatgtagataagcttgttgctattagacaaccctcaccgagaactagactctaaaataaataacttttgatatgtttcctattggcacctttgttagggaggccaaattccttctttgctgtaactttatcgagtttgctgtaactaactgttcttatgggtgtaacttaggccttgtttgtttcagcttaagattattgaaatctagattattaaatcagatttctctaaactagattatattaagctgacataaaataagctacgagttgtttgtttctctggattattagaggcatctaagggtagtgggtctttagacactcaataatctggaaaaagctcctctagaggagattattggattatagtaatctggcttatagattgtaataatctagcataataatctacttgtttgtttcagcttacttctaataatctagattataataattctaagctgaatcaaacagggcctaagtagctcgtgaacttgctcactttggtgtgaaccttgatccggctagtgtgatgctgtgactggacttggttccaatttgtgttacctcattggtggctggcgatctcgccatggtctaggttaatggaatcactaacatttttttaataaaaaattagcagtgctatacgtatttaaataatcataacaaaactttaatttgcaaataaagatatcaaaaccgcttaatttagatcgtggtggctcttgtggtccaatggtccctagaccaaactcaattttggcctagaaggaccccctcccctaaatccatgtcaaagtcactctataggcatggtctattgatttttttacactgtattttttaatatttgcactcaaatgtgagttttagggatttgtaataccatgagatactttgagcaaatttggcttatgtgtattgaatttatgatgttatagaagtttagagcatggagtaggatcatctaacgaaaaattgctatagccgccactgaatttagtaaattagttgtcacataagcataaaaacatttttttctagagacatatcaatttgcaagaaatatgttttactttaagaaagcctaaaagcatacagagtcttatacatcgtaaaacatttacacgtgaaaaagaaaacatttcgtaagaaaaagtttagtgtatcatttttccatcagtgacttcacgagaaagagccgaagcatgagttgtttaagatagcgtttgattaagcaagacgggtgagaaattttatcctatttagtataggcttctcgaattgttaaatagggtggtttttttaaaaaatatatagaaaaattagtctattattttaagtttaaaataattaatacttaattattatatgctaatagtttatctttattttacatatactctcattcttcttaaaataaaatatcctataaaaacgggctagaactagtgtagatatatgaaatacattcttaccaaatcttaagtcaaaactcaaattaatttgtaagaaataaatggcaaatttaatggtaacagtgtcatcacccgaaaattgtcttttttttactcgcaaataaaattgagtttctatttggtttggtgagaatgcatttcatatctaacacatatctttatagtaatttgctcataaatttataaaatttgtatgatgttcacgagtttcaacagtgaattcgttttcaccggaaatgttcttcttaaatccactccacacacacagccttattatacttgtgtgagaggataatcggacggcggatgctcaacccatcgtctccaccccacacttcaatcgcgataacccccgcgacgcccagcaagccaaaaccacaaacaccatacgcgcgcggacgcggaggccgcggagctctcagccatggaggcggccgcactcctatcccccaccgccacctctcgctcccctctccccctcctctccaccgcgcccgccgcccaccgcctccacgttctcctgcctctctccggccgccgccgccgcctgtgcctccgctcctctcctcgaccccgcggtaactcactcctcactgctgttcgaatccgcggaccgcgggcttctgaggcggtgcagaatttgatgcgtgatgctgcgctgcagggtcgttgggctgtgcgggagattgcgtcgtgaggagtatgggttcgtctcgtgagcgcggggtgctcgtgaagaccagcagctcatcaggtttagtaatttataatccctttagtctgattgatgattagtacttcttccgttttatattataactcgtttgacttttttcctagtcaaatttcttcaaatttgaccggatttatagaaaaatatattactattttcaacacaagaaacatattatcaaaatatatgcaatgtgagatttaatgaaactaatttgatattttaaatgttgctagctttttctataaaattagtacttaatagtaaaaaagtcaaacgacttttaatatgaaacggatggatggagtagtaagtttctgcttggtatgtatggttcggtttgtaattgtggtgaaattgaatgtaatccacagcctcagtcgaatcggcaacccaggaggtgggcgcagcgagttcgggggagtggagcggggacgccatacgccgacgtttccttgatttctatgctgcccgtggccacaagatccttcctagctcgtcgcttgtgccagatgaccccaccgtgttcctcactatcgccgggatgcttcagttcaagcctatattccttggcaaggtgattctcataagatacatattgcattcagtagtgcaaactgcacatttttgaaaagtgacccgtaaggtcatcactaagcgtttttaataagaacattggggaaaaaaggggatcattgcacacattgagctagcatttacaagacgttgaagtgcacatgagttttccacttgcgggaagcaaaagctacgcaagtgacaagtcttgtggcatgatctttgcacgatctcagaatcagaaacaaatttgcgaaatgacaacagtaagaggggctaatagtacgtagcaagtgaattaacatgggtgtctatatgtactaatgtgaatactaactttaatatttcagttaataagtgaagttctttagttgtccaatgttcattggtaatcttgatgcttatgtggaagaatccgttatcgaatataatcgttggctcgataatggtagtaaatagtaacacaatgagtattgctttgttctttatagatcatgtcacagcaaactatgttgcaacatgcatctgtttcttgtaacttcgttctgaagtccttatattgctattcctaggaacctaggcgtgtaccgtgtgctactacctcccagaaatgcatacggacaaatgacattgaaaatgtggggcgtacgagccggcatcaaaccttctttgagatgcttgggaacttcagctttggtgattacttcaagaaggaagcaatcacatgggcatgggagctaacaaccaaggagtatgaacaatttccttactccctatggagcatgatctctgtattggtaaatcttaagctgttcatctgaaaagtttgccatgtcaccatgaatattacattcatgcacacatgcctctaagtccactctcaagaaaaaaagggggaaaaacttccggacatttagggttgttcaaatgcttatgtcgatccccagagtattgaacagctcttctttcatctgaaattttatactttgtttgtacccattaatgctattaaaaatttagattatttgaggattatcagtattcctgcaattgtctttgatttctttgtcaatgctaatgacttgcatattgactttatctttccaaccatcagcatgctgttttagtgtatactactttactaggcttgatattcttgcatgcttttgttgctttaattctgcagctttcattttttgttatttatttaggtttgggttacccccagaaagactatggattagtgtatttcaagatgatgatgaagcattttccatttggcacaatgaggtcagttatcaaaaacctgcatgtttctgcaatcttgaagagctttgtttatttttggtttacacaacaatggaacatttattacattttagctgcatctcagagttactcttcatggttagctagaccatacaatatgcttactcactagcaaaataattatggtcaagaaaaacttatttctttaataacttattaatagtaaaagtatatagatctgatgttattgtacatcagttatttacagtgtcaaaatatgcttattctgttcaagaggtgatgggattgtatatggaaatatattgactgacacataaacacattgtcttaaaataatgttctgtgcctgactaagtacttcataagcttgtagtatgggtgagtgattttatatctatttattttatcaaggttggagtaccaaaggagcgaataaagagattgggcgaggatgataacttttggactagtggtgcaactggaccctgtggcccatgttctgaaatttactatgatttctatcctgagagaggatcctcagatgcggtatgtaaagactgtggtattactagttaagaaattcaaagcgccttttccattgtgtatgcaagatattcaccattaactgaaactagtgatatacatatagttgtatgcaggatttgggtgatgatagtcgattcatcgaattctacaatcttgtcttcatgcaatacaacaaaaaggatgacggatctcttgaaccattgaaacaaaagaacattgatacagggatgggccttgagcgtatggcacgtattcttcaaaaggtattgcctaccatctatttcttaaaacaaatgaatgtcatccttactaggtttaagctactctcttactcaattgtctatcataggttccaaacaactatgagacagacttgattttcccaattattgaaaaggcagcaagcatggcattagtgtcgtacaccacagctgatgatgctatgaagacaaatcttaaagtatgctattcaggaccttttactagtttcatcataaataaggaggttacccataacctttgctctttctttttctgttattccagataattggggatcacatgagagcagttgtttatctcatatcagatggagtcattccctcaaatattgggagaggatatgttgtccgaaggcttataagaagagtagttcgaactggtagactgataggtataagaggtgatgggcatggaaattcagaaggtgcctttttaccttcactagctgaggtagcaatcagtcttagcactgagatagatccggatgttgaatctagaaggaaatcaattcttggagaacttcaaagggaagaactgcgatttgtgcagactttggaaagaggtgaaaaattattggacgaacttctggatgaggcattatcaagtgctggtaataatggtggtaaaccttgtctatctggaaaagatgttttccttttgtatgatacatatggttttccagtagagattacagctgaaatatcaggtgaacgaggtgtaattgttgacatgaagggatttgatatggaaatggaaaaccaaaggaaacaatctcaggctgctcataatgtagttaaactttctgtaggaaatgagactgagattgtcaagagtatccccgatactgaatttctggggtacgactctctttctgccactgctgttgttaaaggtcttttagttaatggaaactcagtgaatgtagtttcagaaggttctgatgtagaaatatttttagatcggacaccattttatgctgaatcaggtggtcaagtgggagataatggtttcttgtatgtctatggagaagaagatgcaaaacagaaggcagtcatagaaatcaatgacgtccaaaaatccctggggaatatctttgttcacaaaggcacaattaaacaggggtccgtagaagttgggaaggaaatcgatgctgctgttgatgcaaaattgaggcagggggctaaggtatgaaattgtggaggcatcggattgttttttctggttgacatttttttttttgttttcaagattcaatgataatttgttttatttggattcacattaacttagcttatgtatttatttacctgacgaggtttctcgagattctgaaaaatctatctgatcagactactttaaagagcaaaataggaacatttgcaatagctaatttcttgtgttccatgactaattacagcttagattgttggcatttgaaacatgcaaatgtggttagaatataggttcataggctttattgcttccattatcttggttcttactttcatatgctatctttgttttgtactaggcccatcatactgcaacacatctcctacaatctgctcttaaaagtatcattggttcagaaacatcacaggcaggatcccttgtggcatttgaccgtctccgatttgacttcaatttccaccgccccctttctgaagaggaattgatgaaaattgaatcacttgtaaaccaatgggttagcagtgctactcatcttgagacaaaagtgatggatctgcaagatgcaaaaaatgctggtgcaattgcaatgtttggagagaaatatggcgagcaggttagtctgtatatatagatgtttttttcttcaaaaatagttagtgccctggcctctggaaattagtatgttgcagtgacatgcctgagtagggaagtgccaagtcatgaaagtttgtgcagatgaaattccgaacttgaaggagcatagaacaatgaaaatgcatgttataccatagtagcatagccaatagtttaacctcaataagactttttttttgttctgataggtcagagttgtagaggtccctggggtgtctatggaactctgtggtggaactcatgtgagtaacaccgctgagatccgtggtttcaagattatctcagagcagggaatagcttctggagtcagaaggattgaggctgttgcaggtgatgcatttgttgagtatgtttgtgcccgtgacaactatatgcggtgcttgtgctcatcccttaaggtatgatggtgctcatgctgttgcccttctgatttgtcttgtgtttgtttgtaagtttggttgctatactttgtgaatctatgatcgtttacttctttgccccatgttcaaatagacaaacatgcatgcttctaactactgctaatcataggcacatgtgttcagatacagcatgttggcaacaaattttactctgtaacttgattatagacatcatgttaatcacaagcaaaatgccaacagcatgctcatcctgtcatccatgcctaggatgatcaattcttgcaacaacaaactatgctgattatgtcttccatttgtgtttttcaattgatgtccatctactcaaaataactttgcaggtcaaggctgaagatgtgaatggcagagtagaaacaattcttgaagagctaagaacaaccagaaacgaagtatcatctctacgcagcaaaatcgcggtgctcaaagcagcatccctcgcaaataaagctacaactatcgataacacgaggtatgacgcctccgctttcgccattttcacatccagtcttcatgatcatcacttgctagttgctactagaaaaccaataacatttggcagttgacaatttgacataagcaacaaatccatcccaaaaat

SEQ ID NO: 60997 - DNA, 16677 bp, Oryza sativa
tcacagtggcagtaacattgttcgtcaaccaagaataggaaattgttgtttgggatttttttctgcccggttgcgtacgtactttgcagaaaaccagcttgtaccatttgtaactaccccgtcccaaaaaaaactcaacagagcaagtttaataatatagtccactactagctataaatcatctatatacaatgtaatagtcaattcatactatagttacttaatatactattaatacatggtcctatctatcatatacatattacgtcttggagttcgtgctacagctggctacagatttgtagcccgctgctcttctctctcttcctttatctctttaaaatatatttatagctggcttatagcccgctattgcaccttctcttataggtttgagttttttttttagatggagggagtagtgacaaattaatgttactatggcccttatcagcgcagcttctggctagcttttggaagaagaacgagaaagaatgcaaatctctcttttttttttctcaaatatgcatgggagctgctgaggaggggtgttcaagacgcaattacaaataacagagaaaacaaaggtcaaaaagcaaacacacaaaaaacaaacagaatacaacgaacaaagcatcccaagaagacccttgtaatgttctactccctccgtcccataaaaaactaatctagactgtgtttagttccacgtcaaaattgaaagtttgaagaaattggaatgatatgacggaaaagttggaagtttgtgtgtgtaggaaagttcgatgtgacggaatagttagaagtttgaagaaaaaagttggaatctaaacagggccctagtactggatgtgacacattctagtaatacaaatatggacacatctctgtccagattcattgtactagaatatgtcacattcagtcctagattcatttttttgaatggagggagtaactctcacttaggttgtgctttttttgttgggaaccctcccttcgcacgtaaacggagcgatggattaacgcataattaagtaagtattagctataaaatattgaaaatagattactatgtttttttaaagcaactttcctatagaaactttttttaaaaaacacactgtttaacagtttgaaaaatgaacacgcgaaaaacaagagaagtgagttgagaacttaggctaagccttagccgggatcagtaatcagtgaaagtcccttgggccttggccttggccaatctccaaagacatgcaagaaccaagcaagctgaaatacttagggaagcctcgaaggcaaatttcttgaagggctggtttctccaataggcttctaaaaaaaaggtcatttgtgaagattatgatgttttcattaaactcttgttagatatagtagtgagcacatatggttgtgaactcattcacaaagacttaagtctcacctttctttcagcatgtgtgagacaaaataagtatttatctctctctattttttattatttctttcccgacaatatttttttataaaaaaagttgacacttcttaatcaaccttattccgcttcctcgccctgcttgagctctactatcgttgtcaccactgtcatcttaagctcctccatggcatacctctagatcccaatcatgatattggtatccatgttgtggccgccttcaccttgaggtcttggtcgctactatctctactttgagctatggctatcgttgttgccttgagctcatgagtagtgccatgttgaagttgtagtcattatcaccgtctcgagctcatcattgtggttgccattactgcatgaagctcctcccttttaccaactatacatcctagttgctattttcatcgagccacctctaggagcttgttgccaccatgttttgttggactatctccaagagggatgaggctcccctgacgttgtacggtttgcagttgtgctactgatatgtgggcccacatattagtgactcatctgcaaactgcacaacatcagaggatctatttccctccaagagctagccgttgctaattctactccaacaccacatcaccacctccttctacggtttctattcacaccattgattgtggatttgcacattgattcctaagcaaatggaaaagataaaggatgctatatgtagttgttgatatggttttacacttcaataactagactgttaaacaaaccagataatataaatagtagcttcttttggaatctaggtaaacatgataggacaatgtaggactaatttagactataataatttcataagaaaacaaaactatcaatttcccgcaagaatggagaaaaatttcccatgttctaaacaagtctaataagcatgtacaactgctatttatttatctcgttccactcccttggcctgcttatgagctcctagtcatcgtatctctacattgagctatagccacaatcaacattgccaccttaagctcgttgatggcaccatagcatccacctaagctttggtcactatcatcgttcctatctttagcttcttgacaacaccacctctaggtatcaatattgtcacggcctcaatctctgttgtagctacctccactttgagcttataagcgctaccgtccaattccagatcctaatcattatccatgccttgagtagccacatctctagatcaaactcctccattgctcctctagagtctagatcctagttgagttctcgttatccacttctcgaagttcgttgcaacatggtcagttggtcatcaaaatgcctccaagtgctttccattgcttcctctgccacaatgccacctccctatgtggattccattgcctaaagatttgatcacattgattgttgatttgggcgttaattgatattgatattatatgtagctattgatattgtttcacgtttcgatggctagtgtactaataaataatcagattctaagaaaaatatcttatccataataccattcaaattgcactatataaaactaatttagagctttacaatacaaaagttacgtaaaactaccgttccgaaccgataaattttcctgcgttctaaataggtcttaaaaaaaggagtttaaagaaaaaaatataacaataaaccaacacgaaatttggctacgatttacggtcaattactagttaccattccttgcaattttcaccagctagcggtactcccaaattcccccccatttcgcgctcggctccgttgcgcccgcgctccaaaaatcccgaaccggtggcgcgtactacccaacgacccgcaccacacctatcacaccgacacgcgggccccatccgtcaccaaccgacaccgacccgagccgcacccgcgcgcgggggacggacggaagcgttttgaaaaacatcgccgccgcccgcgcgccgccaccaaaaaaaggaaaaaaaaatcgcgcataaatcatttccccccccccccctccacaaccaaatctctcctcccgctcgccgaaaccctcgccgtcgccgcgccatggccgccgccgccgatgctcccccgcctcctccggaggtcgccccgcccgcgcccgcgcccgcccccgcgccggcgccatatcagccgccgcggctggcggtggccgacggagcgggaggtggcggcggcggcggcgggaagccgtgcaggcaccacgcgtacagccgcaagcagaagtcgctcggcctcctctgcaccaagtaaacagctaacaaccctccccctcccctccgcgcagcttcgcgcaaccgctatagctttctcgaggttgatttggctggccctccctggtgtgtttggtttgctagcttcgtggcgctgtacgaccgggaggacgtggagtcggtggggctggacgacgcggcgaggcggctgggcgtcgagaggcgccggatctacgacatcgtcaacgtgctcgagagcatcggggtcaggaaaattttttcatctcctcgcctcgtctccctttcttggatttgaggagcgatcttgttctgcgttcgctaaacatttcttggccggtcgtgcgcagatgctcgtgaggagggccaagaatcggtatacgtggatcggcttcggtggagtccctgcggcgctcgcgaaactcaaggttaggaggatccgcatattctgttcttaccatagtgtcattgtatgctttgtgaggcgtaatcagatcggaatttcgatgtatttattgaattttctgttgtttcggtttggtcaggagatgtcactgagggcggtgtcaagcgtggcgtcaccgtcgctggatgaaacatctgctgctaatgttagatttattctctcctctttgctagctcttggtattgttacaaatcgacgaaatgattagcacttgtactgacaaaagtggcacattttgggttttgtgaattatgattataaaaggtctcggatgatgaggatgatgacaagttagatgatgctgagggcgatgcggagagcgagaagctcagcctcagccagtccattgacaatccttctgataagcctgatgcacccccttgcaagcttcgatccggtatagttggttaatcgcttttcttgctatctcaccgtgcctgttggaacacatggtttgtactgactggttgttgtattagcagagcataggaaggagaagtcccttgggctgctcactcagaattttgtcaagctcttcctcaccatggaggtaagcagcactggatttgttcctcaactgtttgattaagttggatgtcctttgtggttaattttagcggaatttgtatttgattcagattgagacgatctcacttgatgaagccgcaaagcggctccttggagagggacatgcggcgaacaatatgagaagtaattgttcacatttcctatttataattccaaactgacagtagtttttactatccaactggaactcacaatgattctgatgttcttgatacagccaaagttcggcgattgtacgatattgccaatgtgctgtcttctttgaatcttattgagaaggtataccctcaaaccgcattcgatttcagttgaacctaagtgattttttcttaacttggtatcttctgctgcttctttcagacacaacaggcggactcaagaaaacctgcattccggtggctgggccaggcaaaacggaatgaaggcgtcacggttgctttacccccaaccaagacgttgcctaacaagagagcatttggtactgatctgactaacattgacaataagaggggtaagttggactccacaatggagaacagaggcaagcccacgcaggatggtggcaacctattcaataatttgcagaggcaattagggcaagagaacaggagcgattttgtttatggccccttccaccctgctgttgcaaggaaacaagaacatggtaatcgcacagtacaagagaaggagaggaagagcattcaagactgggagaaccttgcttcttctttccgtccgcaatatcaaaatccaggtgagctccaactctctctatatatctatatcgccaaacgaatgctgtttcaagaacccattttgcattagctattagtccatctgtctagctagcatttttggttgctctctacataccatgtgatatgtcagtgctacacaaacgtcaagaagcaaatgaaacctggaaattactgagtgctcgtggattgttgtgaacaattgaagggcttcttaggttcatacatgtgtcatcagttacaagtttaaccccttcaacccttagttgatatacacttgtagggtagagctcctttacctgtgccttgcgcatctgctttactcaacacatcgtttcctctagttcacttgtttgccagcatacattctgtatttgaattccttgaaatcaaatcaaaacatcaaagactggtggatagaagaccatgtaccgacgtttaatagtagttctgaacattttgtatatggcatgttgataagtttagtatcattcggtcttctcaagtagttcaccttctgctagtgatctatcttctattatctatctatctatctattatatactaaaagtccattaaacttcctacaaacgctctcaagccgccacgtggcgttcctacaaacactcctaaaccgccacgtggcaatgtctaatcgcaccgtcgattttcacttaaatcggtggacccgataatttagaccattagattagattagatgtattttatttaataaaaggaaatgaataccatactgttggccggaaaaaaaacaaaagcataattactccttaaatacgtacgactacaaaaacaatcaagcttacataatgttcatcgaagaaaaaaaagacctacgcacagacttacttaaaaaaaaagccaaaagcaacataagtacatagtaccattgaaaaaatataaaaacaacaaagccaaaaaaaatatacgtacgtaataccattgaaaaaaaaaattgatgacctttaaaatataattttctattatttaaagataaaatatatcactctataaatttaagcaaatattatagttaattttcacttaaattagtgaacccaatagtttagaccgttagattagatgtattttattaaactaataccttattactctgtgtatgggagaattatataactattggctagaaaaagacaaaagaaaaaacataagtagcctttctacaaatgctactaaatcgacatgtggcatcctataaacgctcctaagccgccacgtggcactctaatagttaaagatttttttttaaaaaagcaaaacatctaaccgttaattttcattaaatttggtggacccattatttgtaacctttagatttatctataaaaaaaatctccttctaatatctgggcccacctgggcctgttggcatgtacgtacctacatagtacctacatacgtatgtttcttacgtctactccccctccctcttttttacctatttcttttcctactttcacgcttttagaaaagcaaaaattctatgttaaacaattaagcaaatgtaacatctaaatcataaaactaatatttgatctgcttatgtcttttgattattttacatttaaaaactcatatccactttaattcaattttgagaagaaatatgtaacattaattaggggtacatcttctgacttttgcatgccacttaagaaattatacaattataaaaaataatgatatatattttatcatcgtacaaaacttcataaaaaataatagatataatataagtaaaatgaacataactttgggtaatattaaaaagaattagacccccattctaacacaacaaaaagtcaaaataacagttagattattagatttgtagtgtgctccttacaaaaaaaattatttgcagtgttcatattttaatatcaactatgaatatattgtaggtacagacgagtaaaaaagattgattttaatcaatcattaaagcttttgttttatttttagttaataaagtaatagcagctaaaacactataactgataataattattataattatatgcatacatactctctccccttcgactatctcttcctctctcccattcaattatttggtcttctaaattttaactgattaatcaaaatgattaataattagaaaactaaataattaaattttttaagttatatctaacccacttttagtttacttgaatttgtttttttataattaaatatataattcaagatctgtattacccatattttatgctattaaaataaaagtttgtcattttaacatatacccctatcctttacaagtacctaaatagaaaaaatatcagaacattataaaatataataataagtattatataaccttaaatcattgtatatcctctgcaatgcacttaagatgtcatgtgttacatcttaaataaaaataaaaactagaaattataggaaaaaaacatctgactatcagttttcacttaaataggtggatccattattttaaaacaattgatatacttttagaacaatcctatccctccatgtgttagtcggatattagaaattatgagaaaaaaatggatcatcggtttcacttcaattattttaaaaaggaaaaagtatgaattacaccaccgaactatcgcgatcgaccaaattaaacccctaaacccaaaaaccaaacatcactcaccctgacctttcaatactttacaaattaccccctcgacccaatccagagcaattttgtcctacatggcgtacgcatgacaatccagtcaatattttctttttttaatggtgggcccaccagtcatatatactttctcacctcctctttcccctcgtcccccctctctctccatctctctcggtgcacatggcggcgcgtggcgcgcggtcggtcggcggcaacgcacggcccatgtttaagtgcttagatgttaatgaccttccatctatgctatatcatggcattacgagtttctcaatatattattacatatataaaacacatagttggataaaaacttatatatgctactattaactttaaatttaggactcatgttgactaggtatttttttagaaaaaacactgtagatcacatatagtaatagggaagcgagctgtacaatatgtatatctcctacatacttattgacacggttttttttctagaaaatgaagaattagtgataatcgcttatagtaataaagtaaatattatatagttcaaaccttacaaatatcatgtaaaaaaattatatgagcaatgcagatgaagaaaatttataaagaaattgtactttttcaagtacgaaatgtgtctcgatatccatcttacaagttagtcaaacctatcctactttgcatgcctgcgcaatgcgcgggctatcttcctagttctattaaatgtactgttaaagagaaggttctgttgtaacaaacttaacataatttcttccattttctaatgcaggactgaacgatctttttggccactacatggaagcatggaggtcatggtactcggatctcaggcgagacagagcatcataaaaccagattcaggccggtccgttgtaaacaaaattcttgtaggcagataaactcatttgttgatgcatggttagggatttttgagttatacaagatgtcacaaaaacaaaggctagtgctggcctttgattgattgtatttactcagtgcaagaaattggaaagtcgtttcgtcaataatactaggatacctgattgtcgatttgtttaacgagtcacctgctgctggcaacgcattctttgaatttgttccctcttttcttttcgtcgttccctttgtgatcaggtgtcaggaccgggcgctccaattaatagactgttaattcgttaacagaaaagagaatcagactaaggttagaaacttcttttatgcatgtaaacgagatgacttaggtggtgtttaggaaggcacgaaagcataagtcccttccatagagactaaaatttttatgagtttagtccctcctttccaaacaccaccttattactttcttggatgagaatgtaagtattttttatataggcatgggtacttaaaaaaaaaaaggtagatagagataattagagaatgattgcgattggagattggagaagaaaatgtaagtgaagagaataattgtgatttgtttagaagaaatgatatgtggagaaatagctttattttagaacagattagtgtgctacaaagagttactttttttagtggaaactattagcaaaatttattcaactaggatatccagcttagtcatccgtcaaacagaaaaaaaaaagtttcggaggaacctaaaccaaagtcgtaaagcaccttctttagctagcctatgagcaactttatttgttgaccgccaaatagttacattttgcgatgtaggtagtagcacataattaattaattattattttaaaaacttcaaaataaatcaatacaattttaaagaaaaaagtattttttttaaaaaaaaacacaccgtttaaaaattgtgcccatgaagaaaaagggagtagaagttgacaacacgtactaagcttcccagcaagagtcagctggaatgcggtcaatgtgacaggaccataaataaagaggttacataattgcatttgtgttttctgctgaaattgttttccatgtcgataatatatacaatgtatatttctttccatgtagcaaaattcggtgcaaccaatcggcatcagcagtgcaaaggcagttcattccccttgttcctgactataccatcatgtaggtacagtaatttcacatgatatagacaatgagtatagagaatcaagcagggtaatgtaacactcatcaatcatcagacaaatagtattagaacatttgactagtcattgaccacaaacacatatggtaacttccaacaagaggcatttgatgtcctccgatttatggatgagacaacatatgtaatgcttgaaatgggtaaaatccattaaatcaatccgcaatagtaactaatagcagagcaatcaacaaccaactaaattccttcatcattttgttggctcagtgaagaacttgttgatagctggcatgatctcaggggtcttgtcgcgcacatagtttcttagcccatgctctgcgtagcgccttccctcctcatggttctcgagcactccagctgccctccctaccttgttaaccctgaataaaagcattttattatttcaggcttacacttcattgttgacaaaataagcatcagccgccgagggttcgaattatcaccataatcaatgttacccttgaaacccaagggtttaattatccatcaaaattcactatataagacaatggttaatacactacgacttcctgtctatgacacaataagatttaagcactaataaatcctgcttggtttaaactggaattgaattatgcttggagccggtttggagcagcgaaagattaacaccaacatgtcatgagttgaacatactaataacacataagctcatagtgaagacagattccacacacacgccgacacgaaatacattgtgtctagccatgttagcaactctttggtctatgctatcatgcccaagacgcatagaaatttacaatatacttatcatcataatcaccacgctttctgtaaaagacattcttaacgtcatgacaccgtaccaactactccacctctataaaacaaacaagaaaaaaaatatgtaaagagtacattttcccaagcaaattgacacatggcaagctcatccttatgtttctctaccagctcaggtacaggtttcttaaattgtctaataacaaaccctaattaaacaaaaaaaaaaggacacatcacacatgatatacccactccttggctccttgccccgtaaaatactaaaattcaccatcacaaaatttcacctgagaaatactagcatgtcaatcaatcaagcaaggtaagtcaacgctcagcgccaggtaataggctcaaatcgtaaagaaatcgatgacggtaagctacagtaagtccaccactagaacaggcttatcaagcacagtagatctctcctccaacgagcaaagcaaaaaataaaaataaataaaaataaaaaatcaagcaagcaagcaagcaaagagggcaggaacacgcagtggcggagatccggacctgacttcggggttgccggtgatgttgcggaagagctggaagccgcagatgccgacggccacgcccatcgccgcgaacagcgggtacacctgagacacgcgcgcctccgggtgagcgagcgagcagctaagcgcaaagagcaagaagagaggagtagacgcgtgtgggagcttggctcacctccggtcggacccagcggctggaggccatcgtcggcgtcggcggcggcggagagagagagagaggggaaagtggaaggcgacggtaggagagagagagaggaagtggacggagtgggtgcagagcggcttttatcacagtgacgcagtgtggttcgcttggcgagtttggaggtgacctgtatggaatgacgaaaatgcccctcacccgtttcgtttgggggctttcttcctttgctgctgcggtgctgcccactgttttccatgaagctgtgagcccggtgtaccaccgtcggcgtgctatataatcaaaccaaacctacgatcaacttaatatctattgtatcttctcgctttaaatttcaattcaactcaccttttatggatctaccgcatgtaattgaatccagctatcataatagatgtgtaaaataccttggtatagtggaatatgcttgtggttgcagaggaatgctccggtgcaatctacttgcagtattctactccaagtagaattgatctcgaccgtttattttaaagggcaggtaagtaatctcctaatattgtttaggggtaattttggcatggattattttcttctgttcgatcgcatcaggtcggactccgcatcgcatcgcatcaggtccgactccgttgcacgcagtctcgtcgctattcctcccccggcgtcgccgccttgtccaccccctccgtcgccgtccgtatcccccgtcctctcagtcgccgccttgtccgcctcctcagtcgccgtctgcctcccccgccctcgctgccttctccgctccctccgtccccgtacgtttcccctgccctctccgtcgccgtccgttggccccgccctctccacctccggcaccgttggcgtctcctcccccttcagtgcccttgcctcctccgtcgtcttcctaccgcgcgtggcatcaggtcggaggcaggcaccggcaggcggcggcgcggccggcagctagtcctcccggcaagcggcgtcgcggccggtggcgcggcgcgtcgcatctgtccgacgcaagcaccggcaagcggcggcgcggtgaaatcctcaggtgtccactcctcccccctcccccaccacctgactttctgttccccttcctctcctcagtgttgaacttgtctgaatttttcctctacaaatacatatacttacttgtaaatgactgtgtatactagcttgtaactatactagagaatctacatttgcggatgttaaattgaataggagatttattaaatcgattttgtatgttgagttgtaagcatgaacgataaacctgaacaataattttggtcttaagctgcaaatgaaatacacctgtcacttgaaattccactcaaaacagtttgctgaaattgatgtgttactaatataagtccagcattaaacctcagcaaaggtggcaagttaaatcatatcttgtgcaattgatctttgatcttttctaccaaatgattgccttgtcaactggttaaagcatccagcattttctgctagttcatcagtagtactaatagtacattgaattaatttattagtgcatgccttagttcttttatcatacatacaaaatttgcagccattgtgggggaactgtagtaattgttctaaactcaatagtttagagtggcattgtgagatggatactcttttatagcagattaaacatgtcttcctgaatttggccatctctgcatctgcattacactctgaaactgaggcacttaatttattttagatgtgtacagaggcaaataagctgaaatgctttagaactataaaagaattctttgtcagaaacattacagaaatacggtattgagcttgatttaatccattttcagaaaattacagaattgagctgcctcctgtgtcctaacttgacttgttgctgcttggtttctgaaaataggtcctggatgatgatcatggagctgtggtttaccctgtcaggaggtcagtagctcctcctgcagttcagcgttggggcgacatccctgggcagcataactgcggcgcacctggttgccctgagatgattccggcgcaagcacagttctgttgtttgcgttgcaaggctgcagttcattgctgcttatttatttttaaaggagtgtaatgaacaaataaatttagttgcctttttaaatattaggattaaatgatctacaactggaatggtgacttcattttgtgatgcttgtgtgatgctttaatggtgctgtttgctggaatgatgctattgttgatgctggaatgatactgctactattggaaattgtgctgctgctagaactgcactgttgttgctggaatgaaactgaattgctgttgttggaatgaaactgaactgctggtgctgctgaaactgtaatgctgctgctgctgctgctgctgaaactggttgttttttcatgcagagcctaccagatcaatgagaatgcacatgctgctggaggactcattctgtccatatttttctagttccaacttcgaattgcgacagctctattcggagtctcgaagccaccaaaaaggattggtggtgggagatttggcatcctcagccatcagatctccagaagatgctgattcaggagcgaagcaaaccataggaacagtttcagggggaacatgtcgtccccaagaaagaatgatactgacacatcattttgttctccgtagcatccgattttgatacaacattaacttacacatttgacagtttgacaggatgtaagatgttgcattgagcagcttctttacgaaagattttgcagtgcagaagcacaaaggtgcttcgtcgtggtacgagatgtttctttaaactcgcagaaagtacttatcataaaaaaagcatggtttttcaatcgaccgcgcgcatatattatagcagaacgttattttttttacaaaagaaagaagaagtccccgcatctgacatcgttgaataaccagattgagtatcatttaataaataatagatagagtttaatattaaaaaatttaacacctagcttattcgaaatgaacatctgacaagacaaactaagaatctccaaaataaaacatctcaatgataaatgaacatcttagaatttaatgaaagaatatcctcccaatgcaaagctgaacatcttagatttacttcggagatggcctgtgcatgattccgaaatttgttgggatggagagatgtaaagaatcgctgctagctttcttctgtattcatcgatgtcttcctgcatagatcacaactatatgttatctttcttattttctacaaatgtccttctgtcataatcaaactttttgtttgctatgatgggcctaccatccagtccgcgtactcatatttcatatttgtatccatttgagaaggagcggtatatgaaaccttacgcttcggggtgactcagggcagtaagcagtcaacgtcaccgacgtgcatctgcttcaacgtcgcacctgaacaccgagaacccctttgccggcatgtggttcagagtaagtaagtaaaaatgctgttaacattaaccgttctgttctgaaataaacaatgtatttacttaaccaaaacgagcaatataattggtgaaaaggcaaccaaagttcaaaggaaagagacaccacacatcatctactcgtcattaattgatggtggcataacaatgccaatgcaaatatagccactagtaacatccacccattacaaagcccccacaacaggtgaacattagtttcattcagaaagatgacaactttagacatcataattcaatagcacaacattgcgcgccaaatccaattggtacgacgaagcagccacacgtaccttccaagatggcttcgcgcacttgctcttgctccttgcaaataccgaatgctcccaccagcatcccaatgccatggcacctcggagcacccagtaagcatgcctctctcgggatcgccaacgccatggtggagttgttcagatatagatggatcatctcatccttcatgctacagattaataggaaacagtagccttggaaatcaaatcaaaatttaagaaaaacaaacaacttgagattgaaagttgaggggcagcattaggggagcgcatcttactgcaaatttccgggcattaccttccgctattctccaatggcgagtcttcctcctgctccgaaggaggtgcttgaggcagcatggggacgaaggggagccaggcgtgcattgccattggatccagaggctgcgtcctccgcttgtgggcgatggattgggggctctcccacgcggctgcaggagcgatggcgggcggagatggacggggctagagccgagcgtgggggaggaggccgacggcgagtaaggggatagcgaggaggaggaaggctcggcggcggcgagtggcacggtgctggggtctgaggtggaactcgccacaaggtgtgccgacgcgggtagcggcgggatagggcggagctctggagatcccagacggagatgcgggatcgccgagaggagtggagaagggggaggcggttgatggggaggaggacgtggcggcggtggcgggtggaggtgacgcggcggagagggctggtggcgaagagaacgtggcggcagtgacgggtggaggcgcgacgacgtgaggcgactcgctggagaagagggcgggggacgaggacggcgaccgagggggctcacaaggcggcgtggagac

SEQ ID NO: 60998 - DNA, 962 bp, Oryza sativa
aggcgaacgcgaagccgagccccacaccgcgccacgcggcccgctccgccgcgcgacaccgcgacgccaccaccccatcatccgctccaccgcggcgagcaccgcgcgctgctgctgctgcgtccaaagtccaagctcccaaaccaaacctgcgcgtgcccaatcgatcggcgccatggccgcggccgtcgtcctcctccgccgcctgcgcggcgtcacggcggcgccccggcgcgcggcggcggcgctgcccctgaccacgagcgtccggggtgtctccgattcgacggagccgctcaccatcgagacctcggtcccctacaagtcccacatcgtggacccgcccccgcgcgaggtggccaccacggcgcgcgagctcgccaccttcttccgcgacatgtccgccatgcgccgcgcggagatcgcggcggactcgctgtacaaggcgaagctgatccgcggcttctgccacctctacgacggacaggaggccgtcgcggtgggcatggaggcggccaccacccgcgccgacgccatcatcacggcctaccgcgaccactgcgcctacctcgcccgcggcggcgacctcgccgccctcttcgccgagctcatgggccgccgcggcgggtgctccagggggaaaggcgggtcgatgcacctgtacaagaaggacgccaacttctatggcggccatggcatcgtgggcgcgcaggtgccgctcggatgcggcctcgcgttcgcgcagaggtacaggaaggaggccgccgtcacgttcgacctctacggcgacggcgccgccaaccaggggcagctgttcgaggcgctcaacatggcggcgctctggaagctgcccgtcgtgctcgtctgcgagaacaaccactgtgagttggaattcggttcaatctttgggattgattttgctgcattgttcgttgatcgctggatgaattgcggatggtttg

SEQ ID NO: 60999 - DNA, 10498 bp, Oryza sativa
atcagattatgagaacaagaagcaattcgtggtttctcgagtataaacgaggtatatgatgacatttgcaagaatggagggagaaccaagtcaagaaggaataggtacaatcacatattttttactatacacagtacttttttactttttagtaaaatgatctttgtagaactaacttcacttctcagagaagtaaaattatataagtaacttcaccatccattgaagcaactgcattttggttcataccttccattttttgttgtgtgcatattggttctacacacgactgagcaattttttccagacaaactttctacacacccctgtgcagtaactttacatgtcatagaaagtaacttaacatgtcactgaaagtaacttaacatgtcattgaaattaatttaacatgctacagtagttgtacaaggtatactaatttgcttatttatttttttttctttttgcttttgttaaatgtagccaaaagatcattgatacaggagaatattatatttatcttagcgatcttgcgaactctgtcaaacctatgggctcactggacaataacacatgtgaattggcattaattgttctgtctgctgatatcaaggacaattcgaagagaatttttcctgccagaataggagtgagtatataaaatttacaaaaatctctttttaatgtattattactatcattgcaacaccttatgtttttttttccacatggtgcagggatatttgttggattcgaagttggacaggaatgagctcaagaaacacttcgatcaaacgagagcgaaccgtcttgaccataaagaattagtaagaaaatatatattccagctgtcaatgacatgtaaagttactttttcctgtctgcttgtagaagtaacttaaatgtctttgcaaattaactcagcatgtctgtggaagtaactttttctgttatattgacatgaaatgttattctgaatcactttttattatccttttatacttactaaattatgattatatttactgaaaaaccttttttccactcccctccctcttttcacttgaatgcaggcattttttcccattctccaggaattgggtaatgggaatcataaggctggtcactatttcgtggtgtgccttaatctgaaagctgaaagattcgaggtttatgattcgctgaggggagaagatgacgaagcgctgatttcagcatatcatcttgttgttgcatccatcaagaccatgtgggataggttttacatgaggtcttcgaagaaaaccatccagaattacccactgattttcattgatggcccaaagcaagataacatgtacgtaacatgcttttttttagttagtgattttcatttattgtttttagtcaaacttatccctgttttgtttttgcaaacaaaaacagccgggattgtggtttttatatgctgaaatttgtggagttgtgggatggcaaacagttgccagcatttgaaccaagtgacatccccaacattaagaaactacttacacacaagatgctctcgtttcaaggaaatcgtgtgcaatggatgcaagtattatggggcaaagagcctgatcctacacttaaggtaaagtaatgaaacactgcattttttttccagaaccagcacataagttatagccacataaattaggttgggtaacaaattaaaatagcatcttggttctgcaaagaactcagcatggtcttcctgagaacttacatatcactgtgaagtaactactatggaagctaaaagtaactttaatgcaactgtgcaagtaagtttcaacaatcttgtcacaacattataagttacatctcgtagctctaattcacttctcagtactagctaggcctttcctaactgatgtctttgacgcctttgcatggaccccaggcttgcgtcttgttgaaactggtctcccttgcttttgtatgatgggggggtcatttatctgtagcgttgggttagttgatgccgaggggatatctgaaattcctcttgcaggatcagctggggctggctgtgcttttttctgtttctttctactctgcttcatagctgctaagtcatcagtcattgagctcatacgctgtagagccatacggtaggctttctcgttgcttgatgcatcttttgcaatctgtgtaaattttgtgcacagattggtatacctgattagctttagagattcagggggcaattgcatttgttcaccaatgcttgtaactggaggcaattcaggctctttaaccatcgtccatctaggcaatatgtaatgttctggaatgtcactcacttggcccacaaaatcagatgtcatcacctgcatggaaaaaaacatatgttttattacctgccaaaagtgcttaatgcataagaagtaatttaatgcacattaagaagtaacttaatgtgcagtgagaagtagcttaatgcacagtgagaagtagcttactacaataacagactgttaccttcagaacatgacagcaaagaatgccatccctttcaaacttacagcattcacagttgtatgtcctatccaacacatttgcagctacaatgaatgcccttgatccataattcctaacaggacctccattcggttctactagatacatgttttcagaagttcgggtcaatttatatgatgttgaagcaatcagctctttttgaaatctgttgaatataggccttgtgtagacctccaatgcttttgtttccatgggatagttaccccacatagaagggattgtttcttctgcttcaaactcattctgatctgttgcaacagtgattttttcttgaatcttcttgtactgcaaaaagaagttgtatatgctattttggggatttacatagcgcttcagcactgcgttaaatccctcactccgtgctgtagtctggaggaaagggaagaaacagtgcataaagtatactgggacccaacactgtctcatttcccaaaggtgtcggaagtgctcattatcttgtaaatgatatgttgtcaacattgcatcccatttagcatcaaactcttgctctgtccagctattgtcaaggcagtcattgaatgcatcacacaatgctttgtcatgatctaatatatggccaatcttcttctgagcattctgcattatatgccagtggcagttgcgatgcttagcatgtgggaaaactagcgctatagctgccttcatagctaggtcttgatcagttattatgtttgtgggctctacaccttccatagcctctagaaatgcttgaaacaaccatacaaaggtttctgtcttttcattccttagaaatccacaacccagctgaatatcaaaaataatacacataaggaagtcagtacagttttgaagcaagtaagttactacaattttgcgtagtctctacagtttgtgtttgctagaagtaaatcaatacaattttgaactatagaacaaacactaaaaatgtaacttgtaaacttagttactttttcacctttttttaaaaaaacaaatgtaacttcacattctactagaagtaacttttatcaggatttgatgtaactcaatgaatgcaacaagtaacttatgatgtactataatgtacaaagttattacagattttttagaattacttttttgcaaaaaaaaggagtacctgtattgattgcccatgtttgtttaacccaatgaatggtgcacaaggcatgttatacatgtttgtcatgtatgtgcagtcaaacgagatgcaatctttgaagtctttgtaggcatttcttgctgctccatcaacccaaaatatgttctgcaccctgtcttctttatcaagttgaatcttgtagaagaaatttgggtcatccttttttatttcctcgaagtgagcaattgtttcaggaatatctctacacctatactcgctccccaactttgacttgaaattgcttatgtcttttctagtgtagggtacattcctagcccctccatacaattcagacatcaattgcataattctaccagctgagagattaactccgtgcagcattgtgatgaaatctttttcctctttcggtattgctctatgtgaccttaggaatttcttgagtgaaaactttctaactagaggatgtgtgtgttcttcaacaaactgaattacttctcacctagctcctttcctcttcactgtcatccttgctttccaggcagcctgtcttgttctacttcttttccttttctttggggggcacacttcacccgttttttcttctggaccacatttgttgcaaacaaacattactttgtcacgttctccatctttggctgacttccttgaagtgttgattttgattgaaaatccaacgcgctttgcgtacctgttgtagtgagcccttgcttcctcctctgagttgaaagtcaaggtgaggtacggcacttgtgtgctgcacggaatatcctgtgatggcgctgactgtgcttctgaatcatctgttctagagtcttcacttgaaattgtgttggcagtagcagttgttgcgccagttgcaacactagtatgcattgtgtctccacgatctgacatttcttcaaatacttgcatctcataatcgccttcaaatatttgcatctcatcattggcttcaaatacttgcatctcatcattggctacattgtgtgcttgtaaacttccagcatcaccagcagtatacatagtttcaaagtcaaaagtgtcgtccaaatttatagcaggaatctccatgctagtgtcagtcggatttatagggaagtatgtttcacttttgtctttatcatcaactagtaaatggtgtactggaggttcattttcaccagaaactaattctgggatactgttgaggtcaaagtccatttttgctgcatgtgtttcaggctattagtaacaaagttagtttatacagagcattcattgaggtaattcagtaatttggggggggggaagaagtaacttttagtttttgcagcatgtcttttttagatgttttataggaagcaattttctcaaattaagaccagtggctatactaatgattttttttttcacaatttgttttgatgcagtacaagatgaaattgagacgcaactaggtgatgcatcatgctgtatatagaaacaaggtacaaaatttgtaactaggaaatgtagattcaagtttatagggaagtaacttccatgtttctaggaagtaactaattgaattgttacaagtaactttctgttaaaactgcactgagactgttaaaattgctatgagaacctaatgcacagtgagaagtaacttaatgcgcagtgagaagtaacttaatgtttcttggaagtaactcattgaagtgttagaagtaacttttctgttaaaaatgcactgagacttctgttaaaattgctatgagatttccaacaccagcactcatgcctatgtaattagggaatacaaattcaaatttattttgggaagtaaagtaacttttctgttcatattgcactgagaggtaactagatgggatgttttcatgctgtgtaaactgtaaactagggtttgtgaattcaagtttatatggaagtaagttgcatgttactagaaattgctctgagttttttgaaacaccaggactcatgccttctctataacttttttttctcagtagcactagaaagtgaatttggggtataaaggaagacagaaatcaagaaggaagacagaaaacaagagtacagctcattactcacaaaattacagcacagattcatatcaatttgtttctcgaagaatacagagaagatctaaaagtttctaggttagttcttttttttttgtggatggatctcaaagaagacggaatttgaacttcatgtgtactttacctagatattttttcttggattttcttctcctccttcccctcttccaagatggcgatttttttctgatttttaccgccgtggcggctgtgtgtggattgatgtcaccggatgggttggagtgagggagagaggcgcattgcgctgttttaggtggggcccacgccagctagcgaggcgttgcacggtgcttgcgcgcgcaagcgcgctctttccttttttagcgatggcgcgcgcgggggccctggtttagcgagcgcagaatcaccagatgtgcgcgtcgcgcgatagccctatcgcgatttagattatacgaattaagaaggcgtaactaggggatgtaaattcaactatatgttaaagtaactttcatgctcctaggaagtaacttactgaagtgttagaagtaagtttctgttaaaattgctctgagagcctactatggaatgtaaattcaattttatgtgaaagtaacttgcaagttcctaggaagtaatttactgaagtgttagaagtaagtttctgctaaaattgctctgagatcttcgaaacatcactactcatgccttttgctccaacttttttttcctagcagcacatacaaaggaaatttgggggtacgagggaggacattaatcaagatggaagacaggaaacaacattacaactcatttcttacaaaattgcagcacagattcatagaatatgtttcttagagaagatagaaaagatctcaaagattctaggttagtttctatggattttttggatggatctcaaaaaaaacagaggatgaacttcatgtgtacctgtgattttttttttggatctactctactttcttctcctcctccgagttgatggtttcctcctcctccccctgttcgtgctttttttctgatttttttccgccgtggcggctgcgtggggattgatgccgccggctgtccgaacttgatgggttggaggggggaaggaggcgcgcagcgctctatcctagccgggcccacgccagctataccacgcgaagcgagagccgtgcgttgcacggtgcatggtgcgcgcacgtgggctttcctttttggcagggctgcgcattcacgcggttgctttttctggcaggggcgcgcgtcgcgcgatagtcctatcgcgagactggtctcggtctagtcgcgtccattaattatgaagtacggagtagtcgatttgattaagcgggatgatttgtgtcggattcgcgacacgagcgcttagaagggagcgaaacgctttgtgcgcttgcgcaaaatgtgcagtgtttttctcgatccggagtagacatattaagggaagtgctatgatagatgtgactactatctttaaatttatctattttattcactcatgaaccaagaggcaacctatacaatgtatcacctctagttcacaaataccaaaatatctaatattctcacatctttcttgaaatttgtgtggagattgtatcttgatttaggggtggctcatcatctctcttttcacttctcttctccacctcatcacttaatccaatgtatgtgacacttttaggagcaacatatagagcattatagtacttgcccttataatcctacgaaacagtttttatccagatgcatagtaaaggatatgtttcttccgattatacgttgctatattatggaatgatggagtagcagactataagctagatatatagagaaaaaatgagagagaaaaacattagttacaaatttgtaacgagcatataaactttaaaacgatatatgtgtacgagaggtaagaccagtattgagaggtgatgctctgaatttctagcgggcatgcacgaagaatgggttacgacataccccctatgtgaaaaaaggaataaacttttaccatacataaaagataaaagttgccttttttttaagagtagtacatgccctgagatctacaagattagcgcatattttcgaagtttgaaaccaataagttaaaattttagtctaagttaagattatagtatttatatggtaaaacaagtcaaaaaaaatataacatttatatatactttttgtaaataagatgaagagtatatttcactttgtttcactttttattactggtgttttattttgaaccaaactttaaatagaccgggtaattttactttcgtggtactttactattttagactactctcgattttttttatccatttgaattcaatttaccatatgtcaaagaaacagtctacgtaaaactgcgggagtttattgacaaatagaagatggcgtacccaaaatcgttcatatgcttaagaaaagagtttgggtgattcaaaataaaacaaagataaaattatcgagtctaaactgaaaacattggtaaaatggtggtttaaattaaaacacggcaataaaaaattatctaagattaaatttatcctaagacgaatgatcaaacgtcatgtcaaactttttttagggcattgtgtactaaaacaggaagtaccaagacaactgtgtttagttcacactgaaattagaagtttggttgaaattgaaatgatgtaatggtaaagttagaagtttgtgtgtgtagaaaagttttgatgtgatggaaaagttggaagtttgaagaaaaactttggaactaagggcccctttgaatcgcaggatagaaaaaacggaggaataggaaaaacataggattcttaccggaattgaagtataaaacagaagattgcaaaacacagaaaaaacacaggaatgttcgtttgattggagcgcaggaaaaacgcaggaatcggatgagagagatagactcaaagaaaattttccaagaggttggaactctcgctaaatttcctccaaaatctatatgcaatgtgccattccataggaatttcataagatttggaaagcttcaatcctttgaatcaaagggccaaatagaaaaatttcctataagatttaaatcctttgaaattcttacataaaggaaaatcctttgattcaaagaatcctaaacacgatgatagttccactgataatactagcaccgggttggcgggttaccaaaagagctgacggatatggctttggtgtaggcgtagcagagaacagcgtgacgcgatggtgacagccccaccggggcagacgtggagaacaggtggcgcgagacagcgaaacaaacgtactcccctccccctcaccaaccgagttcatttctattttaaataagtttatttttaaaataattattataaaaagaaaataatatctactgtgaatagataaagtgataaatagttacattgtgatttgataaagtaaagttatttaggtttttctgtagttttgtattaatatgtgtgagaaataaatttatttagcagcagaggtggtactcctactactgctagaaatttggctatgtttagtttatactaaatttgaaagtttggttaaaactgtaataatgtaatggaaaagttagaagtttgtgtgtatagaaatacgatggaaaagttgaaagtttaaagaaaaaacttgaaactaaacgtggcgaaaaggagaaaggaaaacaaaaactgggcctcctttgcgttgcgctcagctggagtccagctgctctgcccgctgggcgccacacgacgcctcgcttttgcgctcggcagcagaatgcagagagagcttgcattgctgacctcgcattcgcaaccggacatcaaccacttgccacccggaccaggaggggacacctgcgagcctgctgtgtgtgtgcgcgcgcgctaagagccaactactacctccaatttatctatagccaatctaataactcattgttacatactacactattaatacttggtcccacctaccatatatacactgtgtcttagagtccgtgctatagctggctacaaatctgtagcccgctgatcttctctctcctcatttatcttcttaaaatatatttgcagctggcttatagcctgctattatatctgctctaatgcgcgactagtcgcacggccccagtcactagtagcgtaccactagtactactactacactattatttattactagtactactacttctagtattactactataaaaatatatatattttatgtataaaaaaaatacacacatacaaactttatatacgatgtgtacaaactttatatacaacacgtataatctttgtatatgatgtatacagactttatatacaacgtgtacaaactttgtatacgtacatattaaaaataaaaaaaactaaaaaaaatcacgtatatccgtatacagtgtacgaagtttgtatacaaagtttgtatagacctatataaagtttatgtacgatatatacaaactttatatacaagtatacaaactttttatacgtatacgtgtatgctaaaaaaaccaaaaagaaaaaaaccgaaagaaaaaaccggaaaaaaaaccgaatggaaaatcgcaaaaaacaaaaaaaaaagaggaaaaaatcggcgggccccaccccctacccacgcggatgccgcgccccgggggagggggcgactg

SEQ ID NO: 61000 - DNA, 5316 bp, Oryza sativa
tccggcaagattcggcggcaaccagcggcgggcaggctggcggcggcggagcacgggctcggtggcggcgtgcgggctagcggcggcgcgcgggctcggcggaggcgtgcgaggtcggcagcgcgggggctggccgacggtgcgcgggctcggcggcgacgcgggggctggtcggcgggcggcggcgcaggggctagccggcagcgcgcgacctggcggcggcgcgggggctggccggcggcgcgcgggctcagcggcagcgcgtgggcttggcggcgacgcgggggctggccggctggcggcggcgcgggggctggccggctgacggcggcgtgccgcttggcggcggggattccttttttttttcttttttttttcagatctggagctagaagtttgccaaacacttttgatgggtctgtaactccaataggagctagctccaactggagtaggagtttggagctgggagttggagtttggagccctaccaaacggggccttagcttttttgtgctgtgtgtgcccatgtctcgtacggcgcgagccctgctgtgtgctgcttgctcatctactctatttcggtctcacaggaatttttgtggagggacgtaacactttttaaaattaaattatgaatctttcaacacatcggtactttcgattggaggaatgtgaccttttcatagccatataaagttttctttttcttttgacctttgttcgatcttctatcagtatataggagacacgatttttttaatctttttttattaaaaatgaaaaagaccgtccaggaccgggttgctagctactttctgcgtgatattttttagactacgaatctgaacatgctctgttacgcttgcatagaaactctccagagatgaggatcaccaaatgttttagcatcttcaccggggttatttggtatacgcaaaaggcggtaccaccattcctctaccgctgaaggtcccaactttgcaagtccaattggaggccaatccaccgctgaactttggcccagactcgtcaaaagaatatgcaatgtgcgaggagatgtattatcgtttcatgaatggtgtagcaaagtggtcatatctgttggttcaccaccttggcctatttcgtagaattaggtctggtttagtttctaactttttcttcaaacgttcaacttttttatcacatcaaattttttctgcatacacaaacttctaacttttccatcacatcgtttcaatttcaatcaaactttcaattttggtgtaaactaaacacacccttagccattgtaaagaaattacacccgtccggtcttttcacctttcatgaaaaaaatatgatgataataggagtgttagttcatataaagctacatcttctcagccaacttttccagattggtaactgagataaactgtttgtatttcgatatagtatttatttaaataaaacaaaggcaaaaggttgcaatatatattgattgagcagggcaacacagtacgctggggctaatttactagtgtgcttgagagaagtataaaggataagattggaaagatacagaaaatgaagtggggtattagtacgcaattaattaagtattaattattttaaaactaaaatgaattactattatatttacagcaatttttctaactttttaagaaaatatttttaataaatttaggaagcgtgcgtgtagaaaataagagacttttcttccagatgtgcttgtctcaaacgcagtgtataaggaagattatgttttgcgttgttctgtactgatggtggtacaatactagataaatgcattcctctcaacatctattgaagataatagtttttgtaacttagagggtgtttagattgagagatgtaaaattttatcgtgtcacatcaggtattatataggatgtcgcagaggtgttcgggtactgataaaaaaactaaatacataatccgtcagtaaaccgcgatagcaagcctaattaatctatcattagcaaatgtttactgtaacaccacattatcaaatcatggagtaattaggcttaaaagattcgtctcgtaaattagtcgcaatctgtgtaattagttattttttagtctatatttaatatttcatgcaatgttcaaacgttcgacgccatagggtgtaaaatttttgggtgtgatctaaacacccccttagaccattcccaacccaaaacactagatatagtttccataaactccacatcatcaagaaactagtactagacactaatcttccaatgcaaacaccactagtccatacttaaatttaatgttgcttatctcacatgatgtcttagatgttgtgtagaaactgtctcatgcaagatatggtttttttctctttgctcatttattcacttgccacattattttttaggcaaaatttaccacaggacatgcaaaaaacgtgtaattggctaaaagacaccgtgaaaacatgacatggccgatggacctaaaaaaacatgtaattggttgcaggacaccggtcacatttttttattatttccagatcaaaagaggtgagatatttttctacatgcctgacttgccccttctctttccttctttaaacaccggtgggtcccatgtgtcatggacagtgtatgtttaatctaatttttaataggtttttaaccaccaggccccacgcgtcatggactaatttgttcctaattagtagggtgattactatttactaaccataagtggggcccacatctctctcctatcctccttcttcctcacgcacgtggcggagcagaggaacagcgcgcggccggccgacggcctgagctgggacggctcggcatgcggcgaaaaaagcggcggcgctccgccggggtatcactgccggcgacggcgaggaccaacgccgggatctcctcattcagcgaggaccaacgccatggtgacgagcagcgccgggatctcctcgttcagtgaggaccaacggccagcctcacctccatcctcacggtgcagcagctgtccacggacatccagggtctggacggcctcattgccagctccgaccccatcggcttccaggtcggctccttcgccaagagctacctgatgcaggagctgggcgtgcccgagtcccgcctctgggagctcgccatcaccgactactcctccaccctgcagagcggcatcgtggcggccatcgtcgacgagctgccatacgtggagctcttcctctccatcaactgccagttcaggacagtggggcaggagttcacaaagagcggatggggattcgtgagttcttttccttgttggcttcttttcttcctctttttattctacactacaaccaagtactacatatgcaggctttccatcacgactcccctctggccgtggacctttcgtcggctgccgaggaggaggagggtgacgtggccgccgaggaggaggaggccggagagcgaggtaggtgcggaggcaatccgatctgatgaattggcggaggcggcgctccatggcaggggcaatcttgccatttgaaaaatattatcacctcttttgatctggaaaatataaaatattgtctctggtgttctataaccaattacacaatttttagagtgtcaatcagccgtgtcacatttttacggtgtctcttagccaattacgcgtttttttcatgtcctatagcaaattttgcctattttttatcagaggtggcagcttattttataccatagacatcatcctagtcagaaatggcctatatatatatatatatatatatgtgtgtgtgtgtgtgtgtgtgtgtgtgtgtgtgtgtgtgtgtgtgtgtgtgtgttgtgtgtgtgtgtgtgtgaccatttacattttttaaaattttgatagtattggatgtacttagtttgattttgttttttccaaaaatttacgtctctatgagaacaaagttttaaaattcccaaactttagtaaagatgtgagataatgtttagttcattatcctactagctaggctgtgtaaatctaatcaatttatacttctaacttatatttttaaaaaatatatatgttggatcacctatataaaagttataaaatatttcatttttatgaaatactccctcggtaaaaaagcctaattctggatttgaatatggacataatgtatgtttggattgtaatctaaaagtaggttttttttttttggacgggaggtaatacggcaggactaaaaaggatgataaagtgaatgcaccgtctcttctcgtgggcaccgatggaacgatcatccccgccggcggacggacctgagcaccgttgagacgaggaggatgggaggaaggacggaccgggcacgtaacgcgtttgggccacgacatcccattgaattcctcgcccaacctctcgatctctctcgccgtacgacgccttcttcttcttcttcttcttcggttaggagaagtatagtactgtactgatttgaacggcggaatggcagacgacggtggctggctagctagggctattagctgtcgctcaccaacggctactacatcgctgatcctgccgcccgttagctaagctcctcgttcgtcgtcttgcgatttgcgatgcgattccacgacgtttgtcgtgtcgctgcaccaagcacaagaaggccgttgccgctgcagcgcgagattgatgggctgcgcacgacgtgggccgtgaattctcggcctgctatttagctcatatggttgggaggcccattcccaacgctgcaatgctagatgaggaatgagtttactttagatcccttagtccacgtatagctcgagtatacagtaccagggaaacgcatcctagcttgagaacttcatggagatgcatcaaaacagcgggtcaacatataagcacaagtgcacaacgccaacattcacctgagcattgacaattttcatgacccccccaagggaatattacgtctgcatattgccgaaggtcgcactcgcagttgtgaatcacacaagacgatgaaatgacaggattaattccggcagttgattcacctatacataatttatttagtgacagaaaaaggaagattaacactaaggatgccttgacctgtattattaattatttctcctcttgtatatgtaactacagcacaaggcagccaagattctggtggccgtcggctaccctagggaagtacagttctcaccaccttcctgtccacaccaaatgactgcatcatggaatacaagattagttaggattgctgatatattctgggatatactccctccgttt

SEQ ID NO: 61001 - DNA, 1832 bp, Oryza sativa
gtcatctattaaaaaacggaggtagtatatttaaatcaaatgagatatttaaactttaggaaaacagttccataacatttgcatgcacgagaaattactaagatatatggaattctgaatgaattgctcttggcatctgcttacctccaaaccgcagtcattaacatatacatttgtaaagagctcagatggatcgggcattggactttcctgcagtattgaacgtgccatgattcataagcacaagtagttcgaatgaacgaaacatttttgaggacatatataactgcaattcagacctttgctttcgcgatggcagtgtcgacttgcttccttatttctttctccatgtcctaagaagaaacatcatagtagatttgacttaggatttctgtgtttatgttttccgccaaagctaatctcatgcaaggatacactatttttgtgtcggtttgtgcttctcttttgtatctcataatgaactaaaatatacagctgatttctctgccttgaatcaaagaaaaacagcatgctacgtcttgcattattgctttgtgatactatttatatgtaccacaatagtataccttgagttcttgtgtggttgcaaagtcatgggccagtagtagcttcctaaccctttcaattggatcgcgctcctgttggtaacataacacaaacaacttactcagaatgaatgtcttcggtgtaaattaagttttgagtcgagactcgagagctcatggccggccatcctgattcctgacctgtcttatgcctgcaatttcatctctggtgcggtaagtgctccctggatctgacatagagtgtccgtggtatctgtaggtgtccatctcaagaatctacaacaccgagaggatatagaaaagttacatgcatctccaagagcaggattgtgttttctactgattagcggcactgaatctatcgaacaatatgagctaaaccacactaccagcagtgtatttcagcacagcccaacccctgagagatccagaaatgtccataatgtgcacagtcgaaatggcaatcaggaaattcacttacaatcggtccattttcaagagcatgttgcttggcaaatttacaagcttgtttgactgcaagaacatccataccatcgacttgcaccaaacacaaggtaccataaccatcatcacaacgatacaaacaagagcaccaacacggccacctccatgcctgcatatccccataacttcttgcatgcaagctaatcgcagtaaaaataactgcaacccaacttgccgtaggtgtggcaagccacacaaagtaatcgttggcggttggccacaagtgtggtaagatgtgacttaaaaatgagcctacgacatgtgagccagcgagttaatgaagtgtggcaaatcatagttatagcaaaccaaacaccaacctaagaaagtttggcacatctagtactcgaatatgtggcatgacgatttgtggcagtgaaccaaacaaccccggaacccacaactagatcacagagtatggtgatcagagtccagaaggatgttgcactcaaatttactggtcaattatgttcagctcagttctcattgtcacatcaacagatcaactctccatcagccagaaagagttcaaacaactactactcataaaaaaaattcaaataaaacagacgttaaatattgggtacgaaaattcacaactgcgcttaaatgagacggagaagtatttagttaccttcaatcctggcacatagtcgccgcgtttgtagtatgcggggcttttcgatgccctccattccgccgtccccatcccatctgtgc

SEQ ID NO: 61002 - DNA, 7987 bp, Oryza sativa
  unsure (1)..(7987): unsure at all n locations
cagagaaatcagtaatcatacaagtcagttagcttttgcaatgattatagcatatggtaaagtgtactttaaataatcttaagacgacaaagcatcaccgcagaaatacgtccctgagagtattatcatgtgattgaaaagttgctaaagtaggtccaaaaagagggtaaagcctgtcaagctttttactgaagacgcggcggcaagtattaggctaatcagctgagaagtttgtcaaggcaaagttcacaggttaaaaaggggaaatatcttatcagaaacgctaacattttgtgtcacggcatcgtttggagcgtccttaatgcaccagtactaataagtaattagtgggaaaatgcttctcatcgaacgcccgaaccaaattgaaaaatcgaacggggagtctctgacacacatgcacctatccaacctgtatctctatctccaaacatgcacctttaacgatattcaaaacgaattttctctgaaattacttatccaatctacaatccgatcataccgttgtattcgttgtcattaaatctttacaacaagatatcgcatgattatattctgataaaaaataatcatatgtttcaatccattaacattttttatttcatatgtgatagggatatgtttcaatatatgtctttagcgtgttttacataattcacaatactaactattactactctctctcctctctccacctcatgcatacatgcatgcattttagctagtttcaaaacattttttctctcaaactaattatccaatctacgatctaatcataccgttgtattctttgtaattaaatctttacaacatgatatcgcatgattatgttttgatgaaaaaaatatatgtttcaatccattaacactggttgtttcatatgtgatagtgatatgtttcaacgtgtattttcatcatattttataaactttctgtaaaatgttatcagtctgctcgatattttattcactcccattaagtccaattggcaaatattttgcacggcaacgaattttttttattcttgtacatgctaccaatagcgcggagtggtgtgattgcaccgtgcacatcaggcgtccgaaatattcgtggaaantatcgcgacgatccgcacgcanngnagtcatcnntncctaattaaagtagcgccctagcactgtcnnagtcgnncgaaaaaggtaannacacaaatgnnnggcatnncnaccgtnnttncgaaanngtgtcaacgncgctcaccaaatgcattactagtaacgtactacanngtanntgatanntaggtacaacagctannngacntgattcgttccccacaacaatcctaaataagcaagcggaggatttaatcacgacatncgaatgagtcaaaaaaagatgacgaaacaatagagataatggatggattacctatttatatttctataaacaactcagggtaccctgcttacaaattgttcatgcaatctctccactaacaagacgcttctctctctatagtccaaatcccccaaatccgctcaccccagccaccaatatcaatcagaaacagggcgtggtgcctagcaagaatacatcacggcgctcgttcatggatatatactaatcagcgtgattagtatttaggaggtgctggaggtaaccggtttggagtgcgtcggctgccggagttggcaccggaggtcacgtcgccgttttcatagcgccctctgcgtccatcagcgcttcttgaccttgattcgctgcctgagctgggtccgttggatgcggaatcgaaggcagacctccaatcctcacctgggcggttgggtgtccgggggctctctgcaaatgattccgtttaagaaatttgtgacaaattaacagaagaaaagtaacatgcaatctacattagtcaccctatgattcaacatgtagaaatatgagttataaaaggggtgaatggtcagctgggtaactatatcaatgacaggtaatgaacaacattaacaactagttacaaaggagatgtaaaataccatacaattgtatttgctattacttctcaggcattgaaagtatagtaagcttaccagcttcagagatatcattggcataagaagcagccctgttgtcatggacactaagttgacgggtaagctttgacaagagagatgattgtttttggtatttttcccttctacgtttagcattatggtcctcttgcagaagctcttcaatttttgcattgctttgcccactggtaatgacaaaaaaagcaaaggaattaagattagataataatggcattaaaaacagcatatagtataaatagcttaggtgtaccatttaagcaagtctataatataagctaagaataaacaaactgcaaatagcatcaatgaacaacgaagtgctggaataacatgtggatcccaacacctgtcccacgaaactgtatttttgacaatcagttagaactaaaataactaaaatccctcccaaagaatacaacaaagtggtatgacaacattcttctggtgccaatatttctttttcatgtaaccagaaaaaagataatatgccagaatgattctgaggtttatacacactatagggattactaaatagcaagatcaaaatcatatgcatagaaaatagatctacaggattcccatggcacccttttgatccagatggctcatgatgacactattgcagcacaaagaatctgaaactgtcaggtggggaaaaaatgcaaaaagctagaaacagtattatagcctccagaagataagagaagtattcatcaaccttattgaactatatagctggtttagcatatcttcctttgccttctccacttggcacaacacaatagcctgataagagaaggggaaaaaacaataagaacattgccacaatgacagggtccaatgaaatgagcaatgctagcttttttttaatgtaaacctttgggacatttgctgccagactattcaaaacagcctcaacataaccacgaacttcatgggacatccatctaagttcttcttcaggatcagcaggtctccgtgccatagtatcctttgaaaagtgcagggatcagatgtcaattgaaaggtcaaatggaagtaagtaactcatgccaacaacaacaatacaacatgtttatcttaaggaacatgaaataaagttttacagtcttaacatcaaaataagaaagagtttgacaaggagaaaattagagccagagggctaaaagcgtaggaatggatatagctagaaactaccagagcaccatcggaattgctttgtctcatggaaccaccatcagtatttggacccttgaatgatccccctttgctttgaattacagcccgtatcttatttacccactcaactttgtcggccgtgctctcagctttcaatacaacagcactatgagctgtaaaaggaaatacaccatttagacaacaagggtcttataaagaaaaaaatcaagctgaggtattcagggatcttaaccttttagaactgttttgtaggcaaccctgttagttatcttaaagacgagacttgggcctttctctggcccatttgccttttttgaatccttcaaacttttaggaggttcttcctcctctacttcttcaaggttacactcctgcacaatgatgtcaaattcaagttaccaactaagttcattttacagcatttgttgatgtatatgtgatgtttcttccaatatcagatagctctttccaagggataaggcaaaaaaacaaacccaataatggtagaataaattacatgcaaatttaaggacaaggtttgcgcacacacctcaagagtgatgacaccacgaaaatgtctctcctcttgtttcttcgtgtagccaagctgataaaaatagaaggttaaccaaccacccatgcatagaagtccatcggaaaatacataaataaattatcctgatattcctcctgttagtgcaaaaagacaaacaaaactaaaagatgatgattgaactctgattaacctttccgcttttctcattgaggacaaaccacctcctactccatccatttgtttttgcacttttcttcaaaaggtaacctgaagaaaaatgtacaaaattaacgaatatttatatttgcatgtacttttttacaatgagacaaaacaaatgtttcatttcaccaaatggttcaaagggcctgtttaccagagctccaactcctggattcttacagaatgagtttttagactagaatagaagtgctttaagcctgtcttgagcctaaattcaataaaaaatttgtggttttccataatggctagcttgagcacagcatgatttgacacattcttacctgcagtaatttcaccagaagaaccagcaacctgcacagaggacccctcttttgcgtctttgtcttgctggcctgatttgtctttgtctttgtctttcgctgatttgtcttttgtgtctttctcagatcctgtctggggactggaggcctagaaccaaagcatagttatttcagccttgtaatggtgaaaagaagaaataccatgtctaataatctaaataagtgtattcctaacaaaacaagtcagtgtgaatcaaaatccatttaggctgccttaccctttttcccatgggttggtcagcatcctgtggtttcttggaggatcgattttttaattcatcctcacggcgttgcctttccattctgccagtattgttaaaaaaaattgacaaggctcaacattccatagtgtaactgtgtagccataaaattatcttatctttacaaaatataaataatggaaagattgattatcaagcaaagggcaacttgctgaatttcaacaaagagattgtatatccctggtaatcatatgttcgactgattcaagataagggggtgtttggatgctggggattgctttgacaattgttggtatagctcaatttgagcaatatcctaaagatctaactctaaaaagaggataagaatttggagataaatcatccctaccaaagcagaccctagaaaagaatagctgaagttaacctgaagttgcatgtgtccttcagtgttcatggatcacttaaagatacttctttgaaggcgtacgtaggaaacatactaagatttccatgctaaattcataacatcaaaatattacaggaaatgaatttataaatcgaatgaacacaaatattttatcaaaaagtaagtatagaaattgaacagggagaaatgttaactaactattggagacaaatgataactaaaattgaagggggaaaactagccaaaaatcaaccttctttgcactagacggatgaaatgctgaggaggaacaaaggcgcgctccatatcaacaagtgcaacaaccatcttttttgcatcatttttgaagctgtctagtgcatttgatgctattgcaatgaccttgcgaaaggaaacatagattttttactcacatcagtcaacaataaactctaccaacgtgaaactcgaaaggaaagaaactctaaaatagctaggtgatacctcgcgcttgaatggaggatatcttccaagtcctggtgtggcatttgctgaagcattgacaatgtctaacaatacacgatgtacctagtgcattaagaaagataactattacttttcctaggcaataaactaagaagttcacaattttcaatacaaagataacaatatacaccagtacataacatagaaataccacacaacaattgataacaccaaataaacaaaaatctgaccatatggaagtatggaactcaagcagataggtagtcccatgcatccgtatcttatttgttgaaacaatggaaccctaattttacctcttatctaaaaaactcaatccatagaacaaattgctacctcaatcaaatgcacccaacccagcctccaaaagtcaaatttaggataacgcttttctggtaagagaataaaaagcatcattttcttattgcagtaacttacaaacacaaacacattatttctacaacgttcttagccttgagaggaaaaaaaggaacagatctaaacatgttatatttttattggtaacaagactttatttgaataaagtagaacatacctcttcaacacagagtcgtgatggctcctttgccatatccaatactatctttatcaaggacctcaaccctttctctggagatatcaggtacggttgataaccatcggcttccaagacaatctagaatgtcagagaatactgttcagtgttcataaaagatgggaaaatgcctgatagtagcactaatcctgaaactggatccaatcttacccttttaacattgctgaggtcaaagtgcctgtccagtggcagctgtttaattctctctgggaatttcccttcaaaacttgcaacaactttccaaccagacccctatttatacaagacagtatattgttattgtaattgcttgtgcagtttaggaaggtatgattaaaatctaagtaggtttgaagctctttactaacctcgccagatgtaatatgagcaagaaacttatcctcgaattcccggcagagttccaaagcaacagcccgagtcccttcagcactttgtaccatagattctcccagccgtgccagttcatcttgaaccatctgggacttaccctgaagactgaagtagcagcatatgaagcaattgtatgtaagtttagcactagaccacacatagtagtgaattattccctccattaacagaaggcatgttagattttgcacaaggattaaaaaggtgatgaaattaagaaagatgtaagagcaaatgaattgtacactttcatgattgttctgtgtgtgagaatactttgtgtcggtggaaaagtggtagaaactaaatgcgtacgagagaggtagagggagggcgggaaatggtcggcaaacactcactaaatgacatgcagtatgtacgagggaaccaattcgaattatatgctatattatatcaacgaaatgagtaacagcactgtagcaagaacatgaattcatctaacaccatgcagcatcgataaataattaagagatgctaggtacaatatacaacagtaattgaagcataaagcacaattcttacccactcaataggttaggaagtcgcactttcatccgtttacgtatctgcttagcaatggtgtcaaccagagctattctacctagtttactttttggagctccagttaagatggatctgagggtttcagcttcagcattccatgctgtttctagtgagttttcagaacctgctgcttgagctgacgcaattgcaactgattgtcctatcagagcaacccactcgatatctggaaggttttttgggcccttattcgacagaagggcctgaacacaagctatagtttttgcatctccttctgcttgatcaactttacttatcacacctacagttctggtgcctgcaacaaatgggtaaatatcacttgcgatgaaatgaatgaatggtactatagaagatatttactcctgaaagacagaccatctgcatcaatatccttggccagcctaagagctcgagatgacgcaacatcagctgcttgcattgcaggtatcacaactagcagtattgcatcattgtgcccagcatattcattaatctgaattcagaaaacagtcagaattctgcagcataaaattggaaagcatgaaaacatcaaagaagaatgcatgtggtgttctctctatagtagatgagtatgaacgcttcaagggaaaattcaatctatgaagtaactgcacattgtgaagtttcctagatgctaccatttttcagatatatgaatgtcacggatcatacaagatattcatgttacctccccgtaaaaaaagttattccttctaccgttatactcacatagcatgtaaactgacagtaatagtgagtggttaaa

SEQ ID NO: 61003 - DNA, 986 bp, Oryza sativa
tactttgcaattacacatcacaagattctctgtaactttctttttaacatgaagattctttataactttcttcagcacaaaatacaaacagcatataaaatgcaatgaacttcaatataacaacccaaattttatctctttgatctgtgcgccatgactacaaggaatacctcaccaagtcctaacatggcagtatatcatacatatcattctacactatattatctacatttctaatggaacaagaggcaggaacgggttagccagaatcgccatgttactcgcggacgaacctgtactcgtccgcagcttgagattgatcccctctacacggcccctactggatccgctggacgcccccttgctgagcctgtcctgcagcgaatgccgcagcgaacctgagaacagcagacatcacaaattcagcgccatatccatctcgaaaacccacgggcgcaagtacatccacagaatcgagcaacgcaaagtttgcgagatcccactgacttgcggacacctgctgcgacttgctgtcgatttgcagcacgatggacttgctgctgaggcccgggtccctctgcaggtccaccacaattggcgccctcgtcgccccgttctcccccgtcggctgcaccccaagcaccaccaccacccccaaatctaagaatcaaaaaatggaaataggcgaagagctagttgtcgggtagtagtagtagtagtagtagcacgagctcaccagcacggggtggccgatgaggctgttcagcacggccgacttgcccgccccctgcacgaagcagatcagaactggatcagatcgggggagcgcacgagcgagcgagcgagcgggcgggcggatcgcggcggctccaacggcggcggcggcctattatacttacgacgttgccgagcgcgacggcgttgaggaaggtggaggggcggcgtggggcggagtcgtcggaggggtcgtcgtcgcgcagcagcga

SEQ ID NO: 61004 - DNA, 1988 bp, Oryza sativa
ccgcctggcgcatcgcctccgacagctgcgcgagctcctcgacggcctccatcgtctcccgcgtccccgcccttcctctccctctccctctccccgcgccggatctcgacggatcgggggctcccgctgctgctgctgctgcgacggcggcggcggcggcggcgaccagggccgaggcgacgcgggtttgaaatctgcgtggggatgggatgggggaggaggcacgagagacgtgggggcggtggatttgggcgagacgagaacgagagaagagagagagagatgggggcagtagagactagagagagagagagagagagagagagtcgtttgctttgcttgcttggctgcgaaggtgcagagcgacgcggtgggggcatcggctatggatactggttgggccgggcctgtcgggatttcggatggtcccccccgttcggcttgggtggaattcgaaaaattttgcgggattggactgggggagaccgggcaaggcctggaggccttcctgggtgtgtttgttcggttgggatgggatgggccgagttggtgggttgagattcggactctcattctttccgtgagaattcttttgggggcattctactcatggtcctcctcatcttcttctacctctggcggttcttctccgggaagcgggtcgctgtcattgtcaacgggcgtgtcattagaggacacatcaccgctcaccgataaccttatcgaggcgttcctaaaccctaaacacaaaacccaaaaccgccagctgcgggaagaggacattgcgccgtctctgtcgtgtttgtgtactccggtgacaacactagcggcagccagggcggaaaggcggtggcaggatgcccgatatacattgtggagtttcacgacggcgacggagcatggctcctccagctgtgaggccaccaattcgacaccaactacatcggcacgtggctagaactccactccacctacacgctctgtcgcgtcatcgtgttgctcctcctcgcctccttccttgagcatgccaagaacgagcccaagatgtcgatcgatgtcgaatggatggccatgctcttgcagttgatgggctagacaagaacaactagctggatgggtggggcaccggatgagctggcgtgcgagcaggatcctgaggacgacgaggcacttgagtgccacaacggcattcctggcccgctgcatgacgctggcatgtggggcccatgtgggtctcgctcgccgcgtaagccaaaactgaccactatattgtcaagggatcaaagttgacacggtattttgagttgggggataggctataccggatattttggtttagggaagaattttaaacttggtgattgagatctaaagtgaacttcactactacaaaagcgatttttctatacaaagatctctttagattgcagatggaccgtaactggtcgcgtcggcaaaaatcgtcctcccattttcgtgtgaggccccttaagaatccgcctaaagtctaagtcccctcctcttttcccttctcaacactttaacatttttcatccttatcctctctctctccttgttatttcaaccttatccactcctcttctctctctcattcgctcatgcacaacgcccgatggtggcccggtgcacgatggtggtggcgcacgggggcggtgggctcggtgggtgccacttcaggcgcggggtggcgcgagcagctcggcggatgggagcaggcgcagcacgccacggcggcgacgggcaacgccagcacggcggccgggagcgatagcaagcgacagcgcggtggccgggagcggtggcgggcggcggcagcgcggccacacgctcccctagcagcggtgcccctcccccgtccggatccggcggtggaggggcagtggagaccacggagagaggcaacgacgacgacgagttgtggtggtgacgatggcaacgatgatgagcggggatgcagctaggttttc

SEQ ID NO: 61005 - DNA, 2419 bp, Oryza sativa
tcatgttcctcctactccttgagaattgagacctcgccgtccccccgtctccttcctgatcaacccagccacctccccacgtccatactccatcgccgttgctgcatactgctgcccacacggcgaggaatggcctcgtcgtgtttgtgcgccgtaatccaccacactatactccaccaccatgacaagactgacatcgatcactagcacgagctcgaggacaataacatcatgatgagaacaagtttaatagtagagctaactattggctatcagtttattttagatttaacatgtacttcaagattggctctatattttctctcctctctctttctcccatcttaaagtacgtgtattatagacaacacttcttatttttctttgtctctattttccatataatgttatagttgacttataatctactgttatctttgctctgagatggtatccaatggtatagcaactctttcctttaattattatcgttatttcctcatatttacggggtgctattttcctcagacaagaaagaaattaagtgaataggttcctcattatgtgtttttttacgattatttggttctttttttctaattaagggtacctgtttggtttgatatgaaaaacacatgaatcatatatctgtgtttttttagtttaatagtgtagacaaatttggttttttttaatacctacatatagaaaacaaattatgtaacaaacttaggaggacaaagtaaataaataatgtatgcaataaccccttagaaatcaagtgttatattccaattaattatgtacctattaagggcctgtttggcacaactcgaacttcaacttccacctctcgtgtagttggagctcagccaaacaatttcagcttcaccgaaaataggagcggaactaaatggagctctctcacaaaaaaatgaactagagatgtggagctgggtttaggcagctccacaactccactccaaacccaactcttgaagctaaacttaggagttggagctttaccaaacaagctctaactgtgcactacgttcctgattcctccttattttctaatgaaatctacaagactggggttgcaaaataaactctactcccatgtgtcaaatgctcacaaagtttcaggttacttgtccatttgagctcctttggaacgctaaaatctaaggctgatttcgttcacaggagataggagagactgcgactcgttttctgcgcatacacttttcaaactactaaacggtgcgtttttttgcaaaaaatttctatagaaaagttgctttaaaaaatcatattaatccatttttgaagattaaaatagttaatatactcaattaatcatgcgctaatggctcacctcgttttgcgtatcttcccaatcttctcaatcccctctccctcaaacacagcctaagaatacgggaatatgaaaaacacagaattgaaaatgttgcgttgaatcctactggtaacaaaagcatatgaattactcaaaacacaagtttggattgatacgcgggaaaaaatataggaattttgagattatatgtttacttaaacggagcgagagtggaaaggaaagagagattgcgttcgaattctcaaagtaaacaacaaaaacatgaggtttggacctcatgttcaggtctaggagtgtattccaaaggaattttgtaactccaaatcctaaaaacgaaacaacctcaaacggaaaagatcctaaggatttgaattctctatttttcctttggaaatcttccaatccaaagaagatcctgacattgcttttggcctactttgtgtgatggtgacagtttggatgtcgctttaaaaactactctagcttaattaatcatcattaacgaccgtgtctggctgcatggtacagtcgctacaactcagcgcggatgcgaaatactttgattgtgcggagtattgtgctgcagtcgtatgattgtttccaaaataaaaatactcccggcaccataaaaacaatttcgtaaaaaataaaggaaaaagtacgaattaccccccgaactatcgcggttgtccgaattaccccctgaaccacaaaatggacattcttcacccccaactatgaataccggacgaattaccccctcgacccaatccatggtggttttggtctacgtggcgtacacgtggcagtccagtcagcattctctttataaaaaaattatgggacctacctgtcatacactactctctcttctctctcttactctctctctcttctctctctcactcacgaggcacggcttcccctcctcccgtcacccacgaggcgcggcttcccccctccctcggcagcggcgggggatgaggagctcgccgccgctcgctcctgcctctgcgccgccctgccccgcctcctcca

SEQ ID NO: 61006 - DNA, 2333 bp, Oryza sativa
aaggcaaggccagttgcaagccacccggtccggctcctccgccactagtcgcccggtggcgcgggcaagctccgcatccacagtcgggcgctcgggtgagctccacctctgccgccggccgtcgagcgcatgtgcctcctcctcggcagtcgactgtccaagcgcgtgagcgtgagagagagagagagagatagcgcccgttgccgccgccgctcctaccgccatcgccaactgccaccgccgtcgccaactcggttcgaagagagagagagagctcaacaccttccccacctcaacacctcttagatcttggtggtggagggatcgatgagcgcgctgcgggcggctcaacctctacgagctcggggacgggcggtggctcgtcgtcatcaccctcatcccccgccgcagcctaccgccatgcgcgtaagagagagactgagagagtgaggatgagtgagagagagaggagagagagagagtgagtgagagagagaggggaatagtggaataggagtatgacatgtgggtcccataattttttataaagagaatgttgactgaactgtcacgtgtacgccacgtataccaaaaccaccgtggattgggtcgagggggtaattcgtccggtattcatagttgggggtgaagaatatccggttttatagttcgggggtaattcggatgaccgtgatagttcggggggtaattcgtactttttccaaaaataaataaaagggtcaaacttagacctgttggctgttgccatggcagatcagctagagtttgtttcaataaattcaagcatgcatatattggctaactaactgtgttttcagttcagcgtttggatgttatgaattttcaatggcatgtaaaatgagaaaagttattagccttagctataacaattaatcaagtattaattattatagatttaaaaatgagtttatttttaattttttttcacaaaacgtatcatttaaccgtttagaaaacgggctaatgaaaaatgagaaagttatattttagttgctacaagaactcatctaagtactcactcgcaggtacttctagccagcaaagaccatcatagctgatggggctcaacacgaggagcgagaaaaaaaaatcatcgaaaagaaacaaattatcaactccactttgagataaataaatgaacggtcggagcaaacggacaactcttaagctatcaaacgtcatcgaagctgcccaaaaataatcccctgtcaaacgctggtgatagctactgtacgttgctctatcatatgctcgcactagggcggggttaacatcagccgcgagctaccaccacggcacgcaggaaaatggcagatgcagaaaccaccagcagaggaacggctgcgacgcccggtccggaataccgcggccagccgaggttgcaagagaccagggcacacaaaacaaaacaccctatggagttcggagtattatgcatgtacatccatgacagattacatatttgcgtaacggatcttttgcattttgggacaactagtgtcatgtatatcattgtttggtccctactgttgctagttgcacttctcgcgatcacttgaaaaatagatttgacctcggtatctttgtgatataacaataaacctcatatcagtgatagatatacatggtattttaaacaaaacatggaaatgagacctttttatgaatgcaaaagttttataggattcttaccgacaatagcttaattcctaaggtttttttacgcttttcttttgtggctactttgtcaatcttacaatatattggcctaattgttcggaggggctcagtagataaaggaggtgtgtgttcgtagagatgagtgcgtgcgcgttgtgagcgtctacacttataccatgtttgtcaagatctcacttcatgttgtgagtgactgattcggctagggtttgccggtttggactttgaattgttttcttttgggccttatccagatacctgtagattgggtggtgcgcctgttctactggcctacttatcattgtgctatatccctagctcgagttggcgtgttaaaccacagctcagcttgttaagaaaatactacgagtcgacgtagtcgagccaagcgagccaacgagcgacgaacttttcgttccgcacacaaccctagtccaaatgcgctatttctcgaattcccagggtcccagtcgcaaaaccaccccccaagtcctcctccagtttccacgtccccgccgccgcagaccagactgggaaattcgccacaaatcctaggggcttcgccgcaaaaccagcaacccaacaccaccccc

SEQ ID NO: 61007 - DNA, 5546 bp, Oryza sativa
  unsure (1)..(5546): unsure at all n locations
ttccacccccgaaaccactccaaaaccaaaccaaatctcgcggcgcatggcggcggcggcggtggcggcgaacggcggcggcgacggcgcgcaggcgtccaacgcgcccgcccccaccaggctcgcgtcggtctacagcgaggtgcagaccagccgcctcaagcacgcgctccccctcccctccgtcctccgctcccccttcgccctcgccgacggccccgccagctccgccgccggcaaccccggtcagtcccgagcccgactcttctgtggatctcgccctcctcctgcttggttggtgttcgttactggtgtgagctttagatttgatctggttgtggtggtggtggtgtgcaggtgagatcgcgaagctgttccccaacctgttcggccagccgtccgtgtcgctggtgccgtcgccggagccggcgtccaccaggccgctcaaggtcggcgtcgtgctctccggcggtcaggcgcccggcggccacaatgtcatctgcggcatcttcggtgagtgcgctagtgttctcgagctgtttgttaaccctgtttacccaaggctatggaggatcagttctctgtacaagcgaatttgaagctcgtggtttcgagatgggggtgttcgcgatctggatagggnaanttcngtgnngtntnttntnaagctagttagagttggtgttctccaaacaagctttggcatcgaacgcgcacagttcttagatcttgatcgattttggttgtttagcgagggccagaattaagagatctgcttattttttgattgtgagttgtgtcccggttgcactgaaaaatcgaataggcactaatgatatattgtggttccaaatatatttcttgatgaatttgcttgccttgtgtcggaccagattacctgcaggaatatgcaaaaggatccgtcatgtatggattcaagggaggtccagctggagtcatgaagtgcaagtacgttgagctcactgcggattatgtgtacccctacagaaaccaggtatagcaacttagattcactaagcatgctattgggtcgaaaattcgacaggtgcctattctctgattttctgtaaatcatgttagtttagtaggtggtgttaggtaaggttctggtgtagaaaatatgataagaccctttttttggtgcaaataattacattctcattttcttttttggagtatgatcatgctaggtgtcaagtactgctgatggttaggtcgctgcatgaaatatacacacttttcctttttaaggggctctcttatttcaggtacgattttaattttgtttctctttttgatagggtggatttgatatgatctgcagtggtagggacaagattgaaacaccagagcaggtatatctttgcgcttttatgtgcaaatgcttatttaatccctttatctgcctttcagggtatttggctattttgttgcctagtttcactagcattttcttattttaaattctgtcatgtatttgagcagttcaagcaagctgaagacactgtaaacaaacttgatttggatgggcttgttgtcattggtggtgatgattcaaacacaaacgcatgccttcttgctgagtacttcaggttggcccctaatatgtgtaaccctgttcttttgcttcttaggcaattttctttagttgctgttgacaaagacctttgtgtactgttgatgctctgtcaactgtaaacaggtcaattccgaaaggaaatacagaaaaaagttttccaaacagtaacaaaaagctcttatttttgttgtatgttgctgaagcatattttctgcatgatgttttctgttaaacaagcattaagtctgcaatagcattgagccattaactgaattctgcaacatagagaatctagatattattctcgatagttttattggcaatattaactatatgcttgttgacaagtgagtgattgtttaactttgtagggggaagaacatgaaaactcgtgtcattggttgcccaaagactattgatggagatctgaaatgcaaggaggttccaacaagctttgggtttgacactgcttgcaaggtatcaggttcttgatccttgtgcatcagttttcaaaatttcagctaattctactgtagattgtgaagttttcacccttatgaccttgatgcacttgctcaactgcacatggtgaaattaggacattttgcacataatatgaaaatcatcacggcaataataacaagttgacgatttttcctcaaaaaagttaacgattgatccatcttctttttcagatatactctgaaatgattggtaatgttatgactgatgcacgctcaaccgggaagtactaccactgtaagtttctgttttggttgtcagacatatgccaaactatgatttttgttttcctaaacatggaaagagagttgataggagcaaactatgtttagtttgaagagatcatggataataattgccaacagtagctgtacatggctattaaagtatactgtcatttagtttatccataactaaattgaagaaggtcattacatgctcagcaacctagtaaagtagtatttattttttcgtacattatacaacaaggcctcaaacatcctcataatgctgtaacaacatgctgctaacatataaaatccttgagtgtcaacttctgcagatggttaatttaacattattttgtctatttctgacacaatactaataagtatttgttatgttcatgtagttgtgaggcttatgggacgtgctgcttctcacattacattggagtgtgctctgcaaacacatcctaatgttgcactcattggagaagaggtttgtaattcttatatatgatcttctacattgacctgacactccaaccttttcctagcttgaatactgttccataatggtggaatcatctattcatttcgattcatgtttatttcatgctgatttcatttacactttttcctaccaaatgtgatgggcatgattggggctagtccactaggccttattgaggttcgttgtccctggacccagttggtgttgcatttccatggaagtcagcatcacaatcacaagggcaagcggtagatagacaatggacacttgtttttctgtcaatgctaacaactacaataggtctcctttaaagcggattattgtaacaattgtatatacgttaatactactgcagtatgttgctgtacagtaacattgcaggtcccaattcggtgttggcacatagcacaaacctcgtactttatatcacagtttggtactaaaaattgactcgagtaaaatgttgctggagatgatctgcagtttttctaaagtgcacatggcatattgtttgcttattatcattaccatttcagaacacttcttttttgtactgtaggttgctgcaaagaaggaaactcttaaaagtgtcaccgactacattaccgacattgtctgcaagcgtgcagaacttggttacaactatggtgtgatccttatcccagagggtctgattgatttcatcccagaggtttgacaatcttcattcacctgtgatttgtgttgtcacgatttgcattactgatttcattctgtttctttcctaggttcaaaaactcattgcagaattgaatgaaattttggcgcatgatgttgttgatgaggcaggggcttggaaaagcaagcttcaaccagaatccaggcaactgtttgacttcctgcccaaaaccatccaggagcaacttttgcttgaaagagatcctcatggaaatgttcaggtaaacagttatagtcctcccttcgctgacatgactttttgctgaagagttggtcatactaagtccctaactggtgttggaaatttttgtttttaggttgcaaaaattgaaacagagaaaatgcttattgccatggttgagactgaattggagaagagaaaagctgaggggaagtaccccgcacatttcagaggccaatctcacttctttgggtatgtatgaattgttgcattttccaaaaaaataattccatctctaatgctgttgctgtgtaattttgcagatatgaaggaagatgtggccttcctactatttttgattctaactattgctatgcgttaggctacggttctggggcacttctccaatgtgggaagacaggactgattacgtcggtatgcacactatagttccctgtcacttgttggatacccagattggaacctaagaacgggctttgtggaagtgatgtttgcagcatgtttgtttacgaaccagcgcaggcagatgaacttctaatgatatgatcatgctcttatgtttgtatttttactcaggttggcaacctcgctgctcctgtggaagaatggaccgttggtggaactgcattgacatcgttgatggatgttgagaggaggcacggtaggtttctacagttccgttgtttgcacttggagattagctagctatgtttcattaaatttcttttgaccgtttattcaaatacctactatgtgattaaatcttcaagttacttttggaactaatttgggtcagattttcatataatatgcattgcattacctgtcatttccttgtttaaatcataaaactaatgtttttttttgttttctgcaatcaggaaagtacaagccagtgatcaagaaggctatggtggaacttgacggtacgaagcacttctattatcaacgctaacagtaatgtgatttatggacctttacccaaaatctcatttcatctatcatccattttcaggggcaccgtttaagaagtttgcttcattgcgagatgagtggtccctcaagaaccattacatcagccctggtacgtggacatgcaatagctagcaagtagtgcaaaatgactataacagcaacatagagaacaatgacatgtttaatttcttgcgaaacaggtcccatccagttcagtggccctggaagcaacgatgcgaaccacaccttgatgttggaactcggcgccgaggcatagagagacacgacgataccgacgtgtaccttttaaattttttgttcttacagttttgaaaagttgagatggaacctcgcagagtgacctgcaggctccatatttgtggagtgctcaataagaggttccattgggagtttctgtggagtagagatatgtgtaccaataataactgatgttagctttgcatgatccattgctccatttttacacagaagttaacttggttttattgtagctctgggttttgttcaactggatgcgacgctataattatgggttttgttcaactggatgcgacgctataattatgaacataaataatccaggttgaggggcggttttggttttctttacttgttattatctcatctatgttcatacatactcgttgacgatcgaccgtcggcatcagtttgcgttaagcttaaagctaaccatagcagtattctcgccctttctccaattccaaaggtcatttttgcatgcacattgtggacgcccttacaatctcattgctt

SEQ ID NO: 61008 - DNA, 21266 bp, Oryza sativa
tcagcctccgcccccgccaccgccgccgccgcgccgaggttgccgccttcagccgcctgaccgtgagagaaagaggaagagtgaggagagtgagagagagaagagagaggaagagcgagagagagagtgtgtatgacaggtgggtcccacatttttaaaaatatagaatgctgactggactgccacgtgtacgccacgtagaccaaaaccaccgcggattgggtcgaggggggtaattcgtccggtttgtatagttgggggtgaagaacgtccgattttgtggttcagggggtaattcggacgatcgcgatagttcgggggataattcgtactttttccttcaattaacttttgtttgcaagacaattcagacatgaatgcagatgcagctcatggttcggtttgttcgatgctagggattttcacgctttgtgtttcaatgtacttaccactccgtactattcatcttaaaactttaaactcatcctatcttgatgttttgacttcaaggttttaactataggatattgcatgatgttacttttagaagaaaacacttttaaatgtgaaaatttgctgctggacaccacattaattataatattcatttctggtttaataggaaagaaaccgcgtgaaagttttgaaacatgtcatgtttccatctcctttgtttctcttagctctctctcgttctcggccggcgagcatgcaatacagatgaagttagctttgccagcaagcattgaggcagcgcaaatccgcaacgctaggagcgggactgggtcctagtgttgccagcaagcaccgggtcctcttgcggcaattaaagatttaaatctccggctatagctgccgctaagatatgccacttttaccgctaaataatctatgaagctaatagctgggtttagcgagagatagccgctaaattggccttgagttagcggcatgcgacagctaaactttggttgtgggttgaaattggctacgggcctaaggcccatctacctctcctataaccctaacctcactctctctcctctcctcgatagatggcgacagtagctgcgcccggagccctaaaggcagcggctatggcttcgccctaaggcgacggagttggcggcttctacagcgcgtggcggcagtttcatgcggaggctgcaacggtggcagttacgctcgtaggcggcggagttggcggctgcggcttcgcccgtaggcgacgcctacacgcggtggctgcgatggcggtggcggcggccaccgtgcccgaaggctgtgacaatggcccactcctcccccaagctggtaagtgatcctgatcttgaatatgcaactactagctagtaattgattctgatcttgaccttcctgtgataaactgatgattgatgaactatttatgtcaagaactcatgtgtcaatttatcatgtactcatgttcatgtatgaactatgaaaaaattatcatgtccatgtgatgaaatgtgttgtactatttattttgttcatgtgatgacctatttattctgtgactcctttatagtttttgcaaaacagctaaatagcttagctgcaactataccccgctatagctaatcatagctgttgaaagcccaaacagctaaaggccttagccgaagatttaattccttggcggcaactgttccagggaggcgaacacgtcaacgacgatgacgctagataggacggtattgttagtggcaggtcccccagatggatcaggttgcgcaatggcacgagctagtgccaacctaagcggcaagcttcgcagcaagcggccgcggatccagttggagagtttgcatggcgtgagcgtggatctaggcggggagctccaggtctggcgtaggccacctctgcggccaccgcctctcttctctcctccattcctcagtggctgtcttgagccttcttctctagctcacagaaggagatgtagacttgacatgtgggtctaggggtctttcagaactttcatgtggtttctctcctattgaatcggaaataaatattatattgggtatgctgtgtagcagtaattttttcatatttcgggagtgtcttccctgaaaagtcacttcgtgccatgccttacaactaaaaccgcaaatatgttttttttagcaaaatttgcctatcttaatataccccatatgtccaaaagtattaaacatattttattttctgatttttctcaaataatatattcatatttgtagtctctgtgcatttaagacttaaatacaaagatagattaaatgaacccaagtagccatcttaggtcttgtttgatggagtttaagatcctgaggagcggctagttggcttttaactcattttgtggattttgtaactacacatttttataatatagatgaaaatttggattgtttgaaggagtttttattctgaaagaaattgcagctaccaaaaactttcttaaatatacccttaatatttattggtttcatacatttatacactctttggtcttaggatgagagttggtttctccttagtttcgatgataaaagaaataaatctaagactttaatatagaagtcgtaataattggttgaaagtatgctgcataaagacaagtgaaaccttttttttagcctagcctcgtaggctaactatttttttaaactaggctaaccattaaatagaagtcaaaattgaaacaaaaattgtccatatcgacaaacatttggaaagggagccgagttcatccatatgccaaaggggttcccaaatgctgtgctaaggatgacgacagaaatgcaggataaaaggctgacacgttcgtgtgcttgccgctttggagtctgctttttcttggatctcggtctctctttagattccatacacatgcagcaacattgcaacaatcttttctgccccctctttagttcccaacttcagtggccgtgagttcacttcttattcaaccaatcctttgttgcattgtacagtactagaaatagtggcgcgctgcgctgcgccagtcaatgatgtcactgaacaattaatatataattactctaaggtccaagagaactacaaactaaacattgaattaagcataacaatcacaacacatcaaagaggcttactaattaccattaacctgtatacaacacagaaggttataaatttgctttattagttacgaaataatttcagaacattttacactggtacactccagcaatgaaatgcactcacccaacatctaaactactctcccccactgatggaaagtatattggatatgctttgtgtggcatatattactgctgaaaactccctcccaagtagtcctacaacagtaaaagaaagaagattagtctatgcttgccgatgacaatggtttgaaggttgacaaattaagtaatgaattttacaatcccataggaaagtatactacagttatcctgcattcagtcaaaattataacaccttttggggagctctgttatctctctatcatatcaagttatcaacagcggtgaaaggaacaaccacgcagttgcgatgctaaaataacttttcttgctcaaattttgaggtgctagtgctagtaaaagtgttttctgcatttaagagaagaaaatggatgggcatatggttggattggaaaactttaactatgcggtaatttactctatatatttgagaaaactaattaagtagcatatagaaagagctagtttacccaattaatgcatttaaactgactattcattgatgcaaataggtggcattaattgtatggacaaagattctttttatagttcaaggtgaatcaccaggataccacatctatcctaccatcactccttagtgggatgtaggaaatcatctctattttgaactgcaaatactttgcgactattctgagctcatagctagtaattcagttttaaaagacggatagctgaatataattatgaaaacttcaataattccatcaaaataggtattgcagaaggcctggatgagtaaaattaaaataaaaagttataactcacaatagagaaggatgatagggaaatggaagggaaaaaatatcctgcagacaaatatacaccatattagcatgcaacccaaaattgagcatattaaccattcaatgatctaccagctaagagaattaaaagtgtaaagaaggatctaatccatttggtccaatgatatatagcaatgctaggataagtatagcagtcgtacaacaaaaatactgaaaatggcatgtagatagtagagtatcgaagcaaatcggatcttcctgcatataaatcatccatttaacttaaaatctagttctattagtaccaaatctaagtcatctagaaactacattaagaactaagtgggcagagagagcaaacatacaaagaaaaatgctaatcagtaagtgactgaaagcctacctaatgcttgaaatacaaagagcatcaaaacacatattatctgtacattatctataagagctcctctgacgttacatatcatgcaatttgaaatgtcccatttgaattatatgactttatgtagaattgcaacacatttttttgctatgacttgtccacacaatagaaaaatggtaacataagcatatgctatttttatttcgatgttgaatttgaaaaatagaacatatcagtcggctagttcgtacaattgcttccatgtaggaaaatataatatgtcaaagagtagtgaagtattatcaatgcaaaacagctttaagttcagttaaccaataaatttgaaagcagcaacagtaccaaaacacataagtcctgatagtataagttggtgatctgccttagtatggatttgttccctcacacgcgctctttgcaaacacctagaacattgtccctctgtaaaaagcacattatgcatatcctccctgcagccaagtttagaaaataaattgttgattcaatattaagatgcaaaattaggatcaggggatattcatagatcgatccaggtttttatttaatgatggataaagatggtaccagtcagtagctgcatgacgtaggagacggtgatggccccagcagctgagttgatgaactcggcagactgtttgtcgaagtaatgaatgacgacttgaactatgtaactaaacaaaatggtattcatgcaaatggggaatgatggagtgaaggtgaagtagaagaaacagggttggaagggaagactgggcataggtgttcaccttgaaaggagagacggtagatcagcttgtttgaacaacagcagcgcctgacgatggagacggatacgccctggacgcttcaggagttggcatccggaaggctcaaaggattcgcatgagatggggaaataccacatctcgagctcgagctcgcagaccatcgagatgatgctatctattgatgctgcccctatggcaatcgatgtgggacgaactgccatcgatgggctgacgacgatggaggaaaaagcctgcaaggacgcgagaagagtgagaagaagagaaggggagggaaagagaggggcacgcatgccatgccctcactccgttgcgcgaggcggggaaccggtggcgtgcgcggatgcgtcgccgtccgcccgcgagagggctacgacagcgtggcggcggatgaggccatatgtgagcgggccgcgagcgctgctagggttttggctgtgtggggatatgttgggaagatcttgaccgtctgttgtcctctcgtcgatctgatggtggtggaagagccggcaccgtaggccaggtggacgactggatcgatcccaatgcggcatcgaacggcgccatggtaggtgaaactcggacgtgattaaccggaagaacagggttcgaacgcaattaaccggaagaacggggtatttttggaaaaaaaaaccgatgacatggcgccttaattttccagcactcccacgacgtttagagagattaatataatcgtattgttcagtactgtaaatatctctgaatgaataaatatacatgaatttcacaaggtatgtagttaaaaaaaaagaaaattattcgtggtaaagccattatctagatttctcggaagtctatttgggagggtagtgcttactccctctgtactcgtaaaggaagtcgtttaggacaatgtttaagtcaaaccttgggaatataaatcatgaataactctcaagttgttgagtttgaaaatgtaaaaattatatgaataaatttgtcttgaaaaatactttcataaaagtatacatatatcacttttcaataaatatttttatagaaacaagaagtcaaagttgtgttttagagactgtgtcgctgtccaaaacgacttcctttatgagtactgagggagtatttcccagtcttcctctctcttatgtttcaggagttggacttttaacaaaatagacctagctttttttaggtttccttttctgttttgttcccctgttgagatggtcggtccgatcttcgtgttgtgtaacaaactttcaaaacttcttctaatatattaacatgcatgtaaggtttttgcgcgttcgcgaaaaaagacattatttaggcttcttgaactactctcgattatttgatattgttaatagttaaattgggagcactaataataggatacaaatctgagcctctacataacacacacagcccgttctcaaggatgttcgagaacaatctttggctctagaaccgaaccattttttggtattgtacacaagcaaattaaagcattaagttctagctggtgatggatcgatgagccatgcgatgttgacgagctgttcaattagatgtcgttcattcctttctgagcaatggtgctgttctttccttacattctgttgttaataagtgcagaattaactactgatgaaatacgaatcgactaattttattaagattgcatgataaaacagataatttgagactcatatagtatttgaagcaatcgaataattcagacgtcaatgccaatcaaatgtataatttggataaaaactttcacccctaaatcccgcattgtgcttcacccctacttggtgcatttggagcttaggtggctgcagctggccaaaatattcaaccaatttggagcttggagctttgggagaagtggttcttctgttctttttttgtttaaatatgtaacttttattcaaccgatatgctcttgaaatttggccacgcccacatccaatgcctaggaggaaaagcaaatacaatgtatttaggcataaatcattgactcgagaaaggcatctctaatgatccaacttagcatgggcacaattttctttaaaacctcatcaaggtgtacttgtattaagaaggagggaacactgtacaatagccttatgggctaggagttacatgtaagaaaaaaagaaaagaagaaaaaggggattggaaggactatgggatgtccaacatgtccgagtttacagttgctttgttaagattatatgtagtgccaccttgttcgtttggcatcagggacttgatgccttttgctccacccgcatgccagaataaaatctcgtcggtcaccctatctatgatccgttgtagcggtagcttttcattcctgaattctcggttgttcctcttcctccatatttcctaggatactaggatgagaattgacttgatgcctgctcttttttttcctttgttgtcgctttgacgttttggctccaccattcctcaagggatggtgtgtcaaaccaaattctacggtttttgttggaggaggtgggtccgtgttgccactgtgtcctagactttcatggttgttggacactcattgaagaggtgatgtgccgttccgaggttcctccagaagaactgacataagtagttgttgggccattctttttgtagatcgtccaaatcatgttttgtagtagtagccatgcaaagaacttgaatttcgacggcgcccaacacttccacaccatacttgctatggccaagggggccccgccaagggattgcatctggtacgccaatttgacaatgcattatctatttctcttgactgtccatttctagcggatgctatccgcagtcccttgcgttagcgtgatgtttgcggtccatatgcattcaaacacttggaagaattcagcgacgagtgttatggactggtcgtgtctaatgtcatcaatctattcatcaccttttagggcctctgggactgcctgtttcttccttcttgagtgtttgtataggtttggggcgattgttctgagggggatactagaggctcaggttgtttttcaagagagtgcctttctgccgtctcccaaaaaacctttgtagaggctacaaatagatccatgtcttgttcgtcccctggtgtgggcatgcctatccatggtttgttcgagctaatccactcataccatagctagcgtagctggagcgctcgtccttttttattttttaacgttagagactctggatccaccatacttgatcagcatgcagacccttccaatacactttgcacttgcctccatggatctcattgcctccatcccatcccattggaattttctcctggctttgtcaatttcctaggtgagttgcttgggatcttgaacgttgtcattgatacagaccggcattgagcttaggactactaggaccagttctctctttcctaacaggtgctcaattgagttaattaatacatgaatttgtagaacaaacatactcaaaagccacctagtacaaattaaagttgactgatactatcgtactgtcaacagtgacgttgacagtgaatcatctcttgcaacgacagatgactccaatgtcactgtccaaaaatactcctgccgaaccgctgtaaacacacagtggcgatctacccctccatctccatggccgtttctgaataaatctccagacctaacaccaccatgttccattgaatgagaaaacgggcagtaagtttctgcaggagagaccaagcattgcaggcctaattctagcctccggccactacgacatcgcagccaaggtgtttagatccagcgatataaagttttggcgtattatatagggtgtcgcatggggtgtttagggaaacggatcctctattgtagagctaatactgcacaggtgctatagcgatcaaagcaagccatccgattagattaagcggctctgattccgtccttaaacaccgaaaatatttttgataatttggaagctaacaaactgattttaaggaggaaaagtcaagatcaccttgatggagggaaaatcatgaatcctccagagtacttggcgccaaattaatacaggttctccttttgctttcttcctccttgggacttggtgccaaaaggagatacagaggtttcactttgccttgttctgtccagaaactttgatgatcagataaagtaagccatcagtctccaacaaacaggtatgtatgccatgtcttgtactctttttgtgatcatgtcctcacaaaaaaaaaaaaaccaaaagcattgttgtgtgattcttatgattggagtggatacactctacactcgtgtagcgctaaacagagtatacctacagatctgaggccttatggcgaacgactcaaactccaaccatcataattcaaataggtgagatcaatttcattcaggtcaacatagttttatcatctacatttttcttttctctgactatgttgttgatctcattactgaaaaggatcttaataatgaccacatagcaatccatatttaacactgtatttctttgttgtaaaaaaaaaagagttgatccctgtttctttttacaacacaaatataattcctagttggattcctcaatttggcatgaaatttaaatctacaaaagaggcatgggaattttggacttattatggaggtcgtactggttttgatgttaggataaattatgaaaataagagtaaagttgatggagtaattacttctgcaagatatgtttgttccaatgagggataccgggcaatagacaaaagagatcacaacaccaagcgtcctcgtgctgaaacaagaacaggttgcaaagctcggatcagaatcacagtagatagagaagtgggcgattattcagtatatgatttagttcttgaacataaccatgaacttcaattgccttcaacatgccatttgatgccatcacagagaaagatatcatcattgcaagcatttgaaattgaaacaatggatgattcgggcattggaccaaaagctgcacatgagcttgctagtcggcaagttggtggttcagtaaaccttggttatacacgtcgtgttctcaagaaccatttacgaaccaagcgtcaaagggagttgatgtatggcgaagccggaagtatgttgaagtacttttaggacaaagttgcagagaacacttcatttcattatgcccttcagttggattgtgaagaacaaataacaaatattttttgggctgatgctaagatgataatcgactatgctcagtttggagatgttgttacttttgacacaacatttgggacaaacaaagaatacatgccctttggtgtctttgttggattcaaccattttagagagaccgtcatttttggagccgctcttttgtatgatgaaacatttgattctttcaaatggttgtttgagacctttttagctgtacataatcaaaaacagcctacaacaatctacacagatcaagatattgcaatgggaaaggcaattgaggtggtatttacagaagcatggcatggattgtgcacttttcatataatgcaaaatgctatcaaacacttacctcgtaccaagaaagaagacaaacattttgtctgatttcagtgcttgtatgtatgaatatgaagatgaagcaacttttgaggaaactttcagtaccatcagaagcaaggtgcacaagcagacttggctaaacagtatatataaggtaaaagagaaatgggcggaatgctacatgaggaatgtttacacattagggatgagaagcacacagttgagtgagagcttaaataatgacttgaaaaaccatctcaagtctgatcttgacattattcagtttttcaataatcttgaaagagttatcaaaggaaaacgagacaacgaattagatgcagaatatgaagcaagaaaaaaattgcctagaattaaaatgagagttcctatattggtgcaagcaagcaagatttacacaccttgtatatttgaatattttcaaaatgaatatgaaagatccatggctgcatacatcaagtcatcagaacataatgaattcattgttgcaattgaggctcctggtgaagcgtcaacatttgaagaggagtgcaaagttgtaggcaattatgcagagcaacaggcattgtgcacctgtggacaatttgaaaggactggaatattgtgcagtcatgctttgaaagtccttgatgtgatgaatattaagtctttgccaaagagatatattttgaagcgatggactcgagaagcacgagttggtgctattgaggactgttatggcaagattgtcgtataagatcccagattggaggataggtgccgcttgaagtttcttattcacaaatttcttggtatagctattcgagctgctgaatctgaagagtgcagcacactagtggacagtgttctagagagcatgaggaaagaagttgatgaaaaaacacctaatagtcaactaggtgaagttgcatctgaagaagcaaacggctctttgcacactgcacgtctgaagaaaaaagaaactcaaaagtgtagcacaaggagaaagaaaaattggcttgataagcagcatcccaccaaaaagaaggtacaagttgtacctgacaaacaaaatatctcggtatgttacttacgaactattcaattagactatatatgtactgattatatatagagtaatattttatctggatggttttgcttagcagcaagcgaaggattgttccatagcacagaaccaaattctggtggagaagactaatggaacgaatgagaagggatctgaagaatatggatggatcaatagctatgcagaactactgagggtattccacttatatatactaaaacttatatatttagtgcatactgtctagcagcatcaatattatttttctaattactctaattcattgtatagggtgatggcatggagcagaacatatttgatactacctggaattttgggttcaatgcaaattttgatgggagatagctagatgcctgggtatcaaattgagaataacaaatcaagccattgaacatttacttttgagaacatccattcattttttttcaatgccacagaaaatttatgctatgcattcttctgtcagtgtttagtactgaaactatttgcacacatgcaagtacctttgtacatgtttctatcagagcattgtgtttaatcttcctgaaaccttttcttcagagcactattttatagagggtgtaaatgaacgatgcaacttttttagtgttacacaacttttttagtgttacactttggaataagtgtagacttcatagtgaggcgatgctctgcttatgatattgtctacacagtgaggcgatgctctgcttatgatatttgtagaatatgtgaaatgggaggcatatcgttagatgaacagcacatcatatatgtataaacagagtctgaagctttcatggccttagccatgtaactgtcaagtaagtggtgggcagattgagcagaatcagagccatccaatgtaatctgatggcttcatttgatcgctacagcacctatgcagtattaactgtccagtagacgatccgtttccgggtggttaggcactaataaaaaatatttactgtagcaccacataattacaaaattcgtcagtaaaccacgagacgaatttattaagcctaattaatccgtcattagaaaatgtttgctgtaacaccacgaatcggaggcgatcgacctcgctgcgtggcagcagcgagcgacaggtgatttttactgcgggcacgtagtacgccggcggggatgcatgcacacctgaattcagtggccagcgttatggagaggtaccaatgcaaggacagtaatggcggccatattcggcgcctgtgagcatgtttaggaaagtttctgtcagctacaattttttctataatcaaaagctttcttaaatagtttagcatttttatctaaattctaggaatttgcagttactgaatttaaaaaataaactagaagctgagaaatcagcttatttagattctcagaaactggccactaataaactaattctcagaatcgagaatggtgctacagtgtgtcaagtcagtggcggatccagaaaagtttcagagtctagacaaatcttatgacattaagggtgtgtttagttctttgggtgtaaaatttttgacgtatacggacacatatttgaagtattaaacatagactaataagggcatatataaagatagagacaggtatgagctctacgctatctagagactaacatcctacaacagttggggacaatatggtctctatcattaatgtatcaaaatatttttatcaaactcttctttcctttttttcaccaccatgcaacaaaatttactctaataaatactaagagtcgactctgaaccgttgtcatgcataacaaccatatttctctttcctcctttctctttcttccatgtcatcaaatttacttgcatggtaataaaaaaaagatcattgtacatgccctaacaaaacaattgtacatgccctaacaaaacaatttacagattatgcctgtaaattacgatacgtatttattaagtctaattaattcgtcattagcaaatatttactgtagcatcacattgtcaaatcatggcgtaattaggctcaaaagattcgtctcgcaatttctatgtaaactgtacaattgattttttttcatccacatttaatgctccatgcatgtatccaaactttgatgtgacgttttttgccaaatttttttggaatctaaacaaggcctaagtgtttgcctaagtgtttgttacaaaaattttgtttccgtttataggaaaacattcaaattctattgcgcgatccgccctggtcgagcgtggctggcaaagtatagaatgatggggagagcattttgcttcagattgtatgtctgtgtagggaaattatttgtggcagtcagctatcaaattggttctcgcttataagtcgtcgggaaaaaaaaaattcgcgccaaacacccattcataaataggccaattttcctaagtagattataagttttttgaattggttggtgcgtgcaccttatttaaaaatcattgtgcggctcaattatccccacgatcttagggcaacaaatggcatcgttgcataaaaattgtaagggcaaggatattattccactcctttttaccagaaaagatattacccatttaaaacatcctcaatatctaggttcatcccttccaagcacaataaaacatctctaatactaagggtgtgctcttttcagcttataaattagattctactattttccgttagcacgcttttcaaactgctaaacggtaatttcgtgcgaaaactttctataaaaaagttgttaaaaaaatccaacaaatttattcataaaaaatatatattaatacttaattaatcatatgctaatcgtatttctcgttttacgtgcggctaaactgtccaccgccactgctgaaacgatcgcaccctaagactcgggtcctatgtaaatgtcaggttggatcctatttataatttggcacattttttaaataaaaaattgggtgttaattgtgtccatttacaaattacaacatgggagtattttgtgtcggtgtaggcaggcaggtgcatgatgcctggatgatcataaaacaacattggattctctggctaacaacatcacctaattagtagtactagtatttgcgatgacgaaaacaagcactacctgaaaatgacttatctctacaatatgcaccatcaatccatccatcatcaccaccaatttaccaatgtcaatggttggctttttcatctttcttttccatcatgctgatgttttccatgtgacatttgtgtaagagaggatatattaattaggggtagtagatgctcatcagtggacagatggaggagttcatcacacttcatgccgggggggggggtaaaaaaagaaaagaaaagcaaagtgagaaggtgaagcaagggacaaaagaaaacagacaatgatcagttgcactgcagtggtagtgcacttggcttgcagtttcaattctctagctgttcattagttggttgcctccagcctggacctgacttgtgatcctgtctttgtataaagtggatcaactttggcatataactggtcatatactactttacactaaactaggcttctcatttttgttgcttcaagccttctactatagtatgagctagcatcatctattcagctcttcatcagtagagctgattgtgtagtggcctagtagtaagtagtaggtaagttattataggcacatcctgtttagattgcaaggaacctaactaccaacccaacaaaatgattttgacttaatcaatacttaaaaggaaaactagttcagaattagaactgacctcaaattctgaatgtaccttttgtttcaaatgatttggaagcaggcgggaaaccaatgggcagatgttgtaggagaactttgaagcctcctgtcacaagtctcttgtgtggagcattgatttctgaccaaaaacttgatacaagtgaaatgaattcagagagtatgacatggattgttctcaatcaggggccgggagaagaattcagtgcatgaggacaaggttgaattgatgatggagaaggcatccaaagataggaattgtagcctcacagtttcagcaccatcaatcaccagtttcatcacatttcaatttggtgtttgcccccagttttgaattcgacagaaatgccagccagctgcattcagtttgtgctcttcagtcttcacatgatcggcatgtttggtttgaactttgggcatttcaagaataggagatccaatgtagaacttcatatctgatagaacaaaatggttctgctccaggttcaatccaattcagactcagatcatatactaatttgagatcatgaacacatcacataggaatgaaagaataatcaataattgaacaaaaattccaggtctttcctaccaaagaattgtacaccgccaatcgagcgaattgggaaccccaagaatcaccacccaaaagaatcaaaatcccccccaaataaccaatctgaattccgccgaaaagaacaagatcatcttttctctctatccattctccccccatcctcgcgcggcaatcgccgcggcctcccttcaccgccctgtacagccgatggcgaggggtggcttagctcacggcggcaacagcagcagcaatgcaatgcaatgccatggaggatcaccattgcaattgccatgaacccgcgcaaccaacaaaagaattattgtgtcccagtatggcactacagctagagatcctcaatttctaccaagagaacaccaatgcgggccacgtcgtcgacgtcgacgacaacgccggcccggacgccggcgaggaggcggcggcgccgtcgtccccggcaacgtagaggtcgtaggacttccaggtgtggtcgagcgggcacgggttgccggcgtcgaggcggtcccatggcttccccttgcctgaccagtgcatgaggctgaccggcccgtcgtggagcgggcggcagctgccgcgcacgttgtcgccgccgaggccgtgctggttccagcggtggtcgacggcctcgacctcgccggcgaagacgaggaggaagggcggcagcgagcccagctcgtagatgcgcttctccttctggatctccatccaccgctcgatgcggtggcggtagttgccggcgcgccagcggcggaggtcgatgaccatgacgccggtgttgaagtagcagggcgggcggcggcggccggcgaagacgcggcggccgaggcctgggtcggaccagaacgccggggtgaagtagcgggagaagttggcgtggcagtactcgggcgccgcgacgacggcggcggcggggaggcgcgtctcccagaggcgccgcacgtcgtcgacggcgagcacgtcggagtcgaggtagatcgcgcggggcacgcagcgcgggagcaggtcggcgaggtggttccgcgcgtagttgagcggcgactccagcgcggcgcgcacggacgccgagatgagccccgccacggcctccgccctgaacgcgtagatctcgaaccgcagcgacgggaacgacgccgccacggcgcgccgcaggtcaccaccacccccaacctcctcctcctccgccaagaagtggaagaagagcgactccgggcaggaggcgtgcttgagcagcgagtacaccgccgccatggacccgcgcaggtagtgcgcgtccagcgtcatcgagatgtgcaccagcccagcgtcacacacccccgccgccgccgtcgccgccgcgggacacccttccccgttcctgtactccggcgcctcagcgaacctcggcagcgccgccgcctgagcgcagacggccagcagcagcgccaccgcagccgccgccgccgcggcccgcgccggcatcgcggtttcttggattcttgcagcctcctcctcctcgtcccgtggtggtggtggtggtgggagcagcagcagcagcagcagtaatggtgggcagcgagtggtcggtgaggcgtcgtatgtatttctctttgtgtctgcgcgtcgcgtggatggatggatggatgacagctgagctcggtgcgcgtttctccgagggggagacgaacggtgtggtgttagcaattcggacgaggggttttaatcccttgcgtgattgggatacgcgttaattagccgctctgtccctctatctcatctcattttaaggttagcggtagatttatatgtctagtgtttaatcgtttggcttatttaaacttttatgataatatttttattactacttcttccgtttttatgatataagagattttaggtgaatatgacacatacaaatatagagtatatctaggttcgtagtattataatgtatcacatccatctaaaatctcttatattatggaataaagcgagtagataataaaatataaataatactttatgtatgacttattatatatatatatatatatatttggactattaacgtgctggttcagccatgtgttgtgctccagttgtgtgcatctttcttctttctttttttgggatttccaaggcttgattgtcttgatagctgttgcgcatttgcatgttctaaagaatatttgtgccgttgtaatttgggttgtatttattctagccgacacatgtagatggtgggtgaatttctagagcggaccatgggtgactcgagtatcataatattatatatctgagctgtggtttgattcgtgttatacattaaaaatattcgtctgactatcatatgtatgcttatgtcatttttactattttgattcacatctcttggctatggtgacatctttcaagactatcttagtttgtcttttcgtagcaactttttttttgtcgtaacgtagggttaacaacgaatatatctggtcaagacttttggttgaccgctaaagatatttcagcgagtcttccgaatataatctcgtcgcttagatttagggggtgtttggtaattaggtactaaatttagtagctctcacaaagggacttatatttttataagagggactaaaggttatcttgcacgatgaaaaattctagcggcttttctatggtggctatgcctagatatacttggtaggtatagcattttacctttagtcccttaccttttctatgagtactctcttcgtcccaaaatataagtatttttagtataatgacaagtcaaacatttttaactttgactattaatagcaaaaaaaataaaaaatatcactcatgtaaaattaatgttactagatttatcattaaacaaactatcacaatatataattctctttatttaaaacatcttgcttttatttcatagatattgttggtcaaagtagtatatcagagaccgtgtcagattctaaaagtacttatattttatattttgagacggatggattaggagtactagggtatcaagctgaatgcatgaatcacttcaataataataataataaacgctgcaataaaacaatgttttgtcattggccagagagcttgggctgcagttggcctctactctaccttggggatcttttactaagaacacttgtcctccacggtcattagcaaaacatcaactgtttctaaacaaagttaacatatcattcagcaatacaagtatctagtgtatgtatctatgtacctctactacattagaatggtcctaatctagcgacttcaacgcccgtgtgatttggcgcagagtggcaaccgaccacccaattacccctaaggcactaatcatgctgaacagttgaatggttagtataaatccattaggacgaagaaaggactttcatgtgtattaaactaattataacattcaagaaagtgattcactggggttgatcggcttccatttacaacgttgtttcgcagcttcgagccagtttgattagtttgatagatgcaagaggtagtatatatgtagtagctggctgtgtggttgggctgtaaactgcagttagacaaaccaattgtcttcaaaatataaggagaaaagcccacgcaccccgcaaaattctacatatatataaaagggagatctagagtcatgaactctaaaatttaccatctgatctgatctcttgaatttataaaagtaccgttgtataaccctttatttcgtctaatttatatgtataagtacgaaattaaatgtgtagtttaaaatttcaggatattgtgagataggctttcaagtacttcctctatttttacataggagtatatctgtaggtacacccatttgtttttataaggccctatttagttcacacgtaaaaactttttacactgtcacatcgaatgtttggatacatatatggagtattaaatatagacaaaaaaaaaattatacagattgcgtgtaaattacgagacgattcttttaagcctaattgctcaatgatttgataatgtggtgctacaataaacatttgctaatgacgaataaattcgtctcgcagtttacagacataatttataatttattttgttattaatctgcatttaatactttaaatatatgtccgtatatccaatatgacgtaagatttttcacgccttgatctaaacccagcctaaactgcccgcacgaaaaccggatatgggaagttgggaactaaactccccgcacagaaaacggagcggtccattagcacgtgattaattaagtatttgctaattttttttttcaaaaatggatcaatatgatttttttaaccaactttcgtatagaaacttttttaaaaaaacgtactgtttaatagtttaaaaagcgtgcgcgcggaaaacggggaaagggttgggaacgtgagattgcaaacacagcctaagtacaggcgtgtgaacgccagccaatcacaagacagggagccggtaggtgtaactttttcaggagtcacagcgacgacagcgagagcaagtctgaaaatgacagtggttgtcactcgtcagccggaaaattactgcggatccggggatctaaacccacggctcgccggaatccgatggtgttggtatagccccactccctccctacaactgttccacgtgggccaccggcagctcacgctggccggggcccacctgtcagcggctgatcttcggctgccgagccgtggaccacgactagccagaggggcttggtccttgggatgctaggcgtgcgtgagagtaggtacaatagcagactgtattaatacggctataacagaagaaaagaggagagagagaagaaagcgggctacagatttgtagccggctgcaatatggaatcaagatgttatgtgtgtaagaggtgggactg

SEQ ID NO: 61009 - DNA, 3373 bp, Oryza sativa
tagttaactattgtatgaatagctattatattggctataaatgttttggagcgctattgtccttgctctgatggaactgaccgtgcgcacgtgtacggcgtagtatgggattagaggattaattatcgtaaaatctaaacggagaggcctctccgtttagcgctatcgcgcgacgcgcgtgacagccgtcgatccgcgcttggtgatgtggcgtccatccggcgcgctccgcgcgtcccgaccggccgaccgagcgagctcacgcgtcgccttttccgaccgaacgagcgagggtttactgttcaaatgttttgggtggcgctcgacgagagagagagaggcagagagtgagagagagagagacggaggtggcgtgaatctccggcgaaatccgtggcaaaggggggtgcggggagttgctgctgtttcctcccgtcgcgtcggcgttagcggagtcggcggagccgacggtttcctctcatcgcgccggcagttgcggtgggaagcgtaggctgcggcggaggtggttttctctcctccaaatccggctgccatttttttcggtaagttgtggcggtttcgttgtggtttttttgagccgaggaggtggagtgatggggctgtttttccgtgcgttttttgtgccggggaggtggagagatttgggcagtttttcactgcgcaaattgcttctcaaacctcccgttttgttctcccctattccctcatttcccctctctctccctcattcatcaggtgctagttcatcctctcggcgagcgcaaggttgcggtggaattcgccccctcaagcgtcggcttgtggatctcgggttccatttgaaggtatttaaatttctctctctctctagcttatgtagatttttctggttgcaagttgattactagtgattactaacatccaaaatgaatttccaaaattattactaacattattagttgcaagttgattattagttgatcgatggttagttgcaagttgattactaacatccaaaatgaatttccaaaattattactaacattgttagttgcaagttgattattagttgatcgatggttagttgcaagttgattactaacatccaaaatgaatttccaaaatgattactaacattattagttgcaagttgattattagttgatcgatggttagttgcaagttgattactaacatccaaaatgtatttccaggaatgggaaaaagaaaaaccattgtacagaaaggcatgttaggcaaaccagagccaagtgaaaaaacaatgggggtttcacaacgtgctaagaaaagaagtattggagatgatcatgcagatgacatagagcaacctcctccaaaaaggagcagatcaaaggtattaagcatccaccttttttatgcattttttgccctcaagcagtgtttcgctttttccaatgcactacatttttcttatgatgcattaagttacttctcactgtggattaagttacttctcactgtgcattaagttacttcttttaaaattcctatgagatttctaacaccagtactcatggctatgtaactagggaatgcaaattcaagtttatttttggaagtaacttgcatgtttctaggaagtaactttttgagttttataacaagtaactttctgttcaaattgctctgagaggcaactagatggaatgtatcatgctgtgtaactagggaatgtaaattcaagtttatctggaagtaagttgcatgttcataggaagtaacttactgttttgttagaagtaacttcctgttaaaattactttgaaattttctgttaacaagtaagaagttacttctcgatgtgcctgaagttacttctctctttgcattaagttacttctctatgtgcattaagttacttctcaccgtgcctaaaatatttttgatgctgctgcttgagggcaagttattttctagaactaacttaatggcaagttacttcttggttcagttacccttttttcaactgttttatatatgtttttgaaaaaataaacaaatgctgatgttttttttatttttctttttgttgttttatacatttgcagtaagaaagtagcagggcttcacctatgaaacttataaagttgtatccccatatgagtggcgaacaaaagcgactaatagagggggctggcttccatggcctcgtagatctcaagtgctcgaagctcagacctgatttgtgcagctggttgatggagcatttcaatccagcaaccaattagcttgtattccctggacgtggagccatagatgcgaacgaggagtcagtgaagtctgtgcttggtatcccaatgggcgacaaagatgtctcataggagatggaatctgaagctacagaatttatgctgaatttgcttggaatcaacgatggtatctcaccatcactgacttctcttgggattcaattggagaagttgaagttagcagatgacaagcacctgcgtatgtggatcatctacgccatttcttctgttttagcaccaacgacagcaacaacagtcagcccaagatgctatccttctgttgttgatgctggaaatatcaagaatcttaattggtgcaagtttgtcatatctattttgcaaaaagctactaaagctgggaagactaccaactcagcatgtctcctgtatatgatggtaacaatgctcgcctttttttattcgatcactgtcccaatgtaacttttatgttttttagaagtaagttaagttgtccaggaagtaactaacatgttcctaggaagtaacttctttctgttaaattgttataaataattttctgtcaagtaaattctctctgtgcattaagttacttctcactgtgtattaagctacttcttactgtgcattaagttacttcttcatatatgccctgccacatctttttttccaatttatttttaaatttaaattacatctggaagttaacatattttgtaggttttaaatcaaacaagttatgtactttttttaattaatctaaatgctctaatttcttttgtagattctttatttggactcgctttcgtttaaaaatctcaatgttccagtggagggttatcgagctactgtttggacgaatgaattgataaatcaagcaatattagcagacacatcagcagacggctcctttggagctttaccagtgagtttttttatagttggcatacttgcatcatttttagttttttgtttgttcgtaacttatggattttataattgaaaatatagcttaggagcagttttcagcatgaagggaccaatttgtttgggagcaatgtagatttttcaaccttcataaattcaaatgtgcccaatagtat

SEQ ID NO: 61010 - DNA, 9328 bp, Oryza sativa
  unsure (1)..(9328): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattagttgaaagaaaaccaggagctaattatacaaagcaccaggttattagcttctaataatctaattaagtgagagtacaccactggtgagttgtgacacgcaccttgatcgaaaccctcctccactacactcgccggatggttggtgcagacagcagcaacccaaccgctcgtctgatctgccttctgcttaccttccttccctctcacgcgacagagagcaatctaccatgtttgctactgcaaatttcagagaagacgacactgaccagatgctaagagctactaactcttttgttagtgtgccaacctctgcaatgtggtcatcaatcaaagcatgtatatgtgtgtaccatctttgcaaaaaggattccaaaatcaaaatgcctagcatgtaggtccaacgactatgtgcggttttgatgttttgggttagtgctggtgttcttggatttggactgttgatggttctttaattttgacagttcaggagaggacactgaagaacatccagttggatgttggcaagctaattaatcagaaggttcttgtaattgttcctccaccaaattgtctggtttgtggttatatgctttacacattgaattagagctttttttttgtaatggtgattgtattccattttagagttttacacatggatattcactaattattctacccaaatgttgcagtgtggttacaacttacaacttaatttggtcattgacttatattggagattggagttaatcaatatacatgactctacccgtcaggataaaatattaccgtcaatattaatttacgtacatatttttgaaagacttttaattgtcgcactaataaatttatgtctcaagtctgtttgagagtgtggtaatgaaaaaaaaaagaaaagaaaaagagtcagctagctatgtgtacatgactctcaatattataatctcttctccgttagcttaatgaacaagatttagccagtgatgctcatgtccttcagacacatctaatcatgtcgttatgacgtcacacgctcgctttaaaaagcaggcatgctgttccgttagatgacacatatctttccttgcttttatatttttcctcttcttattttccccctcattcctgatgatagtcactctccaaaatggtttgcgagccacttttcatgggacgtcatctccacaaagctacgcaaatttagtacagaagtatactgttttctcaccttacgattaatcacctaattcagaaaaagattttctcaacccctatagatttttgtttaagatagtagataatccgaccttacttcaaaagaagctatatccacttattacaaaattgttgaataaaccaaaagcgatcttttgtatgaagtaattatgtacttgcttaattttgccacgtatatatataggtctatatataaagtttgacaatgtctagctagctaattggtttgaaatatactctgttagaaaaaaaacactgtgtagacatggaaaattcaaaatatgactgtcacattgctcaaagtatcacatcaattcctactgccctaacaacctaacaagtggaacaattacccctaaccatgtaggattagtggaccaaatcaatcaatagagaatatttatcaaatcagcttattggcaacaagatatggtccacaatgcatcaaaggaccagcattttctccttgtccagatggaggaaccctacatttgcaactaaacaagctgcaggagggaataattcccccaaaaagatgatccctagctagttgaagccagtgcaatgaaaaagacacccttttctttggcattttttttctcaagccatggtaaagctaagctagatacctcattgtcaaaagggaatcaagaaagaaagtttggtaattatttggtatatatatatatatatatatatatatatatatatataactcactttaaagatatatctttgtcctctttatatggtgggaaatgaagaggaaaaaagccttgttcatactggtatttcaaaatcaaactacaagactagttctcactggaaaactagtttgtggcatatggctaggcacaaaattgtgcatatggtctacccagttcaagtcgtatactagacattgttgtacatatcaaccaattttagaagaacatatacgtatgcacatttaatgcgagtgcgtatgctgtatgcatacccacaatgagagagtgtaattacgttgtacttcccaactgtactttctaaaaaaataccggttcacattgatttagggcacaaattcaagagaatttaatggtgtattagcacaattgaaaagatccatacctgaaaacaaaaatggttaaactgcaatggaatttattaaatttcccaaataaactagtgtgcggttttccttttactcatttacttatgaaacaaaatttacagctatttctagaacaactgtcagatgccatccctgaatgttcagagctatcttgatcactcgagagaatcaggcggctaacattgacaaacaacctaattatatatatttgatttgccaacaccagaacctataaaactatttgagtcaaatcttcatgtacccaagatatatataaaaccaaagaaggattatcttcagaagtatatcatatcatccacaaaactattggagcaggcatacattttattttcttttgcagacttgtacataatctgtgacatttacactaaggccgagtttagttccaaattttttcttcaaacttccaacttttatatcacatcaaaattttcctacacataaactttcaacttttccgtcacatcgttgcaatttcaaccaaactttaaattttagcgttaactaaacccaccctaacgttggttacttgggcgtgcatgcgtggacggcatttagcctaggccctttttaaagggagtccaaagggaggtgcaacagagtcgttgcaccgactgttctgaattcaatgtaacccgaaatgggcagcctaacggccaaacaaattaagaatttttgttcatttcgccctttaggatagtactatacaatagtaacaatggcctccgatccttccgttctggagttccctttcctatgttgagcgcgctattccagcgaaatctactataagaactaattaaagccacgttctaaaatgtggtttaaaacaaatgattagtcgcacgtaaaatgtgaaaagcgataagtataggattgattgagtattacttattgaaaactataaaaatggatttgttttatttttaatgcaacttcatttctacataaaacacaacgtttattagttaaacgataagggtaacagtacttgtgtacacaaatgcaatactttctgaaacttggagaaaattttacccggaataaatcctccgtccacaaccgtggcagtctggctcgatgacttgatctctacctctccttttcctcgtgacacgcatatagcgcgaggaagccatgctggctaccggcttaggccctatttagttcctaatacaaaaattttcacacttacatcgaatgtttggatacatacattgagtattaaatgaagataaaaaaccaattacacagattacatgtaaattgcgatacggatcttttaagcctaattgtgccatgatttgataatgtggtgctacagtaaacatttgctaatgacggattaattaggcttaataaattcgtctcgcggtttcctggcggaatctgtaatttattttgttattagactacgtttaatattttaaatgtgtgttcgtatattcgatgtgatagccaaacccaaaaattttcccgagctaaactagccacatagtcgcgtcgacttttgatcccgtttaagaacttttctaaatggtcttagtttaggtaagtttttaagaaggttttgatataataagttaatttttttatacagaattgatttccctagctaactgtatatttaactaagttgtactatatgctggttataagagaaatcactagaaggctcatgtttcttctctctttatcccctctcttttttatcgaataaaatttaaatatatacttttatttttaacgttttgcatttatatacatgtatggagaagaattgcgaaaatatacctctatgacagaatggagatgcgggacggaggtagcgccgctagctctgcgcagcgtccgcgcggcaccgtcgctcccgcggaacgtccgcgcggaaccgcacggaatgcctcgctcccgtgcgccacatacgcgcgaccggcgtggcaaagcaagcagcacttgcagcgcatgcattcagcgaaagcaacgcatgcattccttcgctcgatcggtcccgcactgctcttctgcatgaccgccggttccgcggaatggtggtgcgggaccgagatggtttcgcgtatcccctatgcagtagatgtatatttgttcaaaatttcatcgcattggtatataaacgcaaaacgctaaaaattaagaatttttgttcatttcgccctttaggatagtactatacaacagtaacaatggcctccgatccttccgttctggagttccctttcctatgttgagcgcgctattccagcgaaatctactataagaactaattaaagccacgttctaaaatgtggtttaaaacaaatgattagtcgcacgtaaaatgtgaaaagcgataagtataggattgattgagtattacttattgaaaactataaaaatggatttgttttatttttaatgcaacttcatttctacataaaacacaacgtttattagtttaaaaagtatgctaacgaaaattgaggaaaaagccaagttaaaactgagtttagaatgctcatgatcgaaaccaatgagttctaatgtgcaaatatagttttggcatatatttttctcacggtcgagctctatcatgcattttagaaatttttatgatggtagtatagaatgatggtgacttttatgatattggagtagtacagaactatgctatgaaaatatttgtggcagttttaatagaattttagtgatattagaaatttattgttgacgttgtcactttgaccatgtgttaagatggatattcacgagtgtttgcgtatacgtcttctgtataattcatttccaacaaaatggcagaaagttggtcctgatcaaatcactattttttgttggcactatgcaaaagtatccctttcataagccgaccagcaagcttgtactcaaaataaatattgacctgtaaatttaattgcttttccatcattaagccatatagtattaatctgtcctgtttagatgggactaaaacttttaaaacttttaagtccctatcacatcgaatgtttagacactaattataaatataaacgtaaactattaataaaacccatccataatcttttactaattcgcgagatgaatctattgagtctaattaattcacgattagtctatgtggtttctcaaaaaaaaagtctatgtgatgctacagtaaacattctctaattatagattaattaggcttaaaaaatttgtctcgcaaattagctttcatttatgtaattagttttgtacgtagtctatatttaatactctaaattagtgtctaaatatagagactaaagttaagtccctggatccaaacaccaccttaactacacctaggagtgcttgtagttgtagttgtagtcatctactcgctccattataaaatataacaacctaacataccaaaattagacacaacttaggttgtgttcgatacatagggtttggaacacatctccttcgcacggaaaacagaacagtttattaacgtgtgattaattaagtattagctatttttttataaatggattaatttgaatttttaagcaactttcacatagaaattttttttgcaaaaaagtaccgtttagcagtttgaaaagcgtgcgcgtggaaaacgagagatagggattgggaacacactgaaacgaacgcagccttagtactataaatataaacaaaaatctatctatattggagtatattatgttgctataatctgacacgggaagtagtatttgtagcgtactgtactcgatcccgtacattctcccacttcaactcgtacgtgtattctttttctaaaagaaaatgtatggtatggataacctcctctctagtctctaccgctcaactgaatgtacgtagacggtccccgttccagattggctagcgcatagtactgacctactcctagcactactgatgagtgtcaaactagggtggggcccactgccaccgctggcgtcatgctgacgccagcacatcaagctccccgcgaacccgatcgaaacgcgctcgtacgtgtaaacagtttgacgatcgatcgatcaaataaaaataaaataaaaaaaaaaaaacaacccatgcatcgatctcgtggccgccgaccaccgtggccgtggggacgcagcgaacaacgtaccgtgtctcaccggcgccgcctccgccttttttttttcttttcttggtcacgaacaggacaaagctcactagtcactaccagggtttacgaatgcatgttttgttttacgtgctgcagaggagaggttcctaaccctggcctcctctccaacacaacctaagatgcagactctacgctgattttcattagctcgtttttcaaactgttcaacggtacttcctccgtttcataatgtgagattttctagcattgcccatattatatttctagattcattaacatctatataaatgtggataatgttagaaagtcttacattataaaacggataaatacgttttatatgagaactttcgatataaaagttgctttgcgttcgtttggagaacagagagtttgtttgtttcgttttccgcgcacacgctttccaaactactaaacggtgtgtttttttaaaaaaaaaatttctatatgaaatttgctttaaaaaaatatattaatctatttttaaagtttaaaatagataatactcaattaatcatacactaatggctcacctcgttttgtttatcttctcaatcccctctccctcaaacacagataaatcattttcttaaatctaaaataactaaaactcaattaatcatatgctaatagttttctcgtgtctatccatatttaatatttatcttaagtgaattcaaccgtgtcagtttaatgtggtccgcggaatgtggctgcctcgggagtcatgacacggcaactcggcgaacaagtgatgtgattcggttatgcatggtttgttggggcgagatggtgaccgtagtgtgtcttctagtatagtacagctactgtgtacttgtatagcatactacttggatactactcgtccatccatgaactgaatggaagactgatgtggattgtagtagcacatttatttgcttcgatcgcgctggttgttcttgtgataatacgctaacttggatgcatgttttgtatgcgagatttctcgatacaagagaaaggctgtgtttagatttatgggcgaaaatttctgccgtgtcacatcggatatatggacacacgtttgaagtattaaacgtagtctaataacaaaataaattacagaatccgcctataaactgtgagatgaatttattaagcctaattaattcatcattagcatatgtttactgtagcaccatattgttaaattatggagcaattaggcttaaaatattcgtctcaacaattagtcacaatttgtgcaattagttataattttatcctatatttaatacttcatgcaggtattcaagcgttagatgtgacatggtgaaaaattttagggtgggatataaacaggaccaaagagtagttccgatgaaggaaaaaaaagtcaaagatagatggttctccaaatgttttgtggtctgttcctatcataaattgtttcaaatgaacctttgccaagcccaaggaaacatagttggttggcatgaaatagatcaaattaaaggcatatggtatgttaaggcacctagcagattcgatacaatggaggaatgtcgataggatataccctgatttcatagatgacacgagaaacacgaggctttgtttgtgtacagatgacatgcatgaatcattttagagatatgagcaacaatcatagcatctggccagttcttatcgcaaactataacctaacaccatttttcaaattgtatttggattaataggttgtgatggctctcttttaaaagatgcatgggcgtggtttgataaattcttgatgcttgcaaaaactgatgttctattggatatgagaattgatggaaatatgtgaggcatactactatgagacttgcaaataattgataattaggattcatgtgattgtgaaatgtatgtgaatggatgtatgtatatataagtatgaggattcaggaaatatatctctgtttctgtcgatttacagcgagcatggctagctatttcctatggctaaccaataaaacaaatttgttatttttgttaaaatcttactgatggcggggttacaacatatcaccgccacgacgagtcatccgtgacgggctttactctactcgctctttgaaccatattggtggcgggttgttgttataacccgtttaagatgtcttacatcggtgatagcagttcgttcgacacagataagttttgcatatcactgattcatgactagaatatcagcaaacaaagataagggtaacagtacttgtgtacacaaatgcaatactttctgaaacttggagaaaattttacccggaataaatcctccgtccacaaccgtggcagtctggctcgatgacttgatctctacctctccttttcctcgtgacacgcatatagcgcgaggaagccatgctggctaccggcttaggccctatttagttcctaatacaaaaattttcacacttacatcgaatgtttggatacatgcattgagtattaaatgaagataaaaaatc

SEQ ID NO: 61011 - DNA, 1133 bp, Oryza sativa
cgccggcgagctcgcccacgcccttgacgccatcaagtggggcaccgactacttcatcaaagcccataccaagccccacgagctctgggccgaggtaactaaatcactctcattttcactctcattacccagttaataacgtacttacgtagctactactaatcaaccaaacctgagagaaaattagaattattcaaaccatgcgaccaacatgcacgcatcgattggctagctagctagctgcagttggcaaaaagaaagaagatttttttttgtaagatttttttttgttttcttttttaaaaaagaaagaacatttgttaggtggagcaacaggacaaagttaagctatagctgggagtggttaattcagtgtctgatcgagacgcgcaaatctcacaccacaccatccccccatgattgtctcctcctcctgctcgcatcacatggaatcgattagaaattaacaatccattcttttctttttagctaattaattctctccatggctttgacaatgtgagctcaaataatgattattaaccaaccacggtgatcgtcgatcatggcgtgtgtgtgcaggtgggagacggcgacaccgaccactactgctggcagcggccggaggacatgacgacgtcgaggcaggcgtacaaggtggaccgccgccgcccgggatccgacgtcgccggcgagaccgccgccgccatggccgccgcctccatcgtcttccgccaatccaacccgcactactcccacctcctcctccaccacgcccagcaggtactaattaattactacttactaatcatccccctctaattaaccccgattaactcactaatcaccgtcttaacaaccacggtcaaaacggtaaatcttttttttttcaacgggttcacatcgaatcgaagacgtgttcctctcctcgttccccgtgccgcatgtgccagctttggcttggccagccggatgacgtcagcgacaccgtgtgaagcttctgtcggtcgtgtgacgccgacatgtggggcccccatccccggtggggtagtagattctccgtggaaggacaaagacatcccgctgctgctaagcacgttgacgtttgcgtcgaattaggttactaattaggt

SEQ ID NO: 61012 - DNA, 997 bp, Oryza sativa
  unsure (1)..(997): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgattttttttgagcttttttgctcacaaaagcatgcattgggtagttcaggtgtgcacccacacggtgggagagaagagatggttgtagagttagcaagctgtgagttttaggcaaggcagaaacatttgactccttgaggaggtggaagattacattcataggccggttgtccaccactccctggcccagaccacgaccatcgtcctgagttagtctacgatccaacataatctccagccatccattttttaagcttgctgcccctagtgactgcttggagtgtactgaaaaccgattgcccagcgaatcctgtaaaaatgcaagtgatggcattgggtagtaattgccctgcaaagggatcttatcatatgtctgcctcctactcatctgaaagccatttagatcagaatagaagactccttggttgtcaatatctgtcttgaatctgacaatcaactccttgtcattaaatacatggccaacaagttcaacatggtattccttctcaatcagcatatcctgtatagagtctccacagctataaatccgtgtgctatgtgagatgggtgacttatgccactgtgtctttggaagggaatgagcctcttgaaccaatggcccttcactaaggatgaaatatcccccttcctcaacaatggattgtgcttcccctattggtttgaacaagtatgccccactaccgtggctgcggtacatgccatttcttcaccaacatcggtgtgttccccatc

SEQ ID NO: 61013 - DNA, 1342 bp, Oryza sativa
aagatggccagagcggcgaagaagttgcgccattggggacagaggaagataagcaacctgaggccgcgtctccagatcgcaaacaagattatcttccaactggatgtagcacaaggaaacaggtccctgttgtcgcaagagctgcgattcagggctggactcaaagggcaggctctacctgacgcttgcctccctagaaaggataagcgtatggcaaagggcaagaataaagtttttaaagagggggatgcaaacacatatttcttccacatgaaagctaaggcgtgagtgtgtgacggcacaagttgattatcggcccttagcatgaatcatgatggtcacatggcaaggggatatattgattcggtgatgggggttgccgacaaggaaaacagagtgatggatcttcaagcactaggtttggtaacagcagatctgtctgacctagaaccgcaattcacagaagagggagtgtggagtgtaatcaaggaattatccagtaaaaaggcaccaaggccagacggtttcacaggtcttttctatatatcatgctgggccatgatcaaacgagaagtcaagctatacaatggcaacaaacacagggtcattctgctgccagtggaaggcccaatgatgctgaaggactactggcccataagtttgattcacagttttgccaaactggccactaagttgatggctacaagactccgcgagcaagattgggaattggcgtcatacacacacaatcagcttcatcagaggaagagccattcacgataatttcatgtttgtggaagggacggcacaacaattccaatggtgtcacaaaacaatgattatccttaaactagatgtacaattatttggtcttttggggttttctctttcaaatgctacagcaccagggttttggcctgaggtggaggaactagattgttgaactacttctcactgcagatacttcagtgggaatcaatgggggtagagggcgaaccttttaagccatcaagggatctgcgttagggggaccctcggtcacccctcctctttgttctggtaatggataccttgcatgccatattgtccaaggctatcgatgcaaggactctggccaaggttgataacaaattggcagcgccagtggtctccatgtatgcggatgtcgcggttatttttgtcccaccaacagaagaagatgcctggccaattaaaaatatcatgaatatgtttggggcagcaactggactacgaacaaacttgatgaaaagtgtgatcacccacatacgatgtgatgaaacattggtgaaaatggttcaatcaattctgatctgcagatttg

SEQ ID NO: 61014 - DNA, 6316 bp, Oryza sativa
agagggcaagagcatcgatttctgcagggcaaattggctcccaggtggaagtattgagagcacaaggcccactctcttcagctatgtcaaaataacaggcctgacactgcacaaggaactacagaatcacacctgggttcaagatattgatggcacgccttcaaacagagtgatctgagagtatgtgaatttatgggacgccattgaataattgatggcacttttctgtttcctctgcatacaacatgttctgcacggccagaagaaatcaagctatggtaaactgatctggaagacgagggcaccttcaaatgtcagattcttcatgtggttggcgatcaacggaagatgtggcagacaattttcagaaaaggggtgccggctatgcgagagggctaatgaggattgtgcacaccatttttgttagctatgttttcaccaacagagtatgacgattcttgagttgggtgaatatttctttccagctgccaggggacatttttactgaaatcactaccaggcttgctcagcagttaacttttacaaatatgaaacaatgactgtacaataggagttacaaaaaggggaaagaaagagaaccaaaaaagagttatatgtcataaactttgtaaccagtcaagcactgtctgacatagaggtagaactcttttgtcctacaactatgtaggagaacttctttcttgaacaaggcaaatctatattgataccttgagaactgtgcctagatcggttggtatgggttgattgctttcacccagcagacctaggtttgacctctcgacccgctcatattccacctggattaaatgaagggttggaaaaatatgtggcttctcctatcttaataccattggatgactagctccttctaggcatcccaacattttttttttatgttgataccttggaagatcattttgttaggctgtttccagatatgctaacatggcaggaacataatctctagaaaaccttttatttttacataatttttaataattttctttgacataatctagaaaaaccttttcgctggaatgcaaactgagtccaagcaatcgtctgaaagaactctagatttgtgttccaccgaaatccaatcctcctccagcattgtttgctaaaactgcatagaaagaaaaggtgtaacagagtttctctttgcccagatgtacaaattgcacatgttagacggcattatccggagcataatgcctcttgtccagcatgtcccttgtgtttaggcaatttgaaaatagcagccaaataaatacttttatcttcatcacacactttcatttccaaatgaccaaatccaaacaaaaggcctcttgaaataaaattcaattgtaaaatctttcggatgtatacgcaagattattccatgttaaacatccatttatctcccccgaagatgcaaattatcaatctctaattgcagctgctggaactcagtgtaggcttgaagagacagggaggtagaaagattgctctagtggtctagagcaaactaccttgaccgattccattctgctctttgcatgagaacactgagctagatgtttggtagtatgtctcatatcacaattccacatatcgtcttagaaaaggactgttgtacccgaagttacaaagcattgagttattccgctgaatatctcagccaagttaatcttaatcatatctcttcaccaaaaagatactttattcaactgcatatgtggaacttcactgccataattacttctttcatcccaaaatgttataacctatgacccatcctaggctgtaatattttgagacgaatgtagtattccaggtgagctagctttacccatggaagatccatggccatgtaaaacttaattaggtgcttcaaaagaagtgcattttgcaacctcaagttgatcactcctatacctcctttattctttggcctgcggaccttatctgaggctgccaaagatttccttttgaaattaggatcaaaacccctccttaggcaatgttttctagctagatcaattgtttctattacagttactgtaagcattatagactatagtagttgtgaagagaggacataactgaatttataggttagagcatagttttttttttcttttttgctctcaagctctcgcaaaaagagcgctatattaaaaaattccccacttcagccccttttccttctagactccgatggcttgcagccgatgtagggaatgagaggggtcgagcttctcttttctcctgtgtcaggttgttcctgtttctcaagttagtctcgtagtattgtaaagataaagggaaccactgtcatacagttgcccttattcctcttgcttcgaatatggatgaaatcgttggtctttgttccaaaattcttttcctgctcaaagtctattaggtattacttcgatgccttctatgggagtgcgccaaatctccccaggaacaggttgtgctggccatggatctgcttctgcatcgatcttcctcgttgactccggtggtagacatacaagatatggttggtttttttcttttcttgctgaggcctcaaccccccttgtgaggccctgtttgggttcgtgccaaggcatgatcttctacaacttgccatgatatccctgctttcaccgtcattgtgtgcatcgacggcctggttgcttttcctatttcttgttaaatccttctttgcataattctgggcctatatgtaacttacccatcttcactgggcttttatgtaaaactggttgtaccccaaggttctttacatataaatcctcagccagtagcgtcagcttgtccctaaagaaaatactaaggttgttcttcctccataattcaagaaaataacacttgttatgagccttctctccatgctgtctgtcaaatgagcatgatccactacccatgaccttgggaagatgatcctttgacttacttccctcagactttaagtcactgacataaaggtctactgggtagagggcccatatgtcagtaacacaggttagagagaaataggttagatgattttaatcccttgaccttgtagtacaaggtaagggtatagatatgtaaatggaatagttcctactacacgcccaaaagtaccagctagttgttccaccttttacttctagtacattacgaggtattacactttgacttatgaaaattcagtttgaggccagtgggctgagcaaaatattcaacaaagctttaaggcaaaaaaaaagttcattatgtgaagccctcatcaggattatagtatcacgagtatattgactaattggtaatccgcctccatcaggctcattgataggtttgcatatcagtcccatttgacatgccttgttgataatgcttaggagcaaatcagctcccaggacaaaaaaacaggggcgacagtggatggatctccccatgtggccaccttactcctcttctacactaaaggttgtgttcgttggagtgagttgggaactaatccctccagcatgtaaaacgaagtgactcattagcgcatgattaattaagtattagctattttttgaaaaatggattaatatgatttttttaaagcaacttttgtatataaattttttgtaaaaacacataatttagcagtttgggaacatgcgcggaaaacaaaagggctgagttgggaaagccagcaaaagaacacactataaggagtttggaactccattgagaagcactgagttagaggcagttacaataatgaaaatgctatatgccaattagaaccatttggatggaaaccccatatgcttcataatctccaaaacaacttcatgctcaatggtgtcaaagggtttttcaaaatccaacttaagattacaatcaaattggtaaaaagaaaaataaaactaggccagcgcatatgacatgtggctcactataaaaaaaaggcctaacacaacttgtatcacgtacatccgcatgagaagagtatgggtgaagtatgcgcccacagttatgtggatgatttggtggcacgcgatataagcgtagcatttagttatggaatcttcaatgttccatccaaaaaagtagggttaattggatccatgccattgcaaatttgtcatattagaaaaataccaaaactatttgcaatattgactgggtactagtacaattttgtaaaattagatccatgccattggtgtcacgttttccatcttcatatagaccaaaatacccttagacattggacctacatatcagtttcatcttccttctccatcctcccctcttccctatctctctcctagctcaaatcccccatggcagccgccgtcgaccaccgcttcaagatcttcgcggttgccaacgccttcaaccatccgctcaaggacgttgtcgttgcgcacctccgtgcgaccgcgccaacttgtccgtcgccgaagtcgtcaaccttggagtcgacaagtactacgccgccactgccatcgccacctcctcctccgatgccgaccccatgctagaggcatgcggcatggctgcgggggtcaccatccttgccaacaagtacctgcaatgtcctcatgctccccggcgtggccagccaccgcctggctcgccatcctgttccgcgccccatgccctatctccggcgatgccccctagctccgcctatgccatctgactccgctcctgactctgcttgcgccatctgcctccgtccctgactccgcctatgccatcagctgccttaggaaggggatggagttgaagctggtggggatcatggccaacggtgagatgcggatcatgcgggagagcgtggagcgtggttcaaggccgggagcgtggagctagcacggtggtgcaccaccgcatgttccagatgtgggggaggagaagggggcgcggccgaccggcgtggaagaagaaaagaattaaaggaagaagagaacgtgacgacaatggcatggatccaattttgtaaaatttcagtggcatccagccaatatcgtgaatagtagtggtatttttctaatatgataaatttgcaatgtcatgtgtccaattaacccaaaaaagtatgcttggttgaatttcattgctaaattttagagccttctcagaccactcggtcagcgacaaattctattcaagatcccaagcatttcaaaatttgtcatctcacttggctagatttcagaattgcaaacaccaagtgaagtgagcatatctcaactgtttaggttcctcagtggaacctggccactcgggtataggtcatatccgtcgacagtgaaacctctgcgtttacttggttaatcttaaaatatgcacataaggtaggtgtctgtgtaaaaattcataaaagtatttacacgttaggagcgcgtgcgtttctactttattttgaaacaagaaattgcaaacacccatcgtaagcacgaaatctctaatgcgcgatcggtcgctggaatctcagcgcggcgatcagttttcattcatttttttttgcgaggctcgtgcacctgctctcgtcttttccaccgcttttttttttgtttcctcacgtggtttcctttttggcaccgcattactttcctattttagtaaatttttgcacctaaagtttttacatcttaaatttacacatctaaagtttatacacctagagtttatagatccaaagtttataagttaaaagtttatatacccgattcaaatttgaatttaaatttaaatattttttatatatagtacacgtaaagtttacacatctaaagtttatagatccaaagtttataaggcaaaagtttacatatccgattcaaatttgaatttgaatttaaatttgaatcggatatgtaaacttgtgacttataaatttttaaatgtataaactttagatgtatagaaatactatatatagaaaatatttgaattcaaattcaaattcaaatttgaatcggatataattcaaattcaaatttgaaacgggtatataaacttttcacttataaactttaggtctatagactttaggtgtatagaaatactatatatagaaaatagttgaattcaaattcaaattcaaatttgaatcagatataattcaaattcaaatttgaaacgggtatataaactttaggtgtataaactttagatgtatagaaattctatatataaaaaatatttgaattcaaattcaaattcaaatttgaatcggatatataaacttttgacttataaacttttagtatctaaactttagatgcgtaaacttgaggtgtat

SEQ ID NO: 61015 - DNA, 3983 bp, Oryza sativa
tggcgtcgccgtccggttgcagggcggtagcggggcccaccacggccgccgcggcggtgcccccgaacttgttgcggtggtccaacccaaacgggcgcaacttgccttggcggcgccccgcgaaccccccgtcgggaaccggaaccggccccggcgaagaacaaagggcgtaccccggtgtgggtgtcgaagtggatgctgcagcagacgcgggtacccgtggtggtcgactactactcccggtggatggcccgctggcccaccgtggacagcctcgccgccgccacgcaggaggtgagattagggaaagatctctcctccactatcgctggaaaaaaaatgcaatgtttgatgaggtgtgtgcgagagtggtaatgaagttgtggatttgtggttgccgccgattgttgcaggaggtgaacgagatgtgggcggggctcgggtattaccggagggctcgatttctgctcgaggtgagtagcgagttgattgatcacgaattcatggtcgaaacgacggggattgggatgaggttcacttgttcagtgcgttctgtggagcgcccatgaaccgtttgatgttttgtccaaaggagagattttatttggaacccgttttgtgtctgacagaggaggggattattgctactagttcgtgatgtctgctgcattgttttcgctggcaatctcatgtgaagttatcagttcatctggtgaagatttggctagtttgggtggaagaactgacaagaacattagcagaaatgttttttccttgaaagatgaaatgaatgaataagtgcctatgcatctatgtgcatggtgctgagcaactaatagaaatgttgctacggagcaaagcattattctgggcatgcatttttggttcaatttctttatagctcaataatatttaaccttttgttgcaaagtagggagcaaaacaaattgttgaaaaaggcgagttcccttgcacagcatcaacactccgtgaagttcgtggcattggggattacacagcaggagccattgcttccatagccttcaatgaggttgtgctccacataatttatatctgattcaaatcaccatgggtgtgatcctttacatactcacatgattatgtaactttcttgctaatgtaggttgtccctgttgtggacggaaatgttgttcgagttattagcaggttttatgctattcctgataacccaaaggagtcctcaacggtgaagagattctggtaggcaactacctctgttgatcacctataagacataggccatggcttgcactaaaatagcactgagtttggtaattcatctcactgcattatcattattttgcacagcactggcattatactgatatacaatttcaatcgaaatgtgtatgttcatacaaccaatttgcattacaatttacaagctcaatttgcagttctgtgatccccatccaagtgcaaatgttatctgtatatggctgtatttcgaactgtcctatcgtaccactttccatacagctctttctgaattagaagctttatactgaaatagaacttccaaattgtatggcctttgaacatcatttccttgatcacaggcagctcactggtgaactggttgacccttcaaggccaggagacttcaaccaagcaatgatggaactaggagcaacactctgcagcaagacgaagcctggttgctctcagtgccctgtctctagccactgccaagcgctcgcactttccagccaaaatgcttcagtcaaagttacagacttcccacgagtagtcccaaaagccaaaccacggtctgattttgctgctgtctgtgttgttcaaatttcacaaggctttggtgaaggtatagcagaggcagagggcaaagataatctttttctactgatcaagaggccagaagagggccttctcgctgggctctgggagttcccatctgttcttgtgaacgaagggaagactgatacgctgaataggagaaaagagatggacaaatatttgaagcagcttcttagcatagatgttacaaggagatccagtgtgatcctcagggaagatgttggccaacatgttcacattttctcacacattcggctgacgatgtttgttgagctgatgattttgaacctcaaaggtaatcatttgttgtccatactagcagttattcatttctgtttagctacattctattattaatttccacatgtagttgcctaatttctttactgtagatgatggggaggaattatgcaaggagggacaagatagcaccaaactgagattgattaacgaaaatgcagtccagtcgatgggattgacatcaggaatccggaaggtacgcacaaattcaatgtggtaaaaatatttttcctcagagttgattaaatttttagatgaattttcacttcaggtgtacaacatggtcaaggtcttcaaggagaaaaggctgaaagagcagagccaagtgccgacgaggaaaaggagtagacggctgaaataacagtttttcaagagattatagtgcaaatgctagtaatataactgagaagcaactagttaaccactgaatgctgatattatcttgtagtagtatgtaattgtgctgctcactcaatttggcagcatactgctgtattttggcaaagctgaccagaagttggcagtgttatctaaacacctactagcagtcgctgctgaaaaactcaacccattttggttgatcaggctaagttctgaatattcctagtctaatttattgctcagccattttgcacattaagacttgacaaccctttttttaacctgacattaattatatcaagaagatttctataccgctgatatttacatggtactatgatttgattttctgacactacaaattgtgcttcgattatttggcaccttggatccactaagaacctaagatggttttacgtgtcattgttactagcgtaacatgttgtgcattcgcatggctttaacctctctttttattgtttatgtattgttgatagtaagtagctgaaattttttataacaattaacaatgtaaatgaagaattacgttaagcgaagttgaaaagtcaatgatagagtgaaattagcagcttgtttagtgagaatacaaaccgatttttttattacatacatgaaaaacgtgcacgcacacatcactacattcattttttgagaactcacgtcactagcacaccttctaacgtacgctcatcgatgctgttgtgttttcatcgtactcaccattgaatggccccccatattatccctttatattttgttggcatacatcgtgtaggtaaattttaagctaataagtttattttgatcatccaattaaaagtaagaattacgaccaaatgaaatcagcaaaataagttgtattatcccctaaagaaataaagttgtactacatataaataatgttaactaggaatggtgagtgcaatgcagatttgatggcaagcgcaatagtgttgtgttatagtaatatttgttgtaccatttcgcaatttagcattaatatacttttttttggcagaatgacttgaatttaaggttaggcttggttggctggttgtcctttcgacctgtttaacatgttcaataacgcggaggcgtagtgtgctagagtacaacccaacaccccagcggaatgaaccggtgactggaggcgattaccgattagggttgcctctcaagtttctactataattgatttcctctcatccacccatataaaaagcacggtagcatagagataaagaaaatcaaatgagcctaatctgggttaatttatatgttaatctgaatttgaaagatgcgtctatcacttaaataaaagaattatagtagccatttgaatatagtctaccaaagttgtttgtaagtaattttatgcatagtttagtataattttaggtaaactaaaaggtaggatatttaaa

SEQ ID NO: 61016 - DNA, 5685 bp, Oryza sativa
  unsure (1)..(5685): unsure at all n locations
atgaagatgcaaaaatggtaggacattgtctgatgaccttgccttatgcacaatcagctcatggaaggttctcgaataatttttggacctttcaacattcttttactgagacttacctatggtctaacggtatgtatgatatcaactattgtatccaatggcccatattttcagttgacgtggcttaatgagacgttgcattttgagttttaccgttcacttttggctgtgttcttttctcccctttcacaactcacttctctcgttttccgcacgcacgcttttcaaattgctaaacggtgtattttttgcgaaagttttctatatgaaagttgttttaaaaattatattaatctatttttcaaatttgtttaggctaaaacttaattaatcttactataattgtgtgcttggttttctatgttgggaggcaaggttgccaaccttgtctaccgaacacagccgaggatatagtgtcactgtaattaaaacaataactaacagaggatcaaattatcaatttttactacatacccttccattacttttatttagatgacactgtctagtttaatataataaataaataaaaaaagatcagaggtagtaatataataactgatatttctttttgggccattctttaaccaatattttcactttcgactagataatttaaactttgtttgtactttggactacctatactctcgattcgagtatatcaatttctatttgttaataaactctcactgtatatgaaccgtttctttcacgtagaatgacgagttagatgtagatgaataaaagagtggatggtggtccaaaataacacagaggtaaaaacccggtttaaattgaaaacattggataaaagatagtccaaaacgaaacatcattaataaaatttgacccaagataaaattctctctctaataaataccaccaatttatatatgtccatacacgcaattcaccgtcggttgctattaaagctgattcaacggatgggaactaatcccttccgcatggaaaatagagtggtccattagcacatgattaattaagtattagctatttttttcaaaaataaattaatttgatttttttaagcaactttcgtataaaaactttttataaaaaacacaatggttagtggtttgaaaaacgtgcgtgtggaaaactagggagaggggctgggaacacagcctaaaatgggagaaatctgcaaattgctcccacccacacgcactgcacaggcacacacaccgagggtccgtggcgctcgccggcgacggatgcggggggaggggaaggaacgtcgatggggacgtactcgtcgccgccacgcagcaggtaatcacgggagaggtgagcgagagatcagagatgtgtgtggaccatgatttggcgccttgatgctgtctgtgacccccctcgtttgcagcttgctgcaggtgacttggggaatgagattgtggtgtgggctgcgccttggatgcgatctgatgacccggatgaatcgtcttcttcgtaaaggcgtgtgagttggcgggagtaagattgatcggtcacacttgctttggtttaacgttgacaagcttcactgtggaggcaccctgttcgacgttttgcctaagagagcctggagagtttcatccagtgtttacacatgaatgccatcctgtgatgtggtgacgaacaaagccagtgttcaggacagcttaggtcagtggctaaggatggttctttctttttttttttcttttgggagtacattctccttaaaaactggccttctcatgattntaaagtgatgattgttctgatctaacccgtgtgaacttgtgatcatacagctcttagcggcaagaaagttataaaacagggcaaaaactcgaagtgcagatcacctaatgctgatattggtatatgttatcatcaccaaagcacacaattggaacaaaggagagttcacattttggtatggttttctacatatttttcaatgatttatgttgtgaagtttgcagaattaaagtacttgatcaacatataccatagacgtgtccaacttgtccagcagcacatgattacaagaacctagtggactagctaccacgtgataaatgcgagctcattttattacataccattgagcctgcattaaagcacaatttacaaaatgttggcctctctcaacactgctggagttgtatacatactgacatacacaaagtactctcagcgttgctttctcatgcaccttccccataaaattaggattgtcattgcataggaaacaccaaatcccaatgcagtgaagaggactagtacaacatctgtggatttctccgaagtgtatgtcataacaatgggctcttttgggttgtcacattgtttggataacggtggtccacacaaaccaatgtttccaagaaaagaattgttggaaaaggtggaaaactgatatgagtttggtattcttccaaccaacatgttgtaggacaaattcagtgttgaaaggaagttgagtgatgctagctccttggggatccccccagtgagctcattcgaggagaggtccaatgactcaagttgattcaacctgccaaactgagttggaattgatcctgtaagggcattgtgagacatgttgagcccgtgaagcagtacaagccccccgacagtctcaggaatggtaccatggaatgcattatttgagaaatcaatcagcataagggtcctcaatatcttggaaattgtcgtgtcactccctttgtatgtaactgaggcagtaaactggtatgtttgcccatggtaatatttattttccatgactagtgtatcattttgagtcatggcaatcatggacttgagcatcttaaaccatgcttctggcaatgttccattgaagttgtttgaggccatgtcagcaattctgagctgcgtaaatgcacagctgttcctgtcaactgtatatgaaggatccattacttgtccagtgaacttgttagacttgaggacaaggacttgaagtttacgaagtttactcatccaacatggaaaggagtcactaatctgattgtttccaacgtcaaggatctccaagttcctgcaagaaactagagatctgggtatctttccgtcaatcaaattgccacttaaatctattgcctcaagtgaacagccttccttgatgctatcaggtaaatttccaacaagtttattttcttttagacttaatacttgtaattcaatggcatcctccattaagcaggatgggatcgaaccactcaagttattgtaagagagatcaaagagttgcaaattcgtagcagcggtacatattgatggtggaatatctccagagagtttgtttctggaggccttgaaagtgagagtttccccaaggtaagttaagtaatgaagaggaatagatgagaattggttgctcgagtaatctaatgtgctgctaccttcttgtggtatcggtatggcccttcaatactgttgaaactgaggtcaaggaattctatatgaagaggaagcaaaggatcagatccaagacttgtaaagttattgtgcgacatgttcaagaggagaaattgcaagcctttccatgtcttccatgcccactgtggtatagctccttggatctggttatgtgaaatgtcaagactaaacatcttatcgagatgcttcaagatattgggaaaagtagacatgctgcaagatgctaaacttaagaactccaaattggggaatgacaccagtgatgaaatattttctccatctaccactactagtttattgtttgagagattcaggacggataggtttttcagttttgagaatgaggtgagttctattgtgccgtcaaaattgttcgaatggagcacgagagtttccaaatgagtcaaatttaagatctgcggaggcaccttccctgaaaacttgcagttgtacagtgctaacttaatcaattcccttaagtttcctattgaagaaggtacatgtccagacaatccgcagttggagaactggagaacagtaagagaagttaggttggatatccatgacggcatggatcctactatctggaacccagacacttctagcaaatccaagtataggaagctacctaacgaagagggcagtgttccagagaaaccacttgcaccaatgcccaacttcttcagagatctgagattgctgatggagctcggaatcatacctgtgaagtttgttctactgacggacaaattctccaagctactgtcctgtgagaaatttggcagattaccagatatgccaggattcttagaaagatcaattgttctcaacttcttgtgctggaagatgatgggaggaaaccatccttgaaacttgtttgtggatagctgaagaacagtgaggttggaaaagccagccaagaactctggcactgaacctgacaataaattgtaatgaagctcgatcgtggtgagcgatcgcatggcagcaaatgatgcgcatacgggacctgacagtgagcagtaaggtaaactaagaacttgaagcttaggtgtgtacttggctatgtggtcacaccacaattcgccattattggacatatccaccattcccatatggagctcctccaggttagtgaggtttgtgagcaaggtctccatgtttggtgctgagagctgcccaatggagtctacagcgtactgtgtgatgctgttttcgtcatcgtaagacacgatgacgaagctcgtggagaggtcgaggtagaccaggctcacgaggcgcccaatgccagccggcaccttgccggcgatgttggtgtccgagaggtcaaggtgtgtgagctcggtgagctgctcgaatccagtggccgggagctgggacatggtgaagatgttaccagagaggttgaggtgcttgagtgaggttaacctgaacagtgcatggtcgaggccgccggcttgcaggttgtggcctcccaagtcgagtgaggtgacacggccatcggcgccgtcgcagtggacgccctcccagcgacagcagtctgcaccagggacccatgatcgaaaggtggtggagtagtcgccggccgtcgcgttgaaggagtgcttcagccggagcagcgcggaagcctggtctggaaggcacattgccggcgtcgtttcggaggaggtcgtcgtaaggtcgtcgagcgtggtggcctggactagctggaggatgagcatcattgctaggagtgatgccacatggtgagggactctcttggagaacgacgacatggtggtgaaggtattttcgcaagtgctgtgctttatccacttaaaaagacacgacacggtgaaatcagtagagggtggtagatttcttgaattttagacgactgtcagaaggactggggtcatgtatcattggttgaaagggctgctggctgttgcctaaacattgtagtgggaatggaagacgtgtagtacatgataactgcagaataccccccaagttggcacacatgtatagtaattgctccagttctgacgacctttgagaagacccgcaaattggacatgttacacatgtataagggtgtgtttagttcatgaactaattagaagtttggttgaaattggaacgatctgacgaaaaagttgaaagtttgtgtgtagaaaagttttgatg

SEQ ID NO: 61017 - DNA, 19009 bp, Oryza sativa
aatctctttttgaaaagaatcctttctcatcaaaagaattaccactttctttggtttgaaaaaaaaactatatctagactctatactactttatactgagtataatgctagtgatggtgtttgagtctgtcttcaatgccacaagctaacatgtgaggctatgtccacacgtatatgattccttaccaaggcttggtttagttcccaactttttctttaaactttcaattttttcatcacatcaaaactttcctacacacaaacttctaacttttccgccacatcgttccaattttaatcaaactttcaattttggcgtgaactaaacacaccccgagtataactttgttgttgtcatttcagaattgttgaaccaacgtaagtacaagtctaagacttcaccgctttttatttgttaattctatatttagaatttaaaattagggtagtagaaactatcagaaaatgtactatgatagaagatgcatactcacaaatcattaatttcgaatttgatatttattttattaagaaagtactccctccattgatagtcatatttcatcttgggacacagaccaaggataaataattctacttatcatccatttaaatatgctactagttattcctcgtaaacaagcgattcattaatatttacattacttgatgcccatgtagttaatcttgtgtggaagaatagagagtcacgcatgaaatctgagaaagtcattaagaggatatgttgttggattgaaatatgcctatcaaaaataaatttttcagatttggaaaaatatcaatcaaaagtagatggagggagtactatattgtggctggttgcatatatgttgtcttaattatttttcatatataatgagttatcttccatacgatcactaacatatcgtaggagtgtatatagaccatatttttctgtattactccaactgactagcaatcatatttgtggggtcagaatctcaaggtagaattatttctagattgtaagtgaatagaaagttggttgttagcttgctggatgtatggtaggtcgatcgttattagtagctgaaaaagaaaatagctggataacacggcaggggaaaaaaaggcatatctgcttatttctatgggaaacactcgttagaagcatttatttctttggatgagttatcatcagtaagaaattatgtagtagtctttatggcatgttcaatggcaatgataaataccgtctcttaaacaatactaccttcgtctcaaagtaattataattctaaattgtttagcatatattaaggtttaagaagaaaaactataatatccatcgttaaataatggtttataggtaaaaatgaaagggcagttgagggtaaaatagaaagaaatttggatgagaagtgattaatcgaatcattagtactttattgtgacaaatattttgggataaatttaaattctagatatacaattattatgggacataggtagtacagtattatttacagaccgcattgttacaacagttgagatcatagaggctctaaccattaactcaatccaaagatattcttttattattattcttaatttctatttttttcacccgcatgcaaccatgtttctattttataggggttatagagtcgttgttgagccgttattatctataacaatgatgttttgtctttcctttttctctctcttctatgttaacaatttatactatctatatagttgatgcccactaatttttaaaagcttaacatgcaagtattctatatcatcacccactagcaatttttatctagagtattgtatatcacatgtaagtgtgcaatatcatcatccactagcaattattatctatagcattttaaatatcatgcaaacatgacatatcatttacaattttgttgtatttttagaacacacactagtagagaaatcatatttaataccgattgaaaatctccattaatcccgattatagcaatcgtgatcaataaatcaagactaaagatctcgacctttattaccgagtcaaaaaaaatatgtgggatgtgggattcgaattcaagatctctcatctcagcccttacgcgcattagcatcccacatactctacacatctaacttaaatagagatgtttttcttttgaactaactctggtggcatcttaagtaataccaaccggtacttaaaaatatctttagtatgggttggtgttatcgaaaaaatacatctttagtactggttgataacatcaaccgggactaaagatccaccaacattagtctcggttggtggtaccaatcggtactaaaaatacatttttaataccggttgaaagatgagtttgtgtgtttgggacattagataaaagatgagttctctagtattgtcaatatgcaagcaatgtaaccattatctccacatcatttttacattatttaaacatatatatctatcatttctataacgtataatatgtagccatccatgtatcccgcaacaatgcgcgaagtatcaactagttatttctaattagcaacactaaaggagcactattgatgaccattatacatctttattgaatgtatgtgtcctcgatcttagcttggacttgacatagaatcttggacccaatgtaacgttagcatggactacacttttggactaaacaagtctatataacacatgtatatgtaaagatcaggatgcatgcatatgtgcagactttgaagtcaattcgttggaaaagatgtactaacgaatctaaatcagtttgcaataacgtgtgttcaaccaccactatgaaaattaattacataaagctagccaagttagaaagaatgtaatcggaaattacgatattaatttaactaccgcttcaattggatgagcgctgaaaaatttgagagacaaagctaccacatcatcgttttcttcaagcccatttagtttgaaataattaaggaaagttagagaaaagtaggtggcttttgtaccagcttaaactggtttgttgttcccgtgacagcatctactaataacacatagccggccgaagcctggtccggaatgcacttgatgttcatcacggctaagcagtgacgccacatgctgagcaaactcccttcgagaacgacaacgtatggatggtgacggattaattttcgcaagtgcggcactttaatcacttaaaatgaagaacgacgacactgttaattagcatggaagatttttggattttagatcgaggctgtcatataaggacagtactcagggtaacatgcatcatatttgttcaagggaattaattgttgcctgaacattgtagtgggaatggaagacatacatggtaacatgatgactgcaaatttaaatctacagttagaggaaattcaattctagattggttttttataggacggatagagtacaggtctacgatctacaagaagaagaccaagctggttttgaaaaagaaaactttctgtttgatgaaaatcctttcagatcaaaagagttaccgctttctctcgtgtgaaaagaattttttttcttaaacttgtgcccacagaccacagtgtaaaatgcaattggaatatcgatcggcactcaagaatcagttgtaagctacaaaagattgtacgatgtctgcgatttttcatcaagtaacgcactcctacgaaaacaatttttctgtgcgggtaaaaactgtttttacgtgtggaggtggcgcccgtttgcctgaaagtgtttgcaaaaatctggtttctctgtgcgggtggcgcacccgatcgcaaaaaatcagattttcgcgtgcgggtgcttctgtcgcccacacgtgaaaaaaaaatccaaaaaacaaaataaaaatagcgaaaaaaatcgaaaccctagttgccgccgcaactcgtctcgccgtcgccgtcgctcgtcgtcattgtcgctgttgtgcgggggagggtgggagagaggtgccaccacggggagaacgtggggacggccaccatcctcctccgctccggccaccttctcctcgtcggtggaaagacgccgtcacggggagagcgcagggacggccgtcgtccgcctccgctccggccacctcctcctccttgtcggtggagaggcgccgccgctgggatggccagcgtccgcctccactgggacggccggcgtccgcctccactccggccacctcgtcgtcatcgtcggcggcggcgggggcggtcgaggcctcactcctcccgccgtcgcctgctgccaagccgcccgcctgccgccgcgtgagtgcgtgagaggagaggagagaaagttggaggtgaggataaggataaggaggtgagagagttggagggaggatataaggatggaatttttgaagtgttgggagggaaaaaggaggcagggtatttttgtgtgggaaaaagtacgagttacccccataaactatcgcggtcgaccgaattacccccctgaacctgaaaaccagacattactcaccttaaacttttaatagcggataaattaccccccctcaacactgttttgagtggttttgacttaagtttgcatacgtgacgccaatgtggcaatccagtcagctaataaaaataaaaatacctcccctgggcccaactgtcatacccctctctctttctccccagtcgcactctctctcccgcgtatgcgcttgggcaggtggctccgcagacggagacaagagcagaggcttgcggcggctgcccgacgtgcgtcctcggccgacgatggcaatgggaccgatggcgatgaggcagaccgagcaatgcagggtcgtcaatgaagatggcttgttcctagcgatagcggcgtcgagggacgtgtcccctgtgcggcgtgcttggccggcgaccggtgagcactgcgcacggaagaggttgggtgagccggtgacctccggatcccagcgacggtggagatgagccgagacggagagggcagccgaaaatgggattcggggggacctatgcggccggaggacgacagacgcgccagcggcgcgacgacgtggaggaccgagacggaggcagcggcggcgcgagatgatgagacatcgatgcccccctactcagctcggtgggacggagatcggcatagccttctcagcccaccgccagcaaccgccttcacccccgcccgtcgcctgtcgcctgccgctgcctccgccccaacccgctgccggcagacgccttcgcgcccgcccacgcccaccactggcagccgcctccgccaccatccgctgtcggcagccgcctccgccctcgcacactgcctgccagccgcctctgcccctgcccgtcccggcctggctcctcgcctgccgctcaccagctagagagagagaaagagagagaggggttgagagaaggggagagagagagggagagaaggagagaaaaaagcgctgacaggtgggcagcaaagagccggcacctttatcctcaaataggtgccaatttttaaaaagaactagcacctattactgttgtaggagaaagatgccggtttttattgaccattcggcaccttgtagtataaatccatcggagtagttgggacgggacccatccaagaaccggcatttcttttaaaaggaatatgtgccggttttgtttaaaaatccgacacccgtaaaccgagccgagccgcacctaaggagctctctcaaacccgtaaaacgtttttatccatctacgtactctatctccctcgttcttatcggatcagttctctctctctctcactctctctctcgtctcttcctccttttctctgcctcctctcttgcctcttcgtcctcggcggctgcgggcggaaaggtgacagcagcgagcgacgccctcccctccgccagatccggcaggaggggaggcagcgacagcggtgatggcgggaggcagcggcgggcacccacttgtgtgttcatgttcatgttgttcttgtgtgttcttgattgttaactatgtgttcatgttcatgttcttgtgtgttcttgattgttcgggggtgaaagggagttgctcggagccgatgcatcgagccggctttttttattcctgaaatcttaaaggtgccggttctaaaacataaaaaaaccgacatctttatccatatagatgcctgttctagaagcagctctgattcatcagtgccgcctctgtggtgccggtacctaagggggtttcccaaccggcactgaaggccttttctgtattagtgtatttaaagaaagggcttccaaatgcaacaagagcactgcaacaatggtaaaccttgcggaacagggagattagacggagctcgattagtttccgctagacgaggaataaagaacataaccaaaatggggaacaagggaatactggaccatatctgcttttgcgccacgacaaaacaaaatgctagttgctagcttcccagtaacgcatacgtctggagcgtttgtcccatcgacgagggccaatgagactactatacgcgtttactctttttgtttttaacattgcctaaactgtaatttactcattttcgttagacattgtgccaagaggatgccacttttcaattaacaagaaagatattacaatatagtcatactacaaaagaggaaaagggaaaaaaaatacaacaaggccacacaaggacaaaaccaccccttctagtttaccctaatgtactccatagaaatgaatgcgtatggatcattgtatccctagctagataggggcagtttatttatttgtgtatttgtatttgtaagacaacgtagatcactataaattgttcacaagcactcatggacgaccacctccgtgtcgataagggtgcccgcatattattcctggctcttgatttgagcaccagttcagcaacctcgcggcggaggccatcaagtgtccctcttgcagcgctgtcgtcaagatgagcagcgtgaggagcacgagcagcaggtgccggccgccggtgatcctgatgagcgccaccatcgtcgtctgcttgcttaattaagttaacactgcgatgccgtgtagccgtttatataatagagcgggacgagctgatgaggtaggtagctagcttggaggccaactgctccccggctgaccagtcaagtgtgtggcctcgcgagtccaataattggggtattcctctttcaccagcataagcaaaaaccgattacaattgaaatctaaacgtgtattcggattaattaattagtacaaagttaaaaagtagatttgaaacattataataaattcatatgtagaatttcttttcacaaaaatatcatgtgttagcttttcggaaagcatgcagagtgtagtcaagaaatctagtcatgcatataggagaccaagctagtatagtatagatactaaactgaggtacttattagatagtttaattggtattaatttataatttcaaaattattatatttggaaaatactaagtacatactacctgagtacaatttggtatgcttattatttattattccgaatttcataatctgtatattaccaaaaaggcataattgggactccttatcgatttcactttgtcatttcagaattgttaaaccaagataaacaagtctaagacttcccaactttatgtttgttaattcagaatttaaaattttaaattaggataatagatatataatgtccgaaagggtaccacgatttaaaatcattagttttaaattttgtaattattctattaagaaagtactatattgtggctcaaataaacccgttctgtgttttgtcttcattttcttttatatataatgatttgtcttccataccatcactaggtaatgtaggagtgtatatggaccataattttctttatcagtcaacttggctagcaactatgcatatatgtctggtcagaatctctatgtagaacactatttgtagattttagagaatgggaagttggttgttagcttgttgggtgaaggataggttggtagtaattgccaaagaagatagataaatcgggaggtaggcagtgtttagttcccttcaaacttccaaaaattccgtcacatcaaatatttggacacatgcatagaacattaaatatggacgaaaaaaaccaattacacagtttacatgtaaattgtgagacgaatcttttgagcctaattacgtcatgatttgacaatatggtgctatagtaaacatttgctaatgacgtattaattagccttaatagattcatctcgcagtttacaggtggaatctgtaatttgttttggtattagtatacgtttaatacttcaaatgtatgtccgtatacgtcagaattaaaaattttggccaaacaactaaacacggctgtaatataaaaggccaacattagaaatttcaagtcatatcaacatttttggtgggcagcattcgtttgattcatccatcctgtccttaaaaagaaaaaggctaggtatgttaatatcaaataaattatttagataatggaatagaatcccaacctttactcaacgagatacaaccaattattacacaaatttatgcaaactagcgcacatatacaagttttttttaaaaaaaaacaccaacaaattaagctgaaggaaattaacacaagctaattaataatcgcccacacaaaacaaagactctccattaattctaaattttaagatgtattagcttttcggataggagagtagtgaataaatctagtcatgcatataggcaagaccaaagttatcacaggacacattaaactaaggtccatgttagatagcttataaatagttattaatttataatttcaaaattattatatcaggaaaaaatagtaaatagatactagttacttatcgattcgaaatttaatactctatattaccaaaaaggcataacttagacttcttaccaaataaaattttgtctttgtcatttttcagaattcttaaaccaagatcgataaacaagtctaagactatgtaactttttatctgttaattctgattttaaaattttaaattaggataatagaaagcattcgaaaaaggtactacgatggaatatgaatactcaaatatcattaatttcgatttttttaattattctattaggagtatactatcaacccatctttccgcttatgcttatacttatgaaccaaaatttgaattctcaacctttaatttgaagttgactttggggttttttcatcgaaatttacttttcagtctttgattttagatcgctaaaaacacatacataaaagttttattcacaaattatttctcgtttgcaaatatgttacaatgggagcgtatattgtatcttactccctccattccataatataaggcacaactaatttttatagttgttacataatataaggcatatatgcatgcatgccattaactaaaatattattatttaaattctccactatcaagatccctaattttattgggtgcatgcattgcatttattagattaatccaaactatgaggtgataataattttttttagtctttgggttaaagttgtttgtgccttatattttggaatggagggagtaataaacccgttgtctaagtgatttgtcttcaatactatcgctagataatgttgtagtatgtaggacagtgggagtgtatgtggaccataattttctgtattacactgacatgtatatgtgccggtgctaaaccttggaaattggggtgtcagacgcggaatagatcagggggatagaatctcttggggttaggttaggtgtctctcggcggtggaggcagcgactgctttgagtggaaaccttgcctgtactatgagcgcgggttctgaaaaaacggcaacagctaaaaggaatacaaatctctatctctatctctactacttaaaaaataaaataagaggtgcttccatcgtttgtaaaaaaaacggacgaaaaaaatctgtccgatcaaaaacaaaacggacgaaaaaaccagacaaaaaaccgggcgaaaaaaaagaaaaaccaaatcgtgaaaaaaaggaaaagaaaattgaatccaattccgcgctaaaaaagggtgaaaagaaattaaaaaggaatatgtccgattcctaaaaaacaggcgaaaaataaccatgtgaaaaaaagaccggataatagcgagtaacacataagatcggaaaaaaaaaagtccgactcctccggtggaaaaaagagagaaaaaaaacgaagagaaaaaaactgccatcgcaaaaaaaaatctccgactctaaaaaaaatccgactcctcgggggagaaaaataaaggcgagaaaaaccaggaaaaagagaaaaaaaaacttctatatagtcctccgtccctgtacgcccgatgaaaccccagccaaagaaaaaaaacgaaattaagcaaagggataaactagattgaagttcccaaaattaaaagaggataaacgatattgaaactcccctaactcgaaaaaagggaataaaatatattaaaatttcccgacaaaattctctaaacttgaagaaccctaatttcgggtaagaaccataagagtcaaatccaaatcaattaagctaagggttcgggttacttaccggacttgaagcccctgagctcaccgaagctttccgggaagcggcaccgccgcaccttcacctcctcgcagtcgtgttgggttccctgcacgcgctgtcctagagcacccctccaccgtcctttgccgaagacgggaagcgtcggcttggcgtcgccctaccgccgacgaggtccaggccgctcggcgctcgtcaccgtttgcacgcccacctagccggaccgccgacgtcgtggcacggctttgcgccgccctcgggtgcgcccccccagccggcaaagcaggagccgctcagcggttgtcgctgcacgcgcgcaccagcttgccggaccaccgtcattccgctcgctcgtcgccggagagaaatgggatcaagagagagggatttgggagctagggttttgcccctctccccggtcggcgcttcatccggcgggaggatgattggagccatccattagatcggacgactcagattcgaccagcgtcaggccgtcaccgccgttgattacgctgcgcccaatgggccgcggaagtgcatcggaccgtccccgtatatgtcggccgagctcagctgctcagcttgcgggcagtcgaattgactcaactcgccgaagatgcgccagcccaagtttgggccggcttgggaagacctaggccgaaagcaaatttgatcaaacaatgtggctcacatttttcaaattaaagtccgttggataaactcttaagtaggctcgaaaaataaatctaaaactaaatcctaaattctatgctaattgatcaaattagactctgttctacctatttgttaatatatcaaattaaacttgatttttacagatttgaggttttcaaggtgtcacactatcaaacggtgtttttcccgttgcaacgcacgggcactattgctagtattacaaatgactaaatatcaaataaatataaggagtgagtcttcgaacctagatcagctaacccaccatcttgtagagctagccggaagaccgctggatgtttctcaagaacaacggtagctgcaggttcgtacgacaccgccgccgctctgacggggcccgcgtacttgggggctgaaaagacgaacagcaagctggcctgcactggcctgcagggggccatccatgtcgttaacctgttgcgtgatcggcgtggcccgcgctttcgctttcgattcgcggaatcacgagcttgcatacgacttcgggtgcccgcggcccttgcatccccaaacagcgcgagcggcagcctcccgacgcgaccatggtatatcaatgcagtttctttccaaaccagtgtactcgtgcaaattcacaaaaaaaaacatatatttccgaatttcttttcttgctcaaattggctggcaaatcataactgtgtggtcagaaaccaattgttgaattatttctttattttaagtgaatagaaagtttgtctactagcttgttgagtatttgataggtcagcagtagccgcctatcaaggtaacattagtgaagaaatggactttaataccggttggaaactctctttagtaacgattattaagcaaatcaggactaaagatctcgatctttactaaatatgcataccaagtaaaaaaatgtgtgaaatgtgataatcgaactcaagatctctcatctcaaccctcatgcatgttaccatcccaccttctacacacatctaacttagatagatatactttcttttcaaactaaccctaaaatatcttaagtctcaattggtaacaccaaccggtattaaaaatatctttagttttggtgttaccaatcggtattaaaaataaatttttagtccggtttaatattactaaccggaactaaagatcctccagcattaatttcagttggtgttactaattggtactaaagatgtatttttagtactagttggtaactccaaccgagactaaaaatattttcagagatttggacttttagaccctacacttgctttagtaccgactcttaatctagccaagatatttgtgattttggataccacgacgaaagattagttctccagtagtgtaacatggctggagaaattatcgatctactgaaatttaaatcatatgttcaaatccagttgggctgtgtacatctattgtgaatgtagaggccggattttaatccattttctaaaaaaaaaagttcaaatccagttgttctcgatgggaagcattcgttggatgcatatgttactttggctgagttctcatcaattagttcgaaaagtctttaggctgagaacccttatcggttttatttggttcttatgtgtttgtctctttgtttaatgtggataagggttgagtgcttcataagagcgttgttttggagtagagtgcctaaaaattgtgttgttctttagttgtctgtcaatcgctttacgatatagtatgacatttttatatcaaatgtagactgtgtgcatctccccgcaaaataaaaataaactctgtgcatctgatatatgtatatatacatatagtctgctagtagtaattatatttcttagcggatttttttccattaataaatactacatagctgctaatccaatgtaacattagcatagactactgttttggtgcaaacaggtcagcattggtatgcgcagactttgaattagtcttctcgttggaaaagatatatgtagtacgaaagtaagtttcataaagctagctacggtcttgtttagttcccaaaacaaaaacttttcattcatcacatcgaatatttagacacatacatagagtattaaatatagaaaaaaaacaattacacaatttatgtgtaaattgcgagacgaatcttttaagcctatttgtgtcatgatttgataatgtggtgctatagtaaatatttggtaatgacggattaattggtttaataaattcatcttgcagtttcctagcggaatctgtaatttgttttgttattagattacgtttaatacttcaaatatgtgtccgtatatccgatgtgataaccaaacatacactttttcaccaactaaacaagccctatgtttctctaaaatccttttggcacagacaacgagaaaaaaatgatacacgtaatgtaggatgatacaaatcacatattatatgtactatcattttctttttagggtacccacatatatactcgtaaggtaggatggataccaagcataaaaaaatgtattatacatacttattatcttcttttcagcacgcccaatcagatacatgtaaggtaggatggataccaagcacctaaaaactgtattatacgtacttatcattttcttttcattgcacccacaccgatatatgtaaggtaggatggataccaagcacctaaaaactgtattatacatacttattattttcttttcagcacgcccacatagatacatgtaaggtaggatggatatcaagcacctaaaaactatattatacgtattaatcattttgttttcatcgcgcccacacatatatatgtaaggtataggatggataccaagcacctaaaaacggtattatacgtatttatttattagtttctttttagcgcccctacataggtacacgtaaggtcagatggataccaagcaccttgtattatacgtacttattgatgtgaccattaagtatatgcatataaccaagcatgagaaatatagaacattgccaaagaatgcatcagatgaatggaggatctacaagatattaaagtacaatgagttttggaatccagttcggtctccggagacagcattgactttaaacagatttagcgttttcatgccaactctgattcgggtgatcttggacttgatggatagtttatctcattacctttcaaacgcatctggtctcatatccaaattcatcttgagtcaatggaaatcatcaaaacaagacatgatattgctgaaatcgaacttgggccttgtaataaactagactcatctcagaagtgtctccctccacctccacgaattagcacttaaccctaaatctatttttctctataaatgtctatgtacacccactagaacaattgggatttggtttaggtataagtttgccaagtgctattcaacttgtctatagtcctcgctcgattagtcggtgactataaattcagatccctcaatagtttgtgcgttgatttgccaggtcgattagatctaccacttcaatcacaactatttctttgtgcttaattacctattcgcaatatttagattgtattttatcttgttcttgcagtgttctcttgtttgcatttaagggatcatcaaccgcgcatcccggttggtacgacatcgtttgtggtgtagcgattgcacgacgttctgaacttgttctggttggtagccacatcgcaaacgtcacactcgatctgatagttatcccctcaccggaaaatcgggccacaagagagagcatcatcagttggtatcagagcacctaaattagctcatgctcaactggaccaaggtaaaaaagattgtgatattctacaattgtccactaattatgctatgttagagctacctgtagtggaacagatttctaatttccctttatcgcaagctaaaaatttagattgtgttgatattgataattcttgtaatgagaaagagttgtgcaatgcttcacttatatacatgccacaacttgtgaaagaacatgttacttctatttctaaatatttggtttccactcaaaataaatgtgtctttgctattgctgaagaccaagaagagctgaaattattgttttctttatgtactttaggttatatcgtatttgatgtcctttcttggaacaattatcatgtcattggtaaatataataatagaggagattatatggtgcatcgtgtgtatatatgttcagatatgagtactcttttaaatatgtgaaaatgtgagaaattaaatggatcatacaacattgatgctattgggataaattcacctaaccttgttttgaagatcgacaacaatattcaagaaggggagtgttgtgcaccattagattcaatggtcaagtctcgctatcattttaggacttgttcattaagtgaggtgagttggttttccctttatataaattggatttatgaggaacaaatgatactactcaatgactgcttgtttggtatttctttgtgtgatctctcctatgacgacaattgcagtaagaaactaaggacggtttccagacaagaaggagaggatgatgtgaccatcaagtatatgcatataatcaagcatgaaaagtatacaacattgccaaagaatgcatcaaacgaatggaggatctacaagatattaaagtccagtgagttttggaatccagttcggccttcggagacagcactgatcttggatttgatggaaagcttacctcattgcccttcaaacgcatccgacctcatataccacttcaaacgcaactatttatttatgcttaatcacctattcacattatttagattgcattttatattgttcttgcaatgttctcttgtttgctttacagggatcatcaaccgcgtgtcacagttggcacgacatcgtttgtggtgtagcgattgcacggcgttttggacttgttctggttggtagccacatcgcaaacgtcgtacttgatcaaagcgatagttatcccctcaccagaagatcgggccacaggagagcgcatcatcacttatcatgttcttttcagtgagagtcagacaatgataagggagtcatcagaatcaaacaatgatagtgagaggccatttgtttctggcgtcacaaaacttccgtttacgtcggtcaaccggatggaaattttgtgtttcatgtattttatagtagtaagcactcctttggaaccagtccaaagaaaaagtgaaagaaactttgaagaatcgaaatctatagaaaattatttctgcatggccctttcataaaggaatgacacaaggaaaatcatttaaaactcctatgaaataattaatatcataagaacattggagggatgccatgtatactcttccttgtaattaatatcgaaggaagaacactctctacgttctttatacgcttggctcccttttcatcaaaggatttgttataaggaacaattctataggattttttttctatttttttgccctttcaacaaatgattgatgacttcaaaatcctgtgaaattcttttggagtggattagattaatacatgttttttttcaaaaaaagttagcatgcatggggtctaatatcttggaaaatgttatttcaatcgacctctcatccaattctcatgtatttctcgtagcttatccaaacaattcacctgtacagaaaccatcataggtgtcggtttcccaactagccactattgatcggcaacaatgctcatagacattaggtgccagattcagaatcagcacctatagagaatataggttccggttcttcacccacaaccagcacatatattatttaaaaaattaaaaaaaaatccccgatggagctgatccggcaaccgcgccatcacctcgccatgccgcactggctgccaccccacgctgcactgggggactagctggagaggggttcaacgagatccaggcggccccagccactacctcacgggatggataaatgtgggtgttggctgcctctgagtataggtattgattttacaaaatcagtaatcggtatctaaaataaactataggtactgatttattagttaaaccgacacctataggtactaacattataggtgtcatttttttatctagaatcagcacctataatattaatatagataccaattttttttaaataaactagcacctataatataaatatatatataggtaccaactttttttaaaaaaaaaaaactggcacctatatacaataggtgttggtttttatctatattttttaatatgtagaggtgggaaatgatattaggtgccggttttaaataaaccgacacctataagcctatccctatgtgaggttgtttgtagtagtgattgtttctttatgttccctttgttgtatgattccccatttctgtttaattttcttttgttgtacgattcataggggacgctctcaaagaacacaacaaagtggagtgcaacttactttcatactttgctacactttagtagtgttgagaaaataagtaaagattgatgggaagttctgggggagtgccagagttgtcggtactctctcctctcttgtacctcgacagaagcttctttaataaaataagtgttccttttggtgtttaattacttaagatatattatccttattgcgggttcatcgcatagtatttatactccctccgtcccaaattatagggcgccccctttttaagaaaaataaaactcggtagctttcgactaataatcatactaactatatctatactaagtattatgtatgttatatcactagatttatattttgaagtactttcatgtgatgctaatttcatatttgttgagatcataaaatagaataaaatactggtcaaagtatattatttaagaccgtgtaaaaaaagggcttataatttgggacagagggagtattaagtactctggacctagaatttggataaagaaaaagttcctacgcgaagctagagtagtattcaataagttaggcgtagtggtgtctagattagcagttagctttgtttgttgtgtgctccacagaaaatgaggtaggcaacacatggtgatagccatgtccgtcttttgtgtcccttcacgttcgggtacatcatagagctatagactgaactcagcttggcagaccaggggagagtcagtgctcaaagcaatcgatagagttttaccttaacttaagtttagttaattaatccatgggaatcctctctagcataagcctacaattcgttgttgttcttggttgaagtctattcttagattattcacgcatgttttctgtgattcgatacccttagaatactctgaggtaaagtgttgtagtagtatctatgcgcttgtgaatttatctgcgaccgtaacaaatgccaacaagcattatgtttctaaaaaataattctctgtctttcaactctcttttgattcaaacatttcctccaacccatggttcgcacactaacaccctagccgaatctcaaggaaggtgcctttcctcccctctacagaagcttgggctctcacaaaaaccatatatttgtatgacttatgttactccctccgtcctataatataagggattttgtatgggg

SEQ ID NO: 61018 - DNA, 1316 bp, Oryza sativa
cctaaaatcccttatattatgggacagagggagtacataactagctagcaacgggtttttgtatatggaccataatttctatattactcaacttgtctggcaatcatatatttgtggtcgaatctcaatgtagaattatttatagattttggtgaatataaagatggttttttagtttgttgggcgaaggtaggttggtagtaaccaccaaagaacatataacatgggtgagaaaaaggctaacattcaaaatttcaagtcatatctacacatggttgttttcggtggacagattctttgattcattcattttttaaaagaccaagcccaggtatatatatcaaataaatagtagttgggtatgttaattaacaaatactttaattttgggaaaggtcatgtagcctagtggttacaagagcctagcaccttaggtcctaggttcgactcctcgtgggagcgaattttccagaatttaacggctttgtgctttcagtggtagatgacatacccgtcgacagtgaggtgcttaattcgtcaatctccaacatggatttgccggcttagtcttcgaagatgctcatagggtagggtttgcgtgcgtgcgatcataggggtgagtgtgcgtgcattgtgagtatctacgttgtactgtgtaattctaaaaaaaatacttcaattctaaaatttaagatgtattggctttttaaatggcaaatttatattttaaccattgaatttttctataacatattattagctactaatgaatcaatatcatataaaaatattttcaaatacgaatctgatgataactatgtgcatgacactaaagactgatatttttagtttaattattagtaaaaggtttcaaataaatattgactttactgaccaaggacacctcataaatttagccatgcatatagtccggaccaagttatacatgatagtttagattaaactagggttcgtgttagctagataaaataattattaatttagaatatcagattttattgtattatgacaaatatttaaaagagatcgactagctaagtataatttgggatttgccggctcagtcttcgaagatacttagaggggtagggtttgcgtgcgtgcgatcataagggtgagtatgcgtgtgttgtgagtatctgcgtgtactgtgtaattctaaaaaatactttaattctaaaatttaagatgtattggctttttaaatggcaaatttatatcttaaccattgaatttttctataacatattattagctactaacgaatcaatatcatgtaaaaatattttcaaata

SEQ ID NO: 61019 - DNA, 4636 bp, Oryza sativa
tttgcgtgcgtgcgtcataagggtgagtgtgcgtatgttatgagtttctgcggtttactgtgtaattctaaaaaaaatacttcaaatctaaaatttaagatgtattggctttttaaatggcaaatttatatcttaaccattgaatttttctataacatattattagctactaacgaatcaatatcatgtaaaaatattttcaaatacgaatctgatgatacctacgtgcatgacactaaagactgatatttttagtttaattattagtaaaatgtttcaaattaatattgactttactgacaaggacgcctcataaatctagccatgtatatagtccggaccaagttatacatgatagtttagattaaattaagagttcgtgttgttaggaaacgataggcgaacaaacgagaaaaaacaatagatcaatcataaaagacacgagatttaacgtggaaaaccctcccaaaacaagagagaaaaaaccacgggcgccagccagcaaaatatcttcactatatctgaggtgaggttacatcgccgcacggcggcttacaagaggtatatatagggtggaaccctaaaagggatgacgagaagatggcctttattaagtgcaaatgaatttggatcacaactcaacaaactccaccttgagacaaattccttcttgtagcatgaattaatccttcaccctgaatacaacaaagacaaaaaaacactttcggcgccaaatagcctctcgggctaaaccactataccaactaagcttgagcaaagctcaaacttagcaacaggaacatgctttgtcatcatattagcaggattatcatgagtacttatcttgcatacctttagcttaccttgcgcgactacatcgcgaacataatggtacttgatatcaatgtgctttgtcctctcatgaaacatcttatctttggtgaggcatatagcactttgactgtcacaaaacaagttaatgcaagaatcaactccacaaagctcagcaaacaatcctttcaaccaaactgattctttacatgcttcagcaatagccatgtattctgcttcagtggtagactgggcaacaacagactgcaatgttgccttccaactcacagcacaactcccaatggtaaacacataacctatgagtgaccttctcttatccaaatctgcagcaaaatcagaatccacatatccaacaagccccttatcagtcctgccaaacttcaagcaagcatcagctgtgcctctgaggtacctgaaaatccactgaatagctttccagtgttctttaccaggattagccaggtatctactaaccaaactcatagcatgagataaatctggacaggagcaaaccatggcatacatcaaagaaccaacagcacagaatatggaagtctagacatgtattctacatcctcatcagtactagcacattgtaaagctgataatttaaaatgaggtgcaataggagtactaacaggctttgcatcatgcatgttaaaacgctgaagaaccttcttaatgtagctttgctgactaagaaataacaaaccagaatttctgtctctagtgatttccatacctagaattttcttagtagcaccaagatccttcatatcaaactcactactcaattgtttcttcaatgtagtgatttgttccttgctcttggcagcaatcagcatatcatcaacatgtaacagcaagtatataggtgatccattaataaatttaatatacacacagctatcaaattcagacctcttaaagccatgtgacaacataaatgaatcaaaccttttataccattgacgaggagactgtttcaaaccatccaaagatcttttcaacttgcaaacataatcctccttaccaggtacaatgaacccttctggctggtccatgtatatcttcacctcaagctctccatgtaaaaatgttgtcttcacatctaactgctcaagctcaagatcatgcatagcaacaatactgaagaatgtgcgaattgaactatgctttacaactggagagaacacatcattataatcaacaccagcaatttgactgaaaccttttgctactaacgttgccttaaacctcggaggctcgctaggagataaaccctcctttctcttgaagatccatttacaacgaacaggcttcttctgttttggcaagtgcacaagctcccatgtgccattcttctcaagaggctgcatctccccctgcatagctgagatccacttctcacgatctccagaaacaacagcttcagtgtatgtggctagctcaagagtattctccacctgttcagcacaactaaaagcataataaactatatcacattcctcaataaggcggactagagctccacaactcctctttgttctgcgatgggcaataggttcatcttgtggctgcaaaacaagaggtgagtgctgaacaatatcattaacatcattaccaacaatttcagtttcctgatcatccatgtgctccacctgcacgctaacatattactgctcctcatctgaaccacctggtatgacatctgtgggcaagctgtcattaaacataacagattcattgaaaacaacactcctgctcatgaaggtcttgttggtttcaggattccataacttatatccttttactcctgaaccataaccaagaaatagacacttaatagctctaggctctaattttccattatcaacatgagcataagcagtgcatccaaaaactctcaactgtgaataatcagcaggcataccagaccatacctcaatgggagttttcttattaagtgggatagaaggcgacttgttgatcaagtagcaggcggtgttagcagcctctgcccaaaaacgcttgttcatgcgagcgttggacagcatgcaacgagccttggagatgatggttctgttcatgcgctcagctacaccattctgctgtggagtgtacgggatggtgtgatgcctaacgatgccttccttctgcagtaatcatcaaaagcatccgaacaaaattcaccaccattgtcagtgcgaagtacttttacctccttttcagtttgcctttctatcataactttccactccttaaaagtagcaaatgtatcatctttatgtttcaggaaataaggccacacttttgtagagtaatcatcaataatggtaagcatataacgagcaccaccaagagagggcttacgagaaggcccccacaaatcagcatgtacataatcaagtatacctttggtgcgatgaactgaggtattgaattttaccctcttgtgcttaccaaaaacacagtgctcacagaacttcatgttaccctgagtgtagccatccagcaggttccttttcatcaattctgccataccaagttcactcatatgtccaagacgcatgtgccacaggttagtcttactaggttcatctttagaaacagcagcagcggtaacagaaccatgtaatgtacttcctctaaggacatataagtttgcagaattcatatcactaatcatgtaaacaagagaacctttcgatacctttacaactccacctaaaccggagtatttgtatccttctgcatcaagtgtgctgagagagatgagatttctcgccatccctggtatgtatctcacatctttcagtgtgcgtgtcatgccatcatgagtcttgatctgaacggagccaatgcccacgatctcatgtgggttatcatctcccatgcgcacaacatctccattctgcacagacttgtaagaactaaaccaatctctgttaatgcagatatgaaacgaacatgcagtatcaagtatccattcatcatgactagcaacacaaccagcaaaaacaacaagacaatctcctgaatcagagttttcagcactggtaacaacagaggccttaccatcagatttccttttctccttattctgcaacttccaacattcttcaatgaagtgatttttctttttgcaatacttacagaactttttacctctggacttagaacggcctctactctaactcttgtcacgatcattgctgtcgttgtaggttctctgctcagatctgcctctgacctgcaatgcttcgcccttagaggacgacggatcagactgaaccatacctttcatcttctccctattttggagcgcctcataaacttccgctagggttagttcatcacggcttaacagtatggtgtcacgaaaatttgcatatgaactaggcagtgagcataacagtaaaagacctaaatcttcatcatcaaactgtacctccatcgacactaggtcggcaacgatctccttgaagaccgatatgtggttcaacacagaaccactctcctgcaacttgtgtgagaataacttcatcttgatatgcatcttactggttagatctttagacatgcagatcgattccagtttgagccaaagttcttcagcagtcttttcctgcaacacttcttgcaaaatatcattagatagaagaagttggatcagcgacagagccttacgatctttctgcttctcctcagcggtccactcagtcgttttcttcttcccgaggctttccggcgcctcatcaagatccgaagtttgcgccagaac

SEQ ID NO: 61020 - DNA, 6515 bp, Oryza sativa
ttctatcaataaacaaatattctagctcaaaaaaacctgctgtatgtttcgcgtataatgatttgtcttattttcttcagtactatcactagagaacatatgataacataggagtgtatatggaccataattaattttctgtactacacaaattggctagcaatcatatttgggtggtagaatctcaatgtagaatagaaagctggttgttagctagttgggtgaaagataggtcggcagaagccgccaaacgagatagataacgcgggaggaagaaggccaatgcaacatttgaaacttcaagtcctatctacatatccggttgatttttcaatgggaagcattcattggaagcgcatgctggtttggatgaattctcgtcaatcagatatagcttgtctggttcatttgggtctaactattttgatgcttatatgtcatctctttgttgaatataatgtgtcatctttgacttcatataaacatcttctatttttggatgacaatgacggataagacattagatatggtagtccttcctaagaatgcagtttttgagtattgactagaaatttgtgttgtcttcggttgttttatttgtgagtccttgtttaattaagttttcttttttcttttttataacactgtgtgcatctgatagatatgtaggccgggtgtaattttattttttaatgaaatattttcgattagaaaaaagaactacatagttgctgacccaatggaacgtcaatatagtctactcttttggacaaaacatgtcagcatgcgtgcagactttgaagtcttcacgttggaaaggatgcacgaacctagatttagatcagtggcaataacgtgttcaactacaactataacagtacataatagagccatgttcatagccaatggtatttatctaaaatgcattggcacagataaggacgggtaccaaccacccaaaaaacgtaccctctccgtcaaaaaaaaaaaaagaccaactctacgaatgaatctggacacgcatgtatccagattcgtagctaggattaggttttttatgagacggagtagtactgtctttatatatgaatttgaatatatatttaactttatgattaagagttactatatattttatatattttggattaaatgtacactattggagaaatgatctttgctctgctcggtggtccgaaaaccacaatagtcccggttcaaataggaaccgagactaaagatcatttgttgtcccggttaaaaagtgcaacggaaatggatgatcattagtcccggttggtgttatcatctttagtcctgtttggtcctctgacaaggtttgtcaggggccgaggatctttagtctttgttggtattaccaaccgggactaaagcttgtcacatttttatattccttcctcctccagcccgagccattgctgcaaattggaggtggaagggagggaggtgctgtccaaattttttgtgaatgtgttttggtgataatatacaaatcagagggatcgaaaatgttagtaactccattctctaatgatgtatgcttagcatattacatttatagctttgtgttctatacattattgtctctaacaaggtttatgggcaggggtagacgagggcgacgaggacctcactgctccctagtcctacccacctaaccatggccaccgacaagtatagagagtaagagatgagatagggtagagggggatgtcaatgccacgtgggctacatgccacgtaggcgtcacgtcaaaaaaaccagcctccgtagtgccttaggatctgttttgcattgtttttgcaagttggggggggaggatcaagatttcttgtattgcgatttagggatgcaaaattaaatttgacgggaatgataagggacgtaaaatgaacttcttcctccttcccctcccttacttccttcactctcgccaccgcctcctctccttccttgcctcctccggcctcgccgccgcctcctctcctccctccccaccgctgtaggggttggtggcgttgtggtcctaagcgagggcatctccatcggatgggttgatgacagtgtcgacggcagcgggtgggtggaggaggaggtgaggtgagggcgttcggcgtgggtggcggtggttgcctcctcctccctcagtgagttttctccggccacaccttctctacaaaaccctgacatgtggggtccacgtgctggttcaaccagtcaacggggtcaaagatgtcacgtcgaacgaaactgccttccaaaccgtctgaggagtcgatttacaatggttttgtgagttggaggacatgttatacctggttttgttgttgagggatgcaattcaaccaggggcatgagataaggaacgcaaaatagacttatcttcttactaataagtgttggcccatcagctagactacacaccaactgaagccttaacttgaaactggccgactccgatcaaatgccgattcagcacgaattaggccctgtttagttctcaaacaaaattttttatgctgtcatattgaatgtttagacatatgcatatatagagtattaattgtagaaaaaaaactaattacacaattcgctagaaaattgctacattctatttatttctccctgaaaataattacacagttcaacttaaaaaaaactaatgacacagttcgttacgttctttttattttcgggcaaaaaatcgcccacctgtaaatagctaagagcaatgcaagtttttttttattaggatttgtgccatatatgtatcattgccatatgaaccagaaccaaccaaggcttcatgcatgtgtcaattgtcggggcaaaaccttgccatatgaacaaaaaatattttttttctttcaattgattttatggccgttgaatttgcacggaaattgggatttgtatcgaccacagccagcacttttagcagtgattacgactccttagagggcacctgtaagttgatgatctacctgtcttttttgttttttttctttgctttggatttcttgttctaacttcactaaatcagctaggaagaatatttatgcaaatttatatactcctgcctctaccctataccaccgtcatccggttgcccttatcctgcttgcttcgaagatggatgaaattgtcagtctttgctacaaagttctcttcctgctcgaagcatatcaggtactacgatgcctttgtatgggagtgcgccaagtctcccaagaacaggttgtgccggccatttgttcttctctggccatggatctgcttctgcattgatcttactcgttggctccggtggtgaacatacaaggtgtggttggttttttatttttcttgctgaggcctcaactttcctcgcgaggtcccatttgggttcgtgccgaggcatgatcttttggagctcgccatgacatccttgctttcatcgtcattgtgtgcatcgaccaggtagtcgactgtcgtcgactaaacatagcaaaggattcgattgctttttctatttcttgttaggtccttctttgcataattctaggtctatttgtaacttactgatcttcacggggcttttatgtaaaacaggttatactccaagattctttacatataaatcctgaggctgtaccctcagcttgtcctaaaagaaattattgaggttattcttcataattcaagaaaataacatttgctatgagccttctctcaattttatctgtcaaatgagcaagatccactacctttgaccttgtagttcccattggaagtcctagatatgtaaatgtaatagttcctactacacaccaaaaacaccggctagttgttacacctttttttctagtacatttagagatattaaacttcggcttatgaaaattcagtttgaggccggtggactaagcaaagtatttaataaagcttcaaggaaaaaacaagttcattctgtgaagcccacattaggattatagtatcacgagcatattgaataattgggaatccgcctccattattctcattgatatgtttgcatatcattcccatttgaatgccttgttaacaatgctttggagcaaataaactcccaggacttggagcaaataagctccccggacagtggatttccccgccttactcctcttctacactttaaggagtttggaactccatcgagaagcattgaggtataggcagttataaaaataaaaatgatatataccaattacaaccatttggttggaaaccccatatgcttcataatctctaaaacaacttcatgctcaataatggtgtcaaaggtattttcaaaatccaactttaagattacaatcaaattggttaaaaaaaatgaaactaggccagcacatatggcatgtagctcactataagaaaaaggcctaacacaacttgtatcatgtacatccgcacgagacgagtatgggtgaaatatgtgcccatagttacgtaggtgatttggtggctcgcaatataagcgtggcatctagttaatggaatcttcaatgttccatccaaaaaagtatgcttttggttgaatttcattgctaaatttttgagccttcctagaccactcggtcttcgacaatttctactcaagattctaggcatttcaaaatttgtcatctcattttttttaccgggaatttgtcatctcatttggctagatttcaaaattgcaaacaccaagtgaagtgagcatagctcaattgtttaagttcctaagtggaacctggccactcagtgaaaatatctatgttgacttgattaatcttaaaatataatggtccaatcttcgaatgtactcataaagatttgctaatgatagattaattaggcttaataaattcgtctcgcaattttctagcgatatctataatttgttttattattagactacgtttaatacttcaaatgtataaatgtatatccgtatatccgatgtgacaaccaaacctaaaacttttccctaactaaacgaagcctatatttcgaaaaaaaaaaaacttgcaaacacccatcgtaagtaggccctcccgaaatacttatttcatttctttcctcgataagttttttttttctcgctggcgccaagctcgtcaattcaaaaaattcaaaaataaaaaatccgccctttcgcatccatggccaagaaccccaaggcggccaagaaccgccgccccacgacgcggagacctcgcgccgccgccgccgccgccaccgcctccgcctccgcggacatcgaggacctggcgccgccgtccgggtgcagggcagcagtggggctcaccacggccgccgcggcggtgcgcgcggagctgctgcggtggtacgacgccaaccggcgcgacctgccatggcggcgcgccgcggagccggcggggagcgggagcgggagcgggcgcggcgaggagaagagggcgtacgcggtgtgggtgtcggaggtgatgctgcagcagacgcgggtgcccgtggtggtcgactactactcccggtggatggcccgctggcccaccgtggacagcctcgccgctgccacgcaggaggtgagacaagagaaattatctctcctccaccatcgctggaaaaggaaatgtaaagtttgatgctgtgtgtgggagagtggtaatcgagttcttgatttgtggttgccgccgattgttgcaggaggtgaacgagatgtgggcggggctcgggtattaccggagggctcgatttcttctcgaggtgagtagtgagttgattgatcacgaattcactgtcgaaacgacggggattgggatggggttcacttgttcagtgcgttctgcggaagaatttttcagcttttgacagcgcccacgaaccgtttgatgttttgtctataggagagattttatttggaatccgttttgtgtctgataaaggaggggattattgctactagtttgtgatgtttgctgcattgttttcgctgccaatctcatgtgaagttatcagttcatctggtgaagatttggctagtttgggtggaagaactgacaagaacatcagcagaaatcatcctttttcttcacatttgtattcagtttacaattagcacttcatggtcatagtaagttaaaaatacttaagagtaaagtccatcaccggtccctaaacttgtaccgctgtgtcatcccggtccttaaactctcaaatcgaccgttcaggtccttaaacttgttcgattgtgttatcccggtccctaaacttgcatatcactcgtttaggtcctccaacttgttcagctgtgtcaccccggtccctaaacttggatttgaatatgatctgggtcaaataggatggtctaaagactttacattaaaaataattcataactttttcatgtgaactctaatgaagacaaactttatatgaaacttgtagccatcgacgcaatctacaactttgtagttgatttttttttattttaagtcattttttgtcccaaaatg

SEQ ID NO: 61021 - DNA, 1260 bp, Oryza sativa
caagttggaggacctaaattagtgatctgcaagtttagggaccgggatgaacagtcgaacaagtttgaggacctgaatggtcgatttgcgagtttagggaccgggatgacataacggtacaagtttagggactggggatggactttactcaatacttaatgatgttaaaatgttttacttttatcgtttatgcagcacacagttcgtttcaatctttcttgctgaagcactgttatgtgcatgcaatgtttttccttgaaagatgaaatgaatgaataagtacctctgcatctatgtacacagtgttgggcaactaatagaaattgttggtagggagcaatgcattattttgggcatgtattttagttgaatctctttgtagctcagtaagattttgctttttgttgcaaagtagggagcaaagcaaattgttgaaaaaggcgagttccctcgcacagcatcagcactccgtgaagttcgtggcattggggattacacagcaggagccattgcttccatagccttcaatgaggttgtgttccacataatttatatcctattgaaatcaccatggctatgatcctttacatcctcacatgataagttgataacacaacttcttgctaatataggttgtccctgttgtggatggaaatgtccgagttatcagcaggctttacgctattcctgataacccaaaagaatcctcaactgtgaagagattctggtcagcaactatctttatcgatcactgtaaaactgtacacacacatatatatatccatgtatgtgccatgacttacactaaattagcactaaaattcatccttactgcatttcatcattttgcacaacattgaattatactgataagcaatttcagccaaaatgtgtaagttcatataaccaatttgcacttgttggataagtctttgtggtcctttgtcgtgattcttctttttgcttttgggtagtttcacctttttcaggacagcatctaccctttagcatatttttcagttgtaggacagctgcggttagtaggacagcagcagttagcatctcctttatgcctcctttatgctttattcagtttggatgccctctaggacagcatcccattcaatttcgaattttagataggagggtgcagcaataggctagcagccagctatggctatatatatatgtatccaacctccctcgggtaagtatggcttttgtgtttagtgaatgaagaaaaccagaaaatcgccccat

SEQ ID NO: 61022 - DNA, 6295 bp, Oryza sativa
ttcctgtaggctaaacatctcttgttccaccccttcccaagctcggttgagctctcagccagcagcagcagcagcaccagttgctcctccttcccctttcccttcctcctctccacgcagcagccccccggaggtgcaccatgtccgacgctcggtctcgccgttcggttgcctcgagcactcggcgtcagcaggacgccgagctcgccgcagcagaagagcgcaggcgagcaacggctcggaccggtgcagcagcagcgagggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagctggcaagaggaagggcacgggagcgagcagagcggtgggtagcagcccacctccatggcggcggcggcggcccaagggaccgcgcgcccgccgacgggaacccaaacgggcgcgagcgtgctggcggtagcccggagcccgcacgcggccctcgcaggcagcacggctctctctcccctgaccggcgccatggtcaccacggcgtccagacggtggtcagggactttggtcccggcggtgggtggcctaccctcaccaaaaccaactacatcgagtgggccgcggtgatgagggtgaggctccaggtgcggcatgtgggaggcagtccggtacggtgacgtcgactacgatgaggatcggcgggcactggatgccctcatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggtgacgacacctacgacgaggagagagctgtcgagaagctcttccgctgcgtccctgagaagtacaggcagatcgctcgctcgatcgaatctctgttggacctctccacgatgtcgatcgaggaggcgttaggtcgcctcaaggtcgtcgatggtgatgagccacagcctctctcggggcccatcaccatcggcgggaagctccatctcactcgggagcagtgggaggcctctcaaggtgacaggaggaagggggagtcatcttccccgacaggcggccgtaagccgcgcaaggcgcggggaggtgtccagctacggtgggcgcgaagacgtgcccgagggtggcgcccgcagaggtgcccagggcgttgccaccggcaaccacaagccggcacgagacgacgcctgccgcaactgtggcaagcttggccattgggccaaagactgtcaacagccacgacgtggccaggcccacgtcgcacgggtggagaagagccggctctgctcttggctcacgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccggccgacgggagttcttcaccgagttcgactctagcgtccgaggctccgtcaagttcggggacgcctccggcgtggagatcaagggtgttggctccgtcaccttcaccgccaagtccggtgagcacaggctgctcactggagtctactacatccccgcattgaggaattctatcatcagcgtgggacagctggatgagaacggctcacgcgtgatggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacgaagcagcggcggctcccctttccccagcagacgagcttccgagccaaaaagcggctcgagctcgtgcacgaggacttgtgtggcccagtgacaccggccacaccaggaggacgacgttacttcctactgctcgtcgacgacctctcccgctacatgtgggtgatggtcctcggcagcaagggagaggctgcggacgccatcaggcatgcgcaggctgctgcagaggcagagtgcggccgcaagctgcgcgtgctgcgcaccgacaacggcggcgaattcacagcggctgaattcgcgtcgtactgcgctgatgagggcattcagcgccactacaccacgccgtacagcccgcagcagaacggcgtcgtcgagcggcgcaaccagacggttgtggggatggctcgggccctcctcaagcagagggggatgccggccatcttctggggggaggtggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgctaaggagcttggccacatcggcaagctcgacgacaggagcaccccaggggtgttcatcggctatgcagagggctcgaaggcctaccgcatcctcgacccggagacacagcgtgtgcgcactgcgcgtgacgttgtgttcgatgaagggcgagggtgggtatgggacaaggcggtggacgatggttcgattccgacgtacgacgacttcaccgtcgagtacgtccacttcgagggagctgggggagtaggcagctcttcttcacctagcgtgtctaccctagcccctgaatctccaccgactccaacaccaacacaccctcgggccacgacttcgactacgacgagctcttcgtcgacaccaccccagccagtgactccacatgctccagtaccaacagccactcctccaagcacgtctactctgacgccagctcgtgttgagcgtagcccggtggagttcgctactccgctctcccacgacggggagcgcatcgacgcgtacaacgacggcgagcagctacggtaccgtacgatggaggatcttctcggcgaccagccggtgccgggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctaaagagggatgaagccggagccatcatcaagcacaaggctcgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcagcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcggaggtcgcggcgttcaaggaggagatgaaggccaccttccagatgagtgatcaggggcctctctccttctacctggggatcgaagtgcacaaggacaactccgggatcacgcttcgacagaccgcctacgccaagcgcgtcgttgagctggctgggctcaccgattgcaacccagctctcactccgatggaggagagactgaagctgagccgcgacagcacggcggaggaggtggatgctacacagtaccgacgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccaaggtgtcctggcaaggcacacttcgtcgggtacagcgacagcgaccacgccggcgacatcgacaccagcaagagcacgagcgggattctcttcttcctcggcaagtgcctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggaacggtggagctcagggtggatagcaagtctgctctagccctggcaaaaaaccccgttttcacgaacggagcaagcacatccgggtgaggtaccacttcatccgaagctacttggaggaagggagcatcaaggcgagctacatcaacaccaaggaccagcttgcggacttgctcaccaaagcctcttgggaggatcaagttcctcgagctctgctccaggatcgggatggcccaactttccccacaagacgacgcacaagacttagggggagaatgttggataagtctttgtggtccttggtcatgattcttctttttgcttttgggtagtttcacctttttcaggacagcatctaccctttagcatatttttcagttgctaggacagctgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatatatgtatccaacctctctcgggtaggtatgacttttgtgtttagtgaataaagaaaaccagaaaatcgcccccatctcgagtgccatcctcttctcaatgagagtaaccattgaaattctaacagcactacgatttacaagctcaatttacagttccctgatccccattcaagtgcaaaccttatctgtaaatggctgtattttgaacttccatatgataccgttttcccatacagctttttcagaattagaagctttatattgatctgaaaacttccaaattgcatagactttgaacatcatttccttgatcacaggcagctcactggtgaactggtcgacccttctaggccaggagacttcaaccaagcaattatggaactaggagcaacactctgcagaaagacgaagcccggttgctcccagtgccctgtctccaaccactgccaagcactcacactttccaaccaaagtgcttccgtaaaagttacagactacccacgagtggttccaaaagccaagccacggtctgattttgctgctgtttgtgttgttcaaatcaatgataatctctttctattgatcaagaggccagaagagggcctgctcgctgggctctgggagttcccatctgttcttgtgagcgaagagaagactgatgtgctgaataggagaaaagagatggacaaatatttgaagcaggtccttagcatagatgttaaaaggagatccagtgtgatcctcagggaagatgttggccaacatgttcacattttctctcacattcgcctgacgatgtttgttgagctgatgattttgaacctcaaaggtaatcatttgttgtccatactagcagttattcatttttgtttagctacactctattattcattcaggcaaaattggttatatagcatcgaaagttcacgttttttgttttatagcaccgaaagataccggttcactttaatagcacccaaagttcaccatattcccatttttaacacttccgtcaattctcggtcgtttttcgttcgtcttgatcgagccacacacacgatatgacgtttct

SEQ ID NO: 61023 - DNA, 3327 bp, Oryza sativa
tgctgtttgtgttgttcaaatcaatgataatctctttctattgatcaaaaaggcaaaaaaaggccctgttcgttggcttttggaagtccccatttgtttttgtgaccaaaaaaaaaactgatgtgctcaatagaagaaaagaaatggccaaatatttgaagcaggtccttagcataaatgttaaaaggagatccagtgtgatcctcaggtaagatgttggccaacatgttcacattttctctcacattcgcctgacgatgtttgttgagctgatgattttgaacctcaaaggtaatcatttgttgtccatactagcagttattcatttttgtttagctacactctattattcattcaggcaaaattgcctaatttcttcactgtagatgatggggataaattatgcatggagggacaagataacagcaaactgagattcattgacgaaaatgcagtcgactcaataggattgatatcagggatccggaaggtacgcacaaattcaatgtggtaaaaatatttcctcagagtttggttaaaattgtaagatgaatgctcacttcaggtgtacaacatggtcaaggccttcaaggagaagaggccgaaagagcagagccaagtaccatcgaggaaaaggagtagacggctgaagtagcaaatcttcagaactaaatgcagaagtaacataactgcagaagcaactagtcaataactgaatgctgatattatcttgtaactgtactgtgtatttgtgctgctcactcaactaaattggccgcatattgctgcattttggcaaagctgaccgtgagttagtagtttatcttaggtggaggggagcacgggaaaaaaagagaagggagaaaaaaaaatccatatcatcgtctacgtggcgtgtcacgtagataagaccacggtcaaacggggatttagatcggaatgattcaataaaccaaatttaggggtcctgatgtatgctttgcaagttcgtggaactaagtgaaatctcataacaagtttaaggatcgctggtgtattttactctttaactgaacccctggtagtcactgctgaaaaagtaaacccattttcgttcatgaatatccggttcctcgtccaatttactcggccatttttgcacattaagacttgacaactttttttaacctgacatgatatgaagaaaattatatccattacgctgatacttacatggtactaagatttgatttttattttttacaatacaaactgtgctttgattatttgacatcccaggttgtgtttggatatacaagttcccatcttctactttttggttttgtgtgcgcatttcctaaattgctactccctctgtcccaaaatataggtatttttatacatcgatacggtcttcgagatgctactttaatcaataatatctataaaagcaagatttttaaataaaaagagttgcatattataattatttgttcaatgataaatctagtaacatcaaatttacatgattgatcttttttatttctttgctattaatagtcaaaattttaaaattttgacttgataaaatgcttatattttaggagggagggagtaaacgatgtgtttttttttaaaaaaaaatctatatgaaagctattttggaaaattatattaatccagttttcatgtagaaggaataagtcaaaaaccactaggttcgaacacaccctagaaactaagatgttttcacgtgtcatgagtgtagatcatcgaattttacccaaattcgaataacaataccaccaaattttacatctccgttgtgtaccacaaggtggacgcaattcaacgtcaaagggagagactaggcaaacaaattgtccccaccagccgggaactcccacacaccgagggtccgtggccaccgtggtgcgcgcgccgccgccggcgatcggagatcggcgaccggcgaccgatgcgggggaggggaaggaacgtcgagagggacgtactcgtcgccgccaccacgcagcaggtaatttggggggagttgaggtgagcgagagatgtgtgcgaccatgacttggcaccatgacgcgtgtatgtgaccctctcgtttgctgcttgctgcaggtggggaatgagatgcgggctgcgcttggatacgacctgatgaccagagaaatcgttcctagaggtgtgttagtaggggagattgatcggttgtgctcaggatgctggggtttggtaattagtatccattctacactaattttgctttggcaaatcttcactgtgactgtgcaggcaacctgttcgacgttttgcctacgagagccttcagagtacgatccagtgtttacacatgaatgctatcctgcgatgtgatgatgaccaaagctaatcttcggaacagctagggtcagtggctagtactgatccttttttttatgattcttttgaaaattaactggctcattcatgatcgtaagtgatggttactctgatatggctgttatggtgatattagcagcaagagtgtgcaaaaacatgctaactactcaaagtgcataccacccaaggctgatgttggtatatgttaacatcagtacatcacccaaaccactataaaatgtaacaaatgacaaaatacagttctgtttgtttccctaccaatgttttcagtgatttatggcgagaaatttggtaatgaaatacccagtcatacatatatcctttatgagaatgattttttcaagacatgattacaagaaccaaatgcactagataactgtcaattacagatcaattttatttagtatggtgtctgcattattgttctaatccaaaagttcataacttaaattacaaaaactggctgtctcaatactgctatagttgtatacatacacaaagtaccctcagtgttgctttctcatctggcttccccacacaatcaggatcatcattgcaaaagaaatgaaaaatcccgatgcagtgaagaggagaagtacaacatctatggatttctctaaagtgtatggcatcgcaattggctcttttgggttgttacattgtctagataacggtggtccacacaaacctgtgtttccaagaaaagagttgttggaaaatgtggaaaactgatatgagtttggaattcttccaaccagcatgttgtatgacaaattcagtgttgaaaggaagttgagtgatgctaactcctcggggatctccccagagaactcattcgaggagaggtccagtgactcaagtggattcaatctgccaaactgagttggaattgatcctgtaagggcattgtgagacctgttgagcccatga

SEQ ID NO: 61024 - DNA, 1093 bp, Oryza sativa
ccatgccggcgctagccccttgcctctgctccaccatcgcgggtggcggcatttacaggggtgcagaggtcggccttcatcgagtcgacgacgttcttgcggagcttcatcatgtagagggcctcgtcgatgatcgatcccgttctcagcgttggcgccggccccgagtaaagcatgcgaaggccgccgcggcggacgcgcacgatgttgccgcgcatgatgcggagaggcggcgcgccggccggcaatagcggcgtcgccgccccttctctgtgtctcctctctcacggtgttctctaagttgataaggggcaattttgtctcaacacctagtagaggagagaaaatcttttcgaaaatgaataaaatggtgaaaatagcaaagtggtggtagacgcacgcttcatattggtattttatcgaatcacgttttcggaatggcattctagcgaaaccgtgttttgaacatggcaaaatggccattttttcttccgctcccccccagtcgtcgttacccgccggcccccacgccgccgtctcccggcctgtagccaggtcatcgagctctcagccaccgtctccacccccatggcgaagatcttggcagcacattggcgcctccccacagcagcgctcggcggcgtcacgcatcccgacgagctcaaaggtgagttggtgactagttccgcttgcgatggccagatgtgctagtacgtggggcttctccctcaggccagatccagggcggtgctcccctcggttcaacagctatgttcctttaccagtccttctcttcccctactcctcagacctcaactctctctctctctctaatctccaacccgtaaactaatctcagcaatttttgttttgtgtatgacgagatttggcctttggttgcaaccaaagggggaacacaaatattcctagctataacagaaggtgaagttgtctgttcttcattggttttggttcttggttttttgttgctagattaataccagctcagtttatataatgatatgctagttaagtgggtagacaagaagcgaaatttcaaagtttatatgtagcgattagatcattggttatt

SEQ ID NO: 61025 - DNA, 1396 bp, Oryza sativa
cgggactacagatattttcccactatttccaaattctttttacacccggttatggttaagaaccgggactaaagataatagcactgaatattgaatttcgttgcatatgtgtttctaaaatagtaaataatacattattgttgtctgtagtaaattaagtggataatatataataagcacgtgaatgatttaaaattgttaaaaattctaataatcatatataattagcatatgcatgatattaaattgttaaaaattctaattaacctatgtaaataccacatgcatgatttaaaattaataaaaattctaataatcatatataattagcatatgcatgatattaaattgttaaaaattctaattaacctatgtaaataccatatgcatgatttaaaacttttaaaaattctaataatcatatataattagcatatgcatgatattaaattgttaaaaattctaattaacatatgtaaataccacatgcatgatttaaaacttttaaaaattctaataattatatatacctagcatatgcatgatttaaatttgttaataatcatatataactagcatattcaatacatccaaaatagtttacaacaattacggcaatacatcggcggtgacggttgtccgcacgtactttctcctcactattgttccttccttgtgatcgctacgtgagtaaggggtatcttcatttgataggaggatgctagggtcaatcgtcaccgtgaaagggggttgcccatcaaactgatcgtaatcctcgtcagtcttgtcctttactccgacgatttttcttttgcctgggagaaccacgtggcgcttcggctcgtcaggccctttgcccttctttcctttgctagacatgtccttcacgtaaaaaacttgcgttacatcattggcaaggacaaaaggttcgtccgagtatccaaccttgttaaggtcaaccgttgtcatcccactatcatcaatcgttatgcctccaccagtcaacctaacccattggcaccggaacagagggaccttgagaggtccatagtcaagttcccatatctccttgatggcaccgtaatacgtgccagttgtaccatcgtgtcccatggcatcgatacgaacaacactgttctggttcatgctcttaatttatcccttaatttatgcctagaataattaaaatccttgtgaaagcctccaacaattaaaatgtgcaaagttaaaagtcaaataaggcttggaggatttttgtaaatttcctaaaagcctaaaatgcgtaaataaattttagtggaattttcagacacaaataataattattaagaaataaacaaagttaaaatgattttataaaaagaaaaaccctaaaagtcccccttccctcccttgg

SEQ ID NO: 61026 - DNA, 14694 bp, Oryza sativa
atcactgttttatctagccatgcttatgtacttttgttatgaccttattattgttattgttattatggccttgttcaccttagaataaacaaaaccccaactagtggacactctactcatggtaccactagtatgattttaggtagatgcttcgctggttaattaggcaacattaggtggttttataactctagactttgggaatattttcatcacctggacactatagaatggttggattattgtggaattggattcacacctccccctctattcaaaacccttaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggatatctctagggcaaatgaaggctacacgagctacggcccggtagtcgagatgtgatggcacagggccggtgtcctgctgctaggggctccgtcctgcctacctgtcccgggggttccggccgtaggtggggttgggtcggtactcttgtttatggctaggatgggttggaaactatgtcatgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaactactaaaatgtggaatggttggcctgggttggcttgggacgagctgggacccagggtcgggttgccagttcggtctgaatcatcgtaggccttgggttaaggcaggttcgtgtgggttcacggccttggttaataatattgtatagctctaggaccgtgtttacaaaatagctttgagcaactaagtgtcttttaatgctgtttactgcaaaccctaaccccctatattatggctcccttgtactcccttgcatttattctgcacttatggatgtgtcttgttgagtacggtggttgtactcagtcttgctcaatttttcccacacccagaagaggagcccctggatgatgaaggctttggtgtctagctcgtgcctgccgtcaagcgcctgtggtcgtcgccctagtcttccgctgtttttcgtttgtcttcttgtgtgctgggtcttcgccgcccatgtaataaattaattaattacgcttccgcttgataaactctgaaatgtatcaacttttggtgtaccttgcctcctgggacaaggaataatacacgcacgtaaggaacgcccgttgggttatttccggtcgtgacaggacccctcgccaggaaggccagttgctggttaatcgtctcgttacccatgagatgttgtcgcagccatgcggggaaagtatcaatgtgatgtcgtgtaatccatgcatcggacttaccgatgtttctggcgcgaactagagccaagtgctcctcgatgtaaggagccaccaatgaagattcttgtaaaaccgtgaaatgggctttacggaataaattgttgtctaccgtcattattgctttccttccgagagtcctctttccctgtagtctcccttcatggcgtgattcaagtaccccgattaggcgaaggtcttcaataaattctacgcaaaattcaatgacctcctctgttccataccccttggcgatgcttgcctctagatgagcacggttacgaacatacttcttcagaacgcccatgtacctctcgaaaggaaacatgttgtgtatgaacacaggcccgagaataccgatctctttgactaggtgacaaagcagatgcgtcattatattgaagaatgaaggtggaaatatcaactcaaagctgacaagacattgcaccacatcattctgaagggcttctaacctatccggatcgatgaccttctgcaaaattgtgttcatgaaagaacatagctttgttattgttgcccggacattgtctgggaggataccccttattataactggtagcagttgtgtcatcaacatgtgacagtcatgagactttaggtttgtgaacttcttctccttcgtgcttattactcgctttatattcgtggagtatccagatggtaccttgatgctctccaagcattgaaacatactttccttctctgccttgctaagagtgtagctggctggactcaagtaatggctgcctttctcctttggttctgggtgaaggtcgccgcgttgttccatatgcttcagatcattacgtgcttccagtgtatctttcgactttccatatacacctaggaagtcaagaaggtttacgcaaaggttcttagtgaggtgcatcacgtcgattgcgttgcggacgtccaagaattccgaatagggtaactcccaaaatatggagttttttttccacatcgccgcgtgaccatcttcgctctctataggctggctgccaggcccctttccaaacactactttaagatctttcaccatagcaaacattgttttcccgctgcgatgtttggccttcgtacggtggtccgccttatgttcaaagtgcttgcctttcttccgtactgggtggtttgcagcaagaaatcgacgatgacccatgtacacaaccttcctacagtgcttaagatacgtactttctgtttcatccatacagtgagtgcaagccttgtaccccttgttggactgtccggataggttgctatgtgtaggccaatcgttgatggttacaaacagcagcgctcgtaagttaaactcctcctgtttgtcttcgtcccacacggggacaccttccttctttcacaacagtctaagatcttcgaccagtggtcttaggaacacatcgatgtcgttaccaggttgcttggggccttgaataataatcggcatcattatgtacttcctcttcatgcatagccaaggggggaggttatagatacacatcgtaacgggccaagtgctatggccgctactcatctctccaaaaggattcatgccatccgtacttaaaccaaaccgtatgtttcgtgcgtcctttccaaagtctttaaattttctgtcgatgtttcgccattgcgaaccatctgcggggtgtctcaacatcccgtcctgttgacgttcttcagcgtgccaacgcatcattctagcattccccttgttcctgaacaaacgccttagccatggtattatagggaaataccacatcaccttagcaggaattctcttcttcgttagctgcccgtcaacctcacctggatcatctcgtctaatcttgtatcgtagtgctttacaaacagggcatgcttctaggtctcgtactcctcaccacgatataggatacaatcattcggacatgcgtgaatcttctgaacttccagtcctagagggcagactatgttcttagcctcgtacgttgtctcgggcaatttgtttccctccggaagaatgttcttgacgagtttcaataaattgccaaatgccttgtcactaacaccattttttgccttccattgcaagaactccagagtggtatccaactttttgtgcccctactcgcaacctgggtacaacatcttgtccaatttatgggcccccttttcactttcgcagtcctccttggcatcctgcaacatctgaccaagatcatccgcaacgtcgttataatcagcatctctatcctcctcgcccgtttgatttccttcaaatctagcgtactgagcaaagtctagaatattgtcgtcttccacttcatcttcttccatttcaaccccttgctctccgtgggatgtccaacaattatagcttggcatgaaccccgactcaaacaagtggaaatgaatagtcctggatgcagaatactccttctgattcttacacttattgcatggacaacatttaaaactcttctgcttgttagtttcggccactctcaagaaataatgcacgccgtcaataaactctttggaccgccggtcagcgtacatccattgccgatccatctacatgaaatgaaaaaaaaatcgtacacaaataatcattcgtacaataatgacagtcatacaataatgataaaataatcacaaactctttcaacagtcatacaataatgacatcattattcatgcaaaaattataaaatattccaccaaaaaattcttatttattatttttgaagttttaaattcttttaattttcaatttagtttgttttcttttatttaagattaactttcactatattttcctactcaactattttataaaaccttatttagcaaataaacaaaatttctatatattctttcttttcccacacaaattttctctctcatcaacttattacaacaaaattttggagacaaaaaagtgtgcaaaacatagctccaaatgtaatatgaccaaaaaaacattggatgatggagttgctaaccttttaggcacctccgatttgtatataatcaccaaagtaaattcactataaattttagcatgacctcccctcttttttgaagaaattttgaagcttgctcgggctggaggaggaagaagacatatataaaggggtgggactcaccgggatctttagtcccggttggtaacgatctttagtaccggttggtaacaccaaccgggactaaagatcccgggagggcataacaagccctgacagcatttgaaccgggactaaagatgaccaaccgggactaaagatcaaatatgcccgttaccctttttattgcaaccgggactattgtggaaataggccgaccgacgaaagatggtttctccaccagtgctactcaaagtaggtgtaaaactcctagttcaactaggactcaatctacaaattccaaaccaaatacaatttaccaaaatttgcagccacaaccacagtcggactctcctcgccgtcccagcagcaacacatcctcctgttctcctgagccaagtcggcttgccacagccccaagccaacctttcagattaacacacatgcaagcagtcacatgcacatgtacatgcatccatatacatgcatacacgccacaatgtggagaaagctacgcatcggacgtccggagatttgcaatctccggacgatgtttcactggaggttaaatgaatgttgcaatgtctcatcgctcgaaaaaaaatgtttcaccatgaaatctctggacgatgtttcacagtttgttgaataaatgttgcaatgtttcaccactcggaaaaaaaatgtttcaacaggaattgtttgttgatgtttcatcgctcgaaaaaaaatgtttcaccgcattatcgaagatgtttcaatcgaatgcaacactcgataatgttgtctgcaacaaaaaaaaccaatatatgcaacatccgaagaaaccaaatacaacatccattaccgatttaagaaacatccagagaaaaaacagattgcaacatcacaaacacactatatgcaacaaaataaacatgtagtgtgcaacaatcctcgctaactagttagacgttgccacaagcctcctcaccttcatcgccgagctcagaaccctctcaggtgatggcgtctcaagcttttccgtcgtgctgccccgttgccgccaacgtggttgccggtgctcaccgcaccctaccgctggaactgctgcaccggccgccgctcaagcgcatggtagtcctcgccggcgacgagcaccaccccacgcttcctccctctcttccatctgtcgtcgccatcgacgccacccggaacacagccaccgtgcctgccacacgatgccgctgacgaacatcactggtggcgccataatctggccacccgcacaggaagccccgccgtcggcggcggcagcggcgcctgcgccccctgatgacgccgcggccgcgtgtgcagcatggagagttggagacgccgaggagaagaagttgaacgagaggttggggatgagaaggaatgaggataagattggggaaaggtgggtcccgtcgactgtccggagtttgtcttgtatcggacgctcgatacaaagcgttttcgcatacatgcacaatacagtaacaccgctacagtacctagagtactgtagaactatatacttatgctccaatttctcaaccaatctcctccgtgaacaccgacgcttgcacgtacaccttgtgaagcccgttgcgaagatcactcccacacggtgtccatccactgtgtgccatctcgtatccaacttcatcacccggtatccttaaccgtctggacctcaactcctccctgagtctagtcccgatccccaccgttgaccgaagttgacctccaagaatcctgactctagtcgccttctcacatggtatcccgaccgtactagacctctgctccaccctgagtatagtcctggtcctcaccattgaccaaggttgacctcaagttacctgtacacaatcagataaaacaactgttcctgagcacaaatatcacaacctgacccacattagtcacacgcactcccaccaacatccacaaatcttttaaaaccaattcattgattaaatcatttacaaaaccaattgttcatcataaatattaatcatgacaatgatttcacaaccgtcgttgtcaggtccttccgcctcgaccgctgtcttcatcaagctccaccagacgtcggcatccccatccgcctctactgccgcccgggggatagacccacgtcttcaccgcctctccgcctgcctcctccctcgtggcaggcaagacgccgctggcccgtcgtctctggcgcgggccgacacctcgccaccaggatctgcaccattgtcgccgcttgcggcctcgacgccctccgccggtcagcccctacgcatccgcgtctgtcttgcctctcgctccctgtattgtctggttgtccgtcactttgctagtcatcttgcacgtgattagcaagggagaggagagagagacaagatggttgcagagagtttgttggctggctggctatggacttgtggagggaatgcatgtgtcgctgctgctggtacagttgggcagagaggttgctggacgtggacttggtctatggaccatgtgtgagtgggtaagcttgcaactgatgctgttctgctgctgcatgtatctgtttttttttcccgattagagatcgagtttgcgtcgcccactgcctcgtcgacatctatgtgtctccgacatcggcatcgactctgcttcgatttcatcgttcagccctgcgcatcttcggcttgatcacccgttcaggtgcccggctacaacgacttctgtaaccaatcgttatcgagcatgcgtctacgccatcaatcttcgggttgccgctgcgttgcccccttgggctgcagtgccgccgcccgtggtccacctccactggttgttggaacacggagaggcgccctcctcagcgtggcctcactaccggtggagttctcgccgctatatcgacatcgggccgcacctgtgtcgccccttcgggtcacagcgtcacccctctcgtcgtcttcatcgccgttcatgcatcgacatcctcgtcgtccgcattggtcatctctagccgtcgggttcttcttcatctactttgagcattactgccgcatctccaagttgccaccgtcgccgctctaggccggtggtccagctacctctacatggctatcgacgttgccatccaggccgttggtcctgctacatcgccttctacttcgtccagcatgattcatcgccagcgtcgccgtatcttccttgactgcacttcgctcttctccgacaaccgcgtgctgctccagcaattctccctctacgccgttctcgtgccacaaccgtcttggaggcttctctgctagtctcctccaacattggcgtatgattcatggtggtcccctgcctcgcctgcacggtattagcaacaccggcgcgcgcattcgtcttgagttatcccggggtttggcaaaccctgtgtgatgtctcgtccttcacggttcgactacatcggctcttcagcatcatcttcctcaacgattgccacgatcatgtcaccgcgttcgtcttcagctcgtcctcgtgcaccttggtccatgacaccctctcgagagtccacgaccattctacagtgtcccatgcgcgccctgcggcacggctacctcgacatcctcgattccccgacttcagctacatcgaccacggctccctcgcacccttcgctttggctacatcgactacggcacaaaagggctatcgtcgatattgagcactctcgccggtttcttctctagtccaagtgtccgcctagtccaagtgtccgcgctgctcacgcttggactgcggggggatgttagagtatatagtagttagagtcatattagaataggattgatttgtgtggactccttccatatctgtaatcattccttatctcctccccatgtaatcctatatataccgcccccctgaggctcaatacaacgtgtcaaatattcaaagtattcctcactccctatactatccaacacatattttgttggatatggcgatccaattttttggtcggtttgtatggatatggtgatccaatttcttgtttggttggagggatatagcatggatgggaaaagccataagttggtgacccatttgtcatatatattttttaatcaaaatataatcatccgagatcttgttttaaacatttaattgtaacaaatataacggtgtaataaaatcataaattagataaacggtttaggagaaagatcatttggagcttgcttaacagaaaatcaagccaccacacccaatcagaataggacacgtcacctagaccaaaactggatggcttcatccagcaaaatcggccggatgcactcatccagcatattgagggaatattcccaattccgggccaccccattcaccctgccctccaaccaaacaccacaaaaaatcgggcggccatctcccatctagactcatccacccaaccaaacacaccctaatacgctcacgtcctctccaaactccatctatatttcggctatataaatctccatcaagcaatgtatatttgaatggtagccacttaatcttgtcgcgtcccaaatcgactctaaaattcatcctcaaaattgtgcaatagaataattaaaattcgatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaataagcaaagttaaaaaggtttataaaaagaaaaaccctaaaagaagttcttttcccccccctttttccctcttgggccggctcggcccatttccctctccctctctctctcctctcccgcggcccatcggctcccccgcgcgcgcgcgccgctgacaggcgggcccgcccgccactctcgctgacgggtggggcccacctgtcatctccctcctcccgccgcgtccgtcgccgcccgtgccctagcgccgccgccgccgccgaatccgccgcattccgccttccccgcgcgccttaatgaggggggaattattccccgcaatcccctctcccgattccccctctttcccctctctctctccctcggattcgctcggaatcaatcccgcaaacctcgccggcatattcaatggcggccgagatctccgcgcccgtttcctctctctccggccgccctctctccctcccgttgctatataattgctccccgagctccgctcttccgtttccgccgctcgccgctcgctctcgccgtcggaatcgtgctcgcgccgtgctcctctctctccgccgtcgccgccgagctccgttccgccgccgccgccgctccggacttcctcccgactcggcgacccctccatccgcttcgccgtgttgccgccgaccccgtccgccggtgcggttcgcccgccgaccgtcggagcgccgtcgtcatcgttttcccgagccgcgccgccgtcttcttccgctccggacgccgttttcgtcgacgtcgttgtaccggggtgaaccgtggaccatccccttcgtttcccccttccctcctctttctcgggcgccgctccgccgcgccggtggtcgctgtcggtgaccatcggggtgcgggtgcgcgccgctcccgtcggccgtgccggcgaggccgccctcgggcgcgccctcgcggctgccaagtgggcccggccgtcagccgcccgcgcccgcgggtgcggctgacggcgggacccacggcgccgaccgccgccagccgcgtgcgcccggtccaccgtggaccgagcggctgacgcgtgggccccacctcccgtggacccggtccgcgcgcccgcccctcggctgacgcaataaatgggatttttaattgaaaattaaatgaagaaattcgcaaatatccatttaaagagcatataaacttcaaacggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcagaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctattcacctttgttatgaccatattattatcgttattgttattattattaccttgttcaccctaggcaaacaaaacctcaactagtggactctctactcaagacaccactagtttaattctaggtagatgcttcgcaatttaattaggtaaccttaggtggttttacaactttagacttgggaattatttcatatcacctggacactctggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctgctgtgaggggctcagttccgtctgcctgtcccgggggttccggccgtaggcgggattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgagccctcggatatgggcaagccgagcaatgtacccaagtcagtgttataattcttaaaatttgctcaacaactaaaatgtggaatggttggcctggggttggcttggacgaactgggccccagggtcgggttgcagttcgggtctgatcatcatagccctggggttaggcaaggttcgtgtgggttcccgcccttgattaataatactgtttagttctaggatcgtgtttccaaaatggccttgagcaactaaatgtctttaaatcttgttactgcaacccttaccctttatgtataattccctcgtactccatggcatttattctgcatttgtgggtgtgtcttgttgagtacggtggttgtactcagtcttgcttaattttcccaagcccagatgaggagttccctgaagatgaaggcttcggtgtctagctcgtgcctgccgtcaagcgcctgtggtcgtcgccctagtcttccgctgtttttcgttgtctctgagtgtgctgggccttcgtcgcccatgtaataattttatatacgcttccgcttgttaaactctgtattgtatcaacttttggtgtaccatgcctcatgggacaaggaataatacacgcacgtcaggaacgcccgttgggtgatttccggtcgtgacaaatcttccgatcaactttaagtgtaggatctttcaaatatttaatcaaaggaattctccaatcctcttttgttttctgggcgcaaatgtctgaatttacaattaatttggctttgaatcaattgcggcgtgccccccagcgctctatccagaactggtcagaccggctatgcaaggccggtcagaccgcccctggtcaccggtcagaccagccgtgcaacgccagtcagaccacccctggtttgtgattttgccaatttcacacaaaggtttaaaatcgagcaccggctcttccaatatcaaaaatactcctttcttcacattatagctagatgcatgttgtgccaaatcatttgctatagaattatcatgcctagcaatatgtctaatagcaaaattatcaaaattggcaataatatcgaaacatgaatcaagatacctatttagtgatccgtccaagcaattgtaaactccggcaacttgttgcaccaccaattccgaatcaccaaaagcttccacgtgtttagctccaaccaactttatcacttgtaagctgaataataaagcattgtattcggcttgattatttgtacaataatactccaaacgaaccgatgcctcataacacatgccattaggtgaaaacaaaactacccctatgccttgaccttctttgcaagaaccataaaaataaatattccaaggtataacttcaactaagcaaacctcttcctcataagcaatatctacaggatggtctactataaaatcaactacaatttggcctctcatatatttcaatggttcataagccaaatcatattcaatcaaagtgtatgcccacttgccaattctcccacttagaattggcctttgcaacatgtgtttaataacatcagcttgacaaacaactatgcatgtactagataacaaataatgccgcaatttggtacaagcacagtataggcataaacaaagtctccctataaagacatacctcgtttcggcatacaaaagacggcggctcaaatatgtaatgatatattccttgccatcttcctcttgtgccaaaacggcaccactgactttgtcttcggaagcaatatataaccgaaacggcattccaactttagtcgctcgtaccacgggtggagtagataaataccttttcaatctttcaaacgcctcttgttgttttgcaccccaagtaaaattggcttcttttttcaaacgaagtatagggacaaaagcatcgattttacccgctaggttagatataaatctcctcaaataattcaccttacctagtaatttttgaacttcctacttccatgtcggcgctttgaaatcacgaatcttttctatctgcttaggatcaatctcaactcctctttcatgcaccatgaatcctaaaacttccccgccgacacaccaaaagcacatttaagtgggttcatcttcaaaccataccggcgcatcctctcaaaagctaacctcaaatcggctatgtcccacaataccatccgatttgacaacaatactatcaatatagatttctaagataatacctagtaaatcatggaagatcaaattcgttgccctttgatatgttgcctcggcgttcttcaatccaaaagttatgacaacccactcaaatataccaacaaatcccgggcacctaaaagccgtcttgtacatatcctcctccgtcataaagatttgattgtagctggcattaccatccaaaaagctaatcacattatgacccgaggcatcattaatcatcatgtcggctataggcataggatattcatctttgggagtagcttaattcaaatctctaaagtctatgcaaactctaatcttaccactccccttcttctccaccggaactatgctagaaatccactccgcataatgacatggcctaataaaccccgctttcaacaaccgatcaatctcttctttgactcggtcatatagcaaaggattgaaacgacgaggcggttgtttatgaggcctaaaacccggtttaattggaagccgatgctcgacaagatcacggttaagacccggcatctcatgatactgttaatagtgaaatttggtaaagcccgaagtcatcatcggcttaaagtcaatatcagctttagagtattggaatcagccgattggaggaaacagccgatgggagtcatcaagttgccatgctgtcgtggtcttgatggagtcagatcaatcaaaggaatcttatctagaagagttcgagttcaagaaagatgcggcatggcagtctatctattaattag

SEQ ID NO: 61027 - DNA, 12542 bp, Oryza sativa
atatacatataaattggatttagccgatgacaacaaaggtttcactgtttaatctaatcttgtggatttcatgacatcggacctccagccgatgtgtgttttaaccttcggatcggtgattattatatcttgtttctagccgattggtttctactcggttatattgtttttttattacatcatcaacagcagattgcctttatatcattatctacattgcacatatagccgattgcttaatccctatcgctatcggctgatatcggcatcggctattatcggctatcggttggaactactccatcggcttgtcagccgatcgactgttttgatctactatttgcatatcttgtcagttgcaggatcaaactgactggcacaccttcatctcattaatctttggacctgcacaggagttaagcagatctcctaagccggtgtgttcgattttttcgtcaacacagattggcacgccttgtgggactcgagttttgcacccattatgtctgaagagaaagtcaatgccgcgaaggggcaatctactaagccgatattcaacatgtcggctcggggggcaagcacatcagtatcggctcatgaaagccgattacaagaagcaaaacaagatcagtttttgagttatcaagaaaagaaagaagataattttgaagcatgaggtttcatactccaaaactgggggccatgtgttaacagtgaaatttggtaaagcccgaagtcatcatcggcttagagtcaatatcggctttagagtactggaatcagccgattgaaggaatcagccgatgggagtcatcaagttgccatgctgtcgtgttctcggtggaatcaaatcaatcaaaggaagcttattctagaagagttcgagttcaagaaggatgcggcatggcagtttatctattaattaggtatagtttgttagtttccttttatctttaggaaagtatgtttagtgtccgataaggactttatcttttccttttatctttaggatagtttctttcttgtccgacaaggacttgtatcaacccatgggtataaatatgtacacccggggtctatataattatcactcgatcaatacaattcggcgcatcaccaccatttttacttctacttttgtttctacgttccggcggaacttggcacccgacgcggggctgcatcgtcttcaatctccggcgaaggggtaagtccaatgttccgtcggtccattcaattgcatcgtttacgtcggcgtcgttcaaggctgcatcagtacattcgacctcttggattgctctggtttggatgatatatttgcctacctatttatcatatgtctctattaatctagtcttagcacatcaatttagctctatcggctgcttctcgttttagggtttctgccggtatcggctaaatcgcgttgctagattagattaacttagatatctaccaccctgaaaactcagtcaacggtttgatcgtctagatattatgtttcttttcatacttagtgctgcatcagttgagtttgatctactaagtcatgtttagaaccataatctctagcctgctttttgactgccaataagggtttcatcggggttttagtcggtgagttatctggacgttgcatcggctcataaggattgcatatacatataaattggatttagccgatgacaacaaaggtgtcactgtttaatctaatcttgtggatttcatgacatcggacctccagccgatgtgtgttttaaccttcggatcagtgattattatatcttgtttctagccaattggtttctactcggttatattgttattttattacatcatcaacagcagattgcctttatatcattatctacattggacatatagccgattgcttaatccctatcgctatcggctgatatcggcatcggctattattggctatcggctggaactacttcatcggcttgtcagccgatcggctgttttgatttactatttgcatatcttgtcagttgcaggatcaaactgactggcacgcctgcatctcatgaatctttggacctgcacatgagttaagcagatcttccaggccgatgtgttcgattttttcgtcaacagatactccatgcgaagcaatcaacatactccttaagtagctcgattattttagctttataatcgactctcatgtttttgtttacaaaagttggccttggcttagtttcatcacctatgtcaacttcttgcaacggatcggccgatgtgaacccttaaccaagcttctctacttcatcaaaatcttcaatagtttcactaatatcgttctttgtagaccgatattcttgcaccctcttttgcaaccactctaaattagcttctttattcattacataaagtgatatggcctagccgtgctaaactagccggctatacagagataggtacaaatttgccattggcgatactaataaaatcatagctagaaagatccatcccgataagcattgaatattcccataacaccactcaaatgttgcattggccattgcaacctcgggcgatgtatccgcttgaacaatctcaacatcatcgccgtcccattgaattaaacattgatgcaaggtaaaaggcacacaacaaatggcatggatccaacaacgacccaaaataacattgtagttaccttgcacatcgacgatgaagaaagcggttggtagcgtcttgtttcccacggtaagctccactgaaaagatatccttcgcctccgttggttcaccattgaagccattgagaattatgttggtcttcttcaactcatcatctccatgccccaacttcttgaacaacgagtatggcatgaaattcatggcagcacctccatccactagcatcctagagaccggcttcccatcaatatgacctttgaaatagagaggcttcatatgacggtttgactcatcaggcttctcaaaaaccgcatctttaggacctagtgagaattgagcaacctcggcttcatctatagcgtaaaactccataggcaacatacacaccatgttgacatccatgtcctcctttggagatgattcatccttagcaaccgattgttcttccttctccttttgcacaacaaccggttcttcaatctctatggatttatgcctccacatctttgtaggcagtggtcgcaactcattgaaccttctatctctttgctcttcggcctctctctctcttaattcttgggcccaaagatgttgcaaccttctcttttggtacccgtcaaatccttaggcatccacctcggtttcggctctgttccaggaggtaaataatgccctctgttgattttactcgaagacgatgaagcccctgaactaccctttgcaaatctcctgtcgaaccggcgctggagcccggttagaccggacgtagaccattagtcagaccagccagaagcgccggtcataccgacattgggctgacggtcaaaccggcctgatggcccggtcagaccagccttagggctgcggtcagaccggccagagggcctagtcagaccggccgcctgcgatgagctggtcccggcgttggatttattgcttgaagactctccaacttcatctccagaaggtattggctcatcatgagaccccactttgatagtaatcacctccgaagtcctaatctccactttgacacgctttccttcccttttctcctcattggcccggttcttagcataaaactggccattgtttggtaaagataaacgctaacgagctggccccggttgtattgcattggaggcatatgattgaacattgatggtgttgccccccatggcatgtagtaaggaaaaggataacccgacggcagcattggataaggcccccatgacatgttttgagaacgatgatatgtaggtgattccgactgtcttggtgaatgaccaaatcgctccctaggaggtgatcttggtcttttccttttgttgcgagctttctcaccaccttgcttctcatacttattcaaaagcatatcgaaggtcaccttagtcctcttaggagctttagaacttgaaacttcgctcctattctccttccaaacaccaacctccggattctttggcaccatcatctttggcctaggctctccaatgaccactccttgaccaatcaacaccttcttattgttgaaattaattgtattcaccgggaaaggatcatgatcaagcttcatcttggaaccatcggtaaatttcaatcgcccttcatctatggccgattaaacctgtcgtcgaaacacattgcaatcattagtagaatgagagtgagaatcatgccatttacaataagcttgacgcttcaattctacttgagagggtatgacatggcctttaggtaatctaatttgtttttcttgcaaaagataaaaaaaaatcatatcacatttggccacgtcaaaactatacttaaccttactttgccgatctttacgaggagtcggcattaaattagagcaaacaaaaggcttatttttgttagttcatgatcactccgcaacatacatatcatgatcaccctcatcatcactatcactagcttcaggataatcaatcaaattaacattaggctctaacaaattttttgctatccttaacccggctttcctgagccagagccttttgcatgagttgactaacataaaaaaattgttggcaatctaatctttctttaataggagcaattaaaccattaaaagcaagatcagccaaatctctatcagttatattcaagctataacatcggtttctaacatcgctaaatctcttaacataatcaatgactgattcattgtgtttttgcctaaccgatgttaaatcacttagcctaagttcagtttcaccagtataaaaataatcatgaaatctttgttctacttgagtccaagtatgaatagaatttgccggaaaagaagtaaaccatataaaagaagtaccggacaaagataaagaaaacaaacgcaatttaaaagtatcagaactactagcctctccacattgcgctaagaattgacctacatgctctcatgtggtcttactatcctcaccactaaacttggtaaattcgggaactctataaccacgaggatatggtatgttgtcatagtaatcaggatatggcttttggtaaaccttagtatgattcctagctttaattccaaatttatccttaataataccactaatcaattcctccatattatcaggcctattttgatttggtggtgggtttggtggcttaataggttgtggttgcggcgcaatataattatattggccatgcctagtatcgggagtatatcccctagtaggatcattgtaagcattagggatatgtggttgaacttggggaccaatagtggatataggaggattgggtgctggtatatggtataaaaacatgttatttgtcattggatctaccccctgtattgggatgattgcgccggtctgaccggtccaagccccgaactgaccggcatccaaaggcgcggtcagaccggtttggggtccgatctgaccgccggggtaatacccggtctgaccggtctgaccggcggcaaagtcgcggtttaaccgaccatctagcccggtcagaccggctgtatgcgctgaccacccctcgtcagtttgttgggtcttcaccccatcggttttactacttatttgatctatggggcttggctagcactggtagaggctttatctttgaacataaaatcggccatgagagggccaaatttagtcctcataaattcttcacaacgagtttcgatagatgcatctaacttattatttaaagtaaccatagatgaatctatcgtatgcgcaatttgttgttggatagattgtgatacctcttcagcacttaccatgtcgaaagtatgtttaggcaatgatcccggcttgaaaatcacaccttggcgggtcctagcgcacgccttcattagtagatcttgagtatatgccttgagatgttcatctaaagctttgcgtgctccctcatcaagctcctccaatgcgactggtatcacattgaccggttccacctccgccttggttgatggaggctttgtcatggcgatatcgaagttgagatgacgttgagcagatttccctagtggagtcgccaaaaatcatcttggcaactttttgtgacaagttgacaagcacgatcgcagcacgtaaacgccttgcgttgatactagagtcaccaaccatctcaatctagcaaaagctaaaccaagataggttttgataactaaactggctaacggagccgattctagataactacccgtctcgtgggcaaaacggaaggttttcaggacaaacctacaaagagatgtcgcactcttgtaggggcggtggacgatttacggcgcaaatcgacaaagatggacaaactaagagaaaactaaaagcaatatgaaaaacgattcgattgattgattgtagattggtttttacaatgaaccggccttacccccttatataggggttggtcttaccctttacaggccctcctccacgtccaactcgggatagaatccaaaggaaaccagaaacatgccttcctgagcaaggaaacttcgagacccggtgaaacagacctggactcggactctgccggtcagaccggccacacaccaccggtcagaccggcccacacacggcggtcagaccggccccacagaggaaaaccggcagacttccaaactttggcaatttttcttattttactcctaggtgccaaatttgggtgtaaacacattaatcattatatgcatccataataattactaatgttcatgaggttatttgcactccgattttcgccatcaaatttgggggagcagccggagtaatctcgataatgatgcccgtcaggtgatcgggcgggggaggagaaatcgggcgctcccctaccccatgcacgcgcgctcccctcccctgacccaccacgtgtcctcacacacaactctattgcaacaaattacccatatattttggaaactctctattaagagaatttggtttattttttgttccagcaaaaatgtttcatctagtgtactgacaatgtttcactatatatagatctaatgttgcagtgaacgaaacattccattgcaacaaaaacccacatattttggaaaccccctattaaggaaatttggtttattttttgttccaccgaaaaatgtttcacctagtgtactcataatgcttcactatgtatagatctaatgttgtagtgaactaaaacattctttcgctatttgctaaaatattgtttttatataagttgaaacagcacctaatttcaacgagtgaaacattttcgatctacttagtgaaacaattccgatatacctggtggaacatcgtgcaacatttaaaaaaatcaataataagctattttttcatcggaatatatccatgtgtggtcttgttttgaagatttaattgtaacgaatttaatggtgtaatcagatcatgatttggataagtaatttaagagaaacatcagtttaaagtagttttgtacgtaaatcgggcgctgacatcggcatgatgtcgggcgcccgagccgtaggcagccccggctaatctttgatttttcattttatgaacgatatactaatctttggatatttcatgtatcttttattacgtaagatccgaaagaattcttcgctttgatagtttgcccaacctgcttgagttaaggcagtctttatcagtgagatatatgaagtgaaggggtattctcaccagagtgatcacaatagctcatgcaccttacttccttcaactaaaaaaaactgcataaaaaaattcacctttatggctcaaaccaaacataaaattggatcatcccactcacccaaccaaataaaaaagtaaaccttgcatactaaccagggttcaatatatatattgaacgagcactttctattgggggggaggcttgatacgaccgaaatttcggtccgaaataatttcccaatcaattcctcttttttcccttccagtattcctgattacaaattccattgaatttcaaattttagttcagtccaaatttgttgcctaagctctaattcctataccttggataacaatccccaatatccccatgaaccaaatttcataattaaattaaaatctatagtaaaatattcaatttaatttttcctcaaatccattcctacaaaagtccaaaacaataatgtgcacctgcatgcgagctgaacgaagttcagttggttatatatgtttgttatgatagcacctattcatctggtgtcaagttctaaccttgacacatatgcttacatttatgagcaattatttttttatttgtaggcaacgtatcaatcaataataagacataagtggtaacatcatctctctatatattccaacgtaatctctcgggggtaattaaagaggtaggtacgtgtttatgcgtttatatgcatgggtgagtgtgtgggcatgtatataaatatctacgttcgtacagtgtaaaaaaatatagcacctggcaacctgggcatcttttcttctccttctcattattttctagtagatggcacacactgttcatgggccacatgttactgttcatgggccacatgttagggagaaaatagggcaagggaagcagaaaataatgagaaggaagtactgccttcaaaatagggcttccttaacattgcggcacttccttgaagactttttaatttttttaaccttttttatttttattttttaaaataaaccctttcaaaacttatttcaaaactttcaaaacttatttctactctagccacattgtagggtgtatttagtttacaccaaaattagaagtttggttgaaattggaacgatgtgatgaaaaatttggttgtgtgtgttggaaagttttgatgtgatggaaaagttaaaagtttgaagaaaaagtttagaattaagtaagagcgtagtggcaaagcatagtagcaaaacaaaaactgacatgtcgactgtaggtgatgtgacaatattaattcgtactgtcatacggggtggcgtagtaaaaaagtttagatttagaaataattatcgagatggcgtagtaaaaattcccctgatgtactcaattgcactgccgacccatggcctcatgatcgagatctgtgagttatatatagtagcacaattcaatactgctgtaaaatatctctgcacccttcaaataatcatttgcaaaaagctgagtataatgcttcatatgctgtccctaagaatggcacattaaattaaattaagtgatgagggtggagtagagaagtgaggagagagataatgagctacccctaaatcaagaggtaacctccacacaaattttaagaagagtgtgagagtattagagacgttggtatttgtgtactagaggtgttttattgcatgagttatctattagtttatgagtgaatgatatagataaatttgaaggtggtagtcacatcttctataacacctgccctaaacacataaaactcaacgttcaagcatagtatttattggctctcctaaaacctacatgcaagcatgccacatcgacccattaagcacacagagctcaacatgcaagcatataataattatatctataatttatttcaattctaaaactaaacatacacgtgctaaatcatcattctcaaatcattttcataatattacaatccaaatcattttattatttctttactatctaatatatatctcacagcaaagcgcgggttattatctagtatatgagaagaatggtgtcaaaattgaagaactctctatagtacttaaattatactccatccatcctaaattataatttaggtttatatttttttacacggtcttcaataacacactgtgaccattaatttattttatattaggtttcctataaatatgaaattagcataaaaagaaagtacatcaaaatatgaatctaattatataacatgtataatacttagtatatatatggttagtatgatcattagtcaaaagttatcaagtttgatttttctaaaaaaggaggcgccctataatttgggatggaggccttttctctactattaaaaaaaaaattgaagatgtttttgtcaaaattttggtacgtcatccgagtttgttttctaatatttgtctttatcacttccggtttgcttttatttttgtccgtcttctttttttcgtcgtcgatttttttgtcagatttgtatttttttgcacgtggaatttttttgtgcgagtttttttatccatccctttctttggttgccggttcttttgtccaatctcagtagtatccaatctatcttagtagtatccaatcagttgcacacgcgcagcacctctagccgctgcccaggccaaaccctagcatcatcacaacgtcgatctaccttcccacatgtttcctcctaaaattgattgcaaaaattgattccccacttattccttagtattttccccatgattttccctttcaattcagcttcaatttgtcgctccattgttgatggcctaccggcaagcttccccggcctttttacctgattttatgaaaaagggaaagaggagaacgaatggatcaaaagccctcacccaattttaggagaacaagagattcggccaaatttgatgagaagatcggggactgtttttgaaggttgaggacaaacagttggctatgcgagttgcgtctctacttgtgggttgggccgaagagaggcaggacgggcggagggaggtatcagactaggctaagctgaaaagtaaggaagaaatatgcttccgtctaaaaccaatgaaggatattcattattttttaaattacaatgtatagcgattctaatatttttatttattgctcagctcctaatagctattgtgtcactgaaaagatctttacccgtgcgattgcccatcacctaatagttgttgtatcactgaaaacatcttcacccattacaacacatgtattttttctagtaattaataaagtttatgatgaactcctctactcattgtaaattttgcaatttttttcccaccaacacaactcggcgagaccctagggtcaaatccccaaacagctttcaaagcgggacaccacctctttctcaaatttccctctctttcacttccactgggcctaggcacttcaggcagccccaccagtaagcaaatgcctcctgggatgccctccctctctcccctcggtgaagccagcatacgcgaattggccactactgcaggacaggtatattgtaacaaaccctgtaacacatactaggatgtgttacacggcaatatcacaggaacacatactatgtgctacaacatctgcttgtaacacattttcaaaagatgtaaaatatagctctagaaaagtgaggtaggagcacaaaatacgtgttacaaaggatgtgttgccaagacaatggatccaggatcgcacagttgcatgataaccactaattggtggcatagccttttttttaattacttctacatgtcctttgcgtctagtatcatatttcaaccttataaaataaaaatatcaatttatgggcatgataaatggaaataaactatattttgctttgatttttggactaattgtttatatatagatggcaatatttgagatcctactttttttctgagtcaacatttaaatacttaatacttgtttcttcatccgtgttataatcatgtgcgaaaaaaacagagtacacaagtaacaactgaaccatcacaaataagctatttatcatgtaattcaagcttgtgcagagtaaatctcacagtatgaatcagtaagctttagatttagtgattcattatcttattttaaatatttcaacatatatcttgcagttggcttatggtttgcaccaaagaacaatgtatgatacacatgttaggaattaccaactttaaattgtattgaagcgtatatggtgcacctattgaattgcaaaggatagtttccaaatttccaataaaaactgagacatccatgactagtatgaagaagaataaatatatccaaactattcactaaaaaaaatggaaacatcatatttcatcgaaatgtaccaaattgccaaagtaaacatcaattggaaaacacactgatctaattccacaactgatgagtctgagattgtatttttcagtcaaacctcagtgttcttcatttgtaactaaaaacattttcaggaattcagttcatgggttcaggtaagtaaaataaataatgcaaggaagttctgattctgatgtatatataaacaaattgtccgacatagtattgcatacttcatgggctagtttttactagtcaatatctatccaccatcttgctgtcttgctgcacattgtttgaaatattttcagcaaattgtct

SEQ ID NO: 61028 - DNA, 1753 bp, Oryza sativa
aggagtcaacagcgccagtgaggtcccctaggaaggctcctctgcctctccgctcatccttcccacctctctttcttctcaaggtggtgatggggagatgtccatgccacgccatcttccccgtctccggaggctccctgccatcggatccgccaccaccggccgcagcctcataatcgcacgcttgctttgccccgccgcagacgctggcccaccgccctccttcatccatgcggcttcgatggcgccgatgcctcaccgcccgccgaagtccaccgcccattgcgtcctccgccacctacggccatccctttaagccttgaggaaacccccctccccccaaaaacctcccctcctaccctggcgtggcaggtcagctgtgtgtgcgcgtggtcaaaaggttcagatttggaaatattttttagaaatgtctattaataaaatgaaaaaaataaaaagatctaaaaaataaaaaaaccaacaatggtatgccatgtcaatgcaaagagcggttggagcccgcttgcacctgtatgacaccgaagacaagttcgtagacctaaaaatacatttagtttagtatctaaatgacaaactacgtatgtttggaggtcggccgtgtgcttcattctaatattttcattactaggtgctcccgtgcagcacacgctcgttgcatcaaaggcgtgtatcgtcaccgatgttctccttatctaccctgatcaatggcactggcgaaggtggtgagcaatctagtcattatgtgcagttacagcagatttgcccatctgtttaagagagatagtaggatagagtccgactcttactctatttctaacacctagtataactccaaaccctaaactgtaatcgactacgtacacatactcgacacaaactaaaatagacctttagttgtaaccccattggttatggtagtggtgtagtaggaagcaaatccaaccatccgttgctatggctgatggagctcgtagtccgtcgggcaccgaagtccaaaggcgatggcaagggccgcgaaggaactcttttggaggagcaatggaggccatgggccactggacggatgggcaatgaggatgtcggcggtggtgagggagtaatggcgccaactcgcagccgagtttagcagcgtctccccgactcccatctcatgttcctctcgtcgcccatgaagactgtagccatcacgaccttgcagatgtcgtgtctatgctgaggcgaccttgtaggtgaacgggaaaacagcaagcgaatgcggccttgcaagtgaaagggaaagaggcaagcgaatgcggtcggaggaagcccgcgtcggcggcggtggagctgccctagccatgccgagaaggcgataagccactcgtttttctcccttgtactcccttcagtgactactatttgcaacaatgccatttaagatatatattggaaataaaaatatattttcaccttaaaatcaaattaggaattccaaaaacagaattttagttgtaaaaatctatctacaactaagctcgaaattttggagacagggcggggtgagagaaattttggaactggtgaaattggtattggcgggctctgctcaagtaggataatctcatcagtcatcagcccactaattaaagtgctcatctcttggactcttaccctcccactcccaggccccactcccccccactccccagaccgctaacgccgccaccccatcctctcccgtcccctatacaca

SEQ ID NO: 61029 - DNA, 10398 bp, Oryza sativa
  unsure (1)..(10398): unsure at all n locations
tacagtagctcatcatatgattgcttagtagtgattagctcatggctacgcctgtcactaatctcaatgtcacaggaggaaactatgatatggtaagcaataatgggctatacatgctaatatatgcttataacgggctataatatatgcttaaaatagcctgctgcatgcatcctctgattgaaatatccatactgttggaaaaactgagattttctgaagttggtatagttatggtagatacatagtgcaatcagaattggcaatggtgatagcttttcagaacttttctctggtatggtagtatttgcttcacttctaattatttccatgatctatggttgtatattgtttctaacagaaaagggattgtagttcaaggaacagaaaagggattgtagttgaaggaatctagtattctttgtttgtaacttagaaggatttcttcagcattcaagttcagaggttcaggtaaaccgaaaaaaagtagaaaattttatcttcatgcaaatttatgcaaatgtgatatatagaaaaatatgcatcaactttgagttgtatctttatatactaatcattggaaagtttttatttgatttttttcatacattattggactagatcagtatatatattgtgttgaaatttctcatatagaaaaaatagtatgctttattagttcattgtggataaacaattggtgattcttattccaagataaatactggtcttgttgctgaaatcacataatagtattcttatccaatgcaagttttcattgtattatctgtgttagattcattttccttatgcgcagaactgtatgcaccgtccttttatccattggactgcatgctttaattttttcaaagcaacaatagcatttctcatccatcacaatatttgtgctgccaaatttttagaaataaaagcattgaactccaattctgtgtgattatttaggagatctcacaaggcactgttctattcatttacttccgcagtctcaaaatttgtgaattgccggacatgtcaaacttaattgcttatccatgtaagattcaataaaagtagaataacatgaagttttaagtttgtcaaacatatttcagatattgatgttaatatggcatctatccaaattatctgtcacagttacaaacaggtttacttcttattacttaataatgattagcttgattggcaactgttatgtcttagatacttccgttctcgcttaactcattttgtggcgtaatccgtgtttgatctttcatatgtacaattcaatgtaaattttatgggcttaacagggatattttcatcatgatcaactgcaggtacagtttattgtacacattacacatacaagttgatactcagttggaacttaagagcaaagatgcacgttcaggtgcaacaatggatcaagcagcaaataattttatgaagaatatagaaatagacacactttgtaaaatcgtttagaaattgtacttattgttgatatgtggattgatgaaaataacatttgcttcgtatgcaattcaaattgccatgttgatttgtgttatttgagatatgtgatgcctataaaggatattttgaaatattttggcacattcctgaaaattaaaaggcaacaatgtaaaaaaaaagctaattagagcattattggtaatcaaatcattattgttttgctgtactgtgcatttgatgtgttactagtggccaagatatgtgttaccgggacctatagcaaggtgttccaaagtgcaacctgaggttaaaaaatggtgttactgttggtatttcttaacgacattactagaaatataattcccagcaatggcgcataaatacttttggtatattatagttacagagtttatccgcaagcgcacggatataccattatagcatttcacccgagagtattccaagggtattgtatttattttatcccgtgggaagatcatgtagagaggacttgactaataatttatatgttgcttgtaataatcatattctaagtaggagttaagataatccaagggtagagtgacacacaagcattaactactcattttcataatatattatctaagctaagtggaaagaaaagaggaagataatctattcctatacttctaatatacatagtatacatacatcttagttaactgatatactagctaataccctctttccgatgcccttctggtacttcgagaagccacccctgactgctgagttccttacgacagcccatcataaccacacaaccgggctaaatacggaggaataccctccccaggaaattaacttaggattatatataggcgcggaggaatacctgtactgagctgtcaccatcagcggcccacctctcatccgcaatatataaccccaaataatgatatcccgtaatctagacaccacgtctaaactaccagatactactctaatatcatcgtcatgacatagagtaattgcataagcaaacattatacccgcaccaaagcatctcctagataagctagccgtatattcagtataacaagaacataatataaagtaggtactcatatactcggaaagtatttcaataccataaatgtatttagaagagtattctaataaaagtacaaggcttacaaaagagaagagaaaagctgctagagtcatacccgaactcttccgaagactttcggactcctgatttctactctattcctattccactagctagatactactaaactaagcttgagagaaatgagagagctattgcttgaggtgtgtgttgaagtgaagagagtgagctccttatatagaggtagttatgacggttgtggaaggggaattgtccgaagtgccatccaactgtcattgggatgcaatcctggacgtccacgccaaaacctggatccaacggcgcaaggattggttcggccgaaccaccaggttgggccgaacctggggctggcccaatctagcccaatttcggctggtggcctcctctattgctccactttgcagacttgtgaattttgtcccaattcatcgtgtcaattctgagttcttggcccattcatacataagtctgattgtcgacatcgtgcgattgatttatcgtctgtgttgatgtcgattctccttcactttattgtcattctctgcaaaatgttagtatacctaatactagtggaatattattattctaacgtaattatgcattgcaagcatcactagttctcctctattttggcaatattgatggtcgaaactgatcgataacaaccgtcaacagttactagtatatgccttgtaacatctaatatgtgcgactacgatatggttgtaacacctttttctactttgttggaacacttagttatgtgctactaggctttgttgtaacacccttttttataggttggaacactaaatatgtgctactagactatatgcccgtaacataggcagttgcatcacttatattttgtgttactgcggacctcagtaacacctttttgggtatgtagtagcacatagctgtgttacaacagccatgtcctgtagtagtgttaatgccgctgtaaactatctatacgcccttaaaataatcacactagtgcaaaaatgatttttctggacaaatactctaataggtttccataaatgtttgtgtctgtaaaaatcaactcccattttcacatacggctcagagacccgcacacaaaattcaatttttgccaaacagaccacttaaagcgtccgtacgcgaaaataagggtgtatttttgcatgcggggctcttaactcaccagcatgcaaaaatacccctcctcttcccactcttcttgtattctcccctcccctcccctctctctttctctctctcccggcctcacccacttctactctcctctctcccactcctctcctctgtcccggcctcacccactcctcttcctctcccagctcctcttcccgcttctcctccctctcgatggtgagcactagcggcggcggcgacaggcaagggtgcctgcgggtgtgggcgacagtgcacgacagtctcctccttgctcccccacgcgcggcgggtggtggtgggtgcagaatccggcaggcggcggccaacccccgcacagattcagtggcggcaccttcaggagtgcctgctgcgaaggagggcggcgactgcggtgaccgtgagggcggcagatccggcgattgcggcgatggcgggcgtgagcgacagctacaatggtagccccttgggcctcccccacgtggatccggcaataggctcgagtgggaggccaacggcggctctccctagcctcccattccaacgcggatccggcagcaggcagcatgatggcggtaggcacgggctccgcaacatgcgcggacgtcagcgacagtgtggattcggcctccacgcgcgcggattcgcggctggcgatgatggttggtacggaaccgccgacagtggagacgggagaggcagatccgccagcgacgatggtggcggcaaccggctagggttaggtctttgtgttttggaatttttttttgcgattttccattttcacgtgcgcgaaaatccgattttcgtatacgggtgtgccacccgtatgcaaaaatagcaattttcacagaccatttcactactactcatcaaataggtgtctgcattataggtgccggaagtgctaaaaccggcacctataggcctttgctacctccatggtccgaaaataataaaaaccggcacatttaagtgataataggtgtcggttctgtaaaagaaaacaacaccatgttagtttttcagtaaaaactgacaactttataggtgccggttttttaaaaaaccgacacatttattatcgagccgagccgagccggaggagatatttcttctcccggcggggcccacactcagaggagataaggccagctttctccatttctctcgatcttttctccactgctcctctctcgctttccctccctctctatgtggagccgcagcccggcgacgacggcggtaccggcccggcagaggcgggaggtatggcggcgccctcccctccgccaaatccggcaggggcgggaggggaggcgtggtggcggcggatggcatggaggtgcaacagcggcagatggcgggagggtaggaggcggtggcagacggtgggagcgccctccctctgccaactctggaggcctgacggtgggaggagaggcggtggtggcctggtggtggcccggtggcggcggatccttggggcgacggtggcagcggtggcgccctcccctccgccagatccggcgggaggggaggcagcagcggtggcggcggtggcggcgatgttggggggcttcggatccggcggcatctctgtccgcctcccctcgcctacggtgcccgatggtgtcctgttgcttccacctccggtgagaacctgtgctgacttgctgttgattgtctgaacatttatgatgtttgattcaatgatgtgaaaatttgatgaacatttgatgcatgaacttgttgttgagtgtctgatgtgaaaattacatgaacatttgacccatgaacttaattgttgattgtctgattgtggattattttctcttttttttggatttatttttggtgctttgaagcatcggctcggcgagccggattttttttttgtaaatcgtatacctcaaaggtgccggttcctaacggggtttgccaaccggcaccgaaagccctttctgtggtagtgttttgtgcatgcagctagccataccgcacgcaaaaaccccttttggacagtccgcaagaaacatttttgtaccagtgtcatttgcaaaacgttgtaaatggtatacaactttacagatgcttcttcgttgtatctccagtacacttataagttacttatatactctctccgctcttatttttttgaaaatgtatctattgactaataagtacactaataatatctacgccaagtattatataggttatatcattagatttgtgttttaaaatactttcatgtgatactgattttgtagttgttgatgatataatatacatgaaatagtttgatactacgccggaccaggtcatctctgacgggcccaaaccctcacctttgatgggtttggccttggtcagtgattagtggtcactgatgacaaaatcacctgtgacgggtgaaacacccgtcacagataactcatctctgaccggtatataagtcatctctgacgggttaaaacttgtcacccgtcacagataagtcatcagtgacgtgtcataactacctgaccatcactgacgactaatctctgacgggttgaaacttacgacccgtcactgatgacaaagcaagaaatacaatttttaaattttaaacgcaacaaaaaaaacctcaaaaaaatattttgaattttactagccatcctatacatagttacacatcactacctacaaattcacaatttttcacgcaatataacttgcatgctaaacgtgagattcaaacttaagacctcaaccaccatagagagcttccttaccaactcacctactcagcacatattgattactcacccaatgttattattttgtctatgtttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatagatctcactttataacatgtattttgaacatgtaaactttgtcaaatgaaaatattttcaattattaatgttgtagatctggttgagttctatgactttgatatggggcatgtatccatccatgtcatttgaaaaaaaactcaaaattttgtttttaaaagtagatctcatcacttgtaatgcatcttcggggatgtaaacgatctctaatagaaatgttattagttataaagttgtggatatcatcgagagctacaactttacttttatataggacatgtctcaatccgaggttttttgcaaaatttaaaaatttgaattttcactcatcactgacgggtcataactaccacccgtcagacataacgttacctgtgacgtgtgttagttaatgacccatcagagatgagtggtctctttttagttaaagagccatctgtgacgggttacaagtgcaagtcgtcacagatgacctcacatctgtgacgggtcctccctagtagccatatattgaagaggatattttttcggcccgtcagagatgactcatctttgacgagttgcgttggcccgtcacagatgacccgtcactgaagcctggatctgtagtagtaagttaaaatatgttattaaagcttggatcttagagtttgttagagataagagtcgtgtccgacaaggacatattttgtaatctcgggtataaatagaccccgaaccccatgtaattagataacacgtgttcaaatacaatctcggcgcatcgccacccttttactttcgttttgtttcgacgaattcttgctttcgggttgagttgcatcggtctcgatcttcaactagaggtatgacttgttatggcggcttgcgttctcgggattagtgcttccatcattatgatactctaatcttgtctacgtaagttgtcgagctatcatatatcttatataatctctgataatattgctatctaacctccaatcggctaatatctatcactagggagtagtcgattaggttagatatcgatgttggcatagattatataggatatctacccctctatgaagctttcaatagcttgattgtctagatattgtctttcttttcatacttatggctgcattagttgagtttgatctcataagtcgtgcttagaactataatctctagcctgcttcttggttgtcgattagagtagtatcggggtttcagccgatcttacctgatttagctttatattccatgtgcttagttgatatgctagatctgccctttatgttaagatcttattgcttttaggtgtattagactttacgtttgatatattttacttgctttaatatcttaatgtagagtagtatcggagtattagccgatacacactagatctatctgattgactatgctatgaatggttatagtttccttgttaacatatatttcgatctaagtgatttatactgtctcggcatggcgaccgatctatcccaatcacttgatttaagtatatgtcgacatgaaaattatatatcattgatatctacagccgatcgaatagatctagtttctttattattgcctcgcacagccgatcgatacagagatgacatcagctcgagtataaatgatacgtcatcggcggctggccgatcggctataatttatggattaactacggtttatttgtctttgtttcttgttgattgcaggatcaaatcaactggcatgctcatgaacctaaaaggcaagattttggacctgcactggagttaagcagatctctcaggcctcgtgtttttacatcaacacgcttttggcatgcccggtgggacccgagttttcgacgacctcatcccgatggctaaaaaaccaccaccatcacagggaacagggttcaaacctcctgtgaacaaaacaggtgccaaaaatccatcagctgaagtcgactcaaccaatattgtcccaatcacattagataggctgacagctaagcaaagggatgaacttgaacagatgatgagcaacgtgaagggcaagtttatggattcttttcaagagacccgtagagggaccatcgtacaaaagtacaaactgaaggtggttgcagccgatgaggtcggctcgagttcatcttagggtaactaagatactgcaactggctcaggtgacaagggtgacattccccaagatggtacagtggaagaccttggtgcagatggcaaccaagtgcctttgcaattcaataatttccaagataggatcgactatgctgtgcaacatgctttgatcaatcaatttggagtgctagttaatatcttaaccaacatggtgaagactgttgtcgatagctcgatagccgagcaccaagcctcaggaccagtttatctaccaggaggtgtttttccgaattataggcctttggttatagcaaattagcagaatacatctaatgctttgccggcttggccgacggctccagttttagctactgcgcaagttacatcatcagcaccaaggcagatagttaatcccagattattgactagagagtagccacaacatgctgggcaaaatgtcaatcggctgacccaggatcaagttgctgcaatgtttctgccgaatccaacaatagtcgacccaacacagccgttgccgactcagcaagcacagccgaggcagtagacggttcagccaactcagcaccaaaacttgtagcatgtgttggaaggttaaggacacctgacaatcagccaatacagcatcctgtgaaccaagttattcctgaacacttggtccatcacgtacaggccgatcaatcaattatgccctcaaggttattccctaaacatttggtgcataatattcagacgaatctccagaactatcaaagaaggaaatctgaattatcaatatcagcctctgtcacatcatgttcagtatcagcagacaggatcgccaacgtcagtacgctcctcaattcaatcagtttgagccaatgcagcaacaaatacaaggagtaccttagcaaacatcatggactgatatgattgcagatgtaatgagggaacagtttgggctcaagccaaaagatactggaaatttgtatcggcatccttattctgagtggtttgagagggttccattgcctagctgatacaaagtaccagacttctcaaaattctcagggcaggataatatttcaacttatgaacatgtcagccgattcttggatcaatgtggtgaggcatcggctacagaagcttgagtattctatagtatccccgggtaccgagctcgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61030 - DNA, 9310 bp, Oryza sativa
ttagccagcaccaccagctccctttcatcgcatgcccagttttagcattgtctgtttattaatatttatttttgcaccctctccaaagaaaattatgtttttgattgcttcatgacggttgaattctgttttcattccgacacagatgatctaattgttgatccaaggaattttgagtggctgagagaagctaattgtccagttgtaagtgttagcactttattgttgtgcagaagcagaactgcgtaatctacctgatgacttctgtgttgatttgtcctgcttgcttctgattgatgaaattggctgatggaataatatttggaaaaatcaacctaggattttacaaggaacctatgtttagtagttttattattctcttttcagtattcaccagaattccttgaggaatgtatgtttggattctgtacattcctaacaccaacagaattcaaggaataatagaaaaaaaaaaggaaacatgggacataacaggcaatcgaagatgcagacttcttcaattgagtagatttttgttatctttttcatcagaaagtaactgcatttctatcttattatgctttgtgaaatatgtttaaatttgtcatacattcatgtgttattctcatactaaaccaattttgtcatgcatttattttttttaattctcttaacccaataatttcatagacctttgaattagctttatcaactatggtatagtacgtggaccattgatggatattacatttcaggtagctgatgtaacgcatgctctacaacagcctgctggaaaaaaggtatatttaccaattgcaatgcacttctgctggtttaggcaagattcctagtttaatggccgactttggtgctactcaaatcctatattgaccaacaaaggaatcaacattatggggatgtccatattttaacaactatctatagcttatatctgatgtaaatttgcaacaactcgtgttcatagttttttgaacaccatgttaccggcccttcctcaaatatctatgtatttgtgcaacgtagacggttgtgaaattgtgcatatttggcttcttttgtaagcttgatggtggaggtgttgcatgtgggggcttacgagaactaataccatgcatcgcaaggacttctgttgctgtctcagttgatggtattttcatggaggtaaaacctaacaggaagctataatgttgccttttgtttcttacattgctttcccagtgacactccacaaataatgatgatattgtactcttgggacttaatttgatatataatcctacaacaggtacatgatgatcccttgaacgcaccttgtgatggcccaactcaatgggtaaacttctacatgtttgtcaagaaagttcatccatgcaatattttctttagtatgttgcaacattcacgctgatcttggtacgctcacttgttataatattgtctattgtgtttttgttagccactgcgcaatttggaggagctattataggagctgattgcaattgctgtaagttacaccgacattcaaattttttcgaacacaaatatttaggctaaaggtctttattgttctttctttgaagcgagtcaccaagggaaagaagccactcaagatcgatctcacccccttcaaagaataatctggtccagttggtaggaaataatgggcacacttgcttggttgatagttttgaccagcatatatttacctgtttggatgaattgctcgttgtatgtcatacattcgtttatcggtgactgttgtctgtattgtactgcctatacaataaagatcattgttttacccaaaatatgcttccctgcttttacatatatactagaaaaatgcacgtccattacaacgggaaaaagtgtatgataaagtacagtagatggctaactttcatttgagcaagttgggccgaggaaattggcaacagcaacagactatctggtcaatttatagccgctagctcgacttcatacaatatgatttcttgagtatatgtactccaagactggtatttatagcaagttcagcagtattccttaagtaggagggcgactcgtgtcttcatcatgatgctatcgtgcagtttcctacactaaaaaactgtttttacaagcagctacagcctcatttttagcttatgcttatgcttataagctaaaatttaaattttcaaccttaaatttagagttgattttggtgctttttcatcgtagtttatttttcagcctttgcttttagatcgctaataacatgtatataaaagttttatttacaaattattttccatttttaaatatgccgtttcgcttattacgatggagtccttaacatatttttacaaacggtcaaatgctccgcctaccatttaaggtttacaaaaatcgacaattttcacaggaaggcctatgatagagatggaaatgggatggagaacctgggagagagggggctgagggagaagaggagataaggatttagtcacagggctctccaaatttcaaaatttagtagcaccttcacattttgtaggcaaatcatttaaggtgccatctccaaaaatcgatttttacaagcaagatcttaaggcttctttttctccctcggtgcgccacccgaaactccaaatcccccccccccccccactaaatattgcggccatctctgccaccataccgctggggggactagagcatcgtcctcatcaccggtggcaccacgtactccactgcctccacccaagatgcatcgcaaggtagctgggggattggagctccatcctcatcgccggcacccccacgctctccagccgctgctgttagcttctcggctccaagctccaagctccgctctccggccaccgctgccgaacgggcgtcgcgaggccatgccattgtcgctcgcccccgcttcagagaggaaggggaagagagaagtgggatgtgccactgacaattgggatccatcacttttaaatttatttttggtaactgaaatgccacgtaggatcaaaccgccatcaaaaccgctttagggatgtaaattgatctgattttaatagtttggatactctatatccggtactgtgatttaagaatgaaactcaaactcaacatgagaaacctagaatgaacttattcccagatttaatgctagagtatttccagtcctagcaatgcgaggcaaggtagttatggaattttttttatttttaatttttttattaaaatatttacaaaagtaattttgtgtttcaaaattttacaaaactagtcgcctgccgccctctgggagggcgatgtttaaaaatcgccctcccagagggcgattttcgtgacgtggctaaccaccggtagcgtacgtctaacggccggctacagggggcctgccttttgcaggcggcccccttgccgcccttacggagggcggtttagtactgtgcggagggccgcctgcaaaagggcggcgaggaccctggttttttttgcaggcggcccccttgccgcccttacggagggcggtttagtactgtgcggggggccgctgcaaaaggcggcgaggaccctgtttttttgcaggcggccccattgccgcccttacggagggcggtttggtactgtgctggttgccgccagctttaagagcagcccccaggtgtttagttcggtgcatttagaaaatttagtaaatcatcacttctaaaattgtgaaacaagaaaaaacattattagaattgaattgtacgttgtttcggcggtttggagcccaacaaggggtgtttttacaccgaaatatttaattgttactgtaaaaactacataaatcattgtttcaaagtcaaaggaggaatagtttcaaactacataaatctaactattttgcaattaaaattttaagaaataggtattttacataaacctgatttttagcacttaaaattaggtaaagtatcgttttgaaacgaacaaagtacgtgcattttgacaaaattttaataatttaatttttcatataaattggagggctatgagggggtttgttacctataaattgtaagttacgcataattctcgtgtatgttgaatcatgtacacaattgaaggtggaagttataaaaatataagcaggtacatataaattataaggatacaacgtatcatggcgtcaaagaaactgtagaaatcggaacgatacagtcacattaaattataattcatgacgcatacaacagcacaacatagtaattaaacattataatgacaagatagcatggataaaagatacaaatttgtcggtcctaacaaatcgagcctgagcttatctaccgaccccttccgcgtcgttcaacatgtattgcattttgatggtccttctctcactggtactctacctgtgtttcagactcagttatcttttggccatcatatgtaggattgacattgtcgatccataaagtgaatgcgcacctccttggattgccctgagaaacaaacatagttcagataggatagtaataataagcagattctacttaaatttggaatttgttatacatacaacgaaattgtcgtctacattggggcagacaatgtagccacctggcaattgtttgttctgcaaacgaggtagccacctggcagcgatctctacaaccacactttggatgctccgaccatttaggtaaacctaatagattgttcctccagtctaagcttgcaatttgtacctgacgttcgtactccatccatgcctgaatgaattgcgtggtcgtctcaggttgcgttatcgtttgaccaatggaagtaactctgaccgtatcgatccattgtatgaattgacatttcctaacctcctcctatttgaaaatttgtgtaaatagaggtaagtgcatgaaagtagtgattagtggtacccaaaaaaaaagatacttacgacgaaatcatcgtcgtcaatgttaggacacacgaagcatctttgtcctcgagttcgttgtcttacggaccttatcacctgacaacggtcaccacaacgacactctggatgttcccgccatgtggggagtcttagggggtttacctgccattctaaagcttctgcagcaatccgacgttcatgctcatccttccgcctgaggtagtccgatcttgattcactacgtgcatatgaacgtgttccgtcgttttgtgggttctctgtatctacccactcaatgtagttgcacaatttacggtatgtctgcgtaagatgttatgatggagtagaaatctgttagcttttgatgtgttcagtatagttaattgaacttgtaacgaatgaatgatacctgatcaaggtttgcacattggaagaatctcctgccccgagtttctaccatgaggcttgacttaagtatgcatcgatccccacaagtgcataacggccggtcacaccatggtggaaacctaccggcgaaaggatcgcttcgccagttgagacgctcaagaaatggagcttccattctctctagatgtgtgggaagatgaaagatgatatgaagagcttgtattcggcttgtctattatatagggccgcaactagtgctataactagacttaattttgttcatctggcgcacttgatgtgacaacacgcgcacgcgtgagcatcattcactttatctccgagaacagggccgaaagatgatagtgacaactcgaactaccaaggtatatgtgtactgtggtctgctgcgctacctaaatgagccaatcttcacgcgccgaaagtttgttgtcgtatgcgtaagtagttttaatatgcagtgtattgatgacacgagcacatgtgggcagtaattaattcacgtgcggaatctatggtgcaaagttgatcctgacaactcgacgaaacgctttgtctataatggactggaccatcacgcgccgaaagttaggcttcgtatgcatggaatagttgtagcagtggacatgtggaaggaacaaaatatcagagcgtcaaggcaatggtaccttagtactaacagcaaaagtaatactggtctacacagcaaaagtaagccaaaagaaaagtgcacacaaccactcaataggtggaccactactgccgaggactcttaccccggtccctcctgccctgcgccctaacgtgtccctgggaatacgtcagacggtccggtggtacggcacggcctgctcgaccctcctgcactggtgtgaccagtggctgctcctgggtgtgcgcctccagagctccgccaagctgtgaggacccaagtatctcgtggtctggcgccccgtgaaagtcgtcgtcgtagaaccgggcagtaggacctgtgccaccggcgtgtgaggaagaggctccactagcaaagatccctcgcggctgcgtgtcaggacgagggatcggcaatctctgtgacaaactgctgcctccgacaaagacgccggaaggcagacggggacctgcgcgtaacgtatttagttaggacgtagtcatgttaccgagaataaatcatatatacttgaactaacctctgggcagagcagtaccgtgcgaagaaccagttgtaggtcgcacaactccggtactaggggcgcgtggacgtggtggtactggaccaggtggaggtaccgcgtccatggcgctgcgacaagagaagacgcggatgacagcgcgtatcttctcctgcatccggtcgaaggtaatcctctgctcagcatcactcaagtgtagcccggcgtccaacctcactgttatcgaggtaatatcggcgttcacagctcgtgccgcgtcggcctattcaagacataagatagcatgtcagtaggaaaataattgaaggacctgagtagaaacaattgccagaagtgagtagaagtttgacatacccccatgaagtagtctcggtcacggtgcgtggggtactcatccctgacagtggcaagtcgtggctgtggtgcggctggagtgaaggtcacacggccacgagtgcgaggtaagtaccaccgtaggtagtccctgtaggtgtcctctgagtgtggaacgaacgcgtgtagtgcagtgggtggtgggagatctggacggcgcatcacgggcaaaaagcgctcagtgatatcctcctgccagccagcaccaccgtctactggaccaactgcggctcctgccagtggtagtccgagtaggtacgacacgtcctgtagtgtcggagccatctctccacagggaagatggaacgtgtgcgtctcaggcctccagcgatctgccagagtggcaaggagtgaccggtctgcatcccaccgcctcgcagggtctctctcgtctgcccctgcctcaacaagcctacaaagcggtaggaggcctgccacacgcaacctgcataatggaaagtcaaaaattagtacatcaaattgaaagtcgactcaaatgtgcttaaaaaaaattgaaaataggcgtaccacggaacgtgccgcgggtcgacacgcaacagctggtgtgaaggacgtggacggaaggtgccgagctgcgcaccctgtaccgcagagaggtacgagcggtggctcctgtcaatgccacgactcaagagctcaggtgtgtcgtccgccatagctgcatcaaaaataattatcagaaccataataaatataaataacaacaattcaatgtgcaattacttaaacatatgagtaattaatgatagtataaacttcgatgtcgcatgctacagagattataacaacagtacaatgctatttcacattggtcacaacacaacaacatattgtttaacgattacaacaaaattcattgaaattacaacatatgagtacttggtacgagaacattaggatacaatactcaataattcgcaatacatgactactaatttcatcacattacatgatataaatacttagtctcagtacttattaggatacaatactgaatagttcgcaatacatgactactaatttcatcacattacatgactgaaatacttagtctcagtactaattaggatacaatagtgctcgagttcatggcctaacaatattagaccatcgcatcgcctgccgcacgaggacgcctgggacgtgctcgtctggttgttgttccttccccagctggtcttcttccatcacttgcttctccagatggaccaacatcctcgacgcttggaccctgtgcagtcttcgggcatttcttgtaagtatggccgcgttggtcacacttgctgcagcgtagagtcctcccaccagcttccaactcgtccatgtcatttttgatgcgtctagtctgacgccgcccctttttcacccttaacttcgatggatcaggaatgaaaaaaacttgggacctctgagttgtgtaagatcctgagatcccgaacccatatatctcctcactccaagtatgaaagattgcttccttcctgaaataaggtgacacgtacacatcgggacgtatgccgcaatcacctgctgctgcaagtacgtgagagcaaggcagatgtcgaagcttaggcttcatacaggtgcaactgcatcccccatcagccttcaatacacattcgtgcacaacatgcttacgcatgattccatgcctgctcctatcaacacacattatttcataccgatgaacttttgttccttgaggcacaactctatgcctctgtgcctttgcaattttatcttccatgtacttagtcactacgctgccaaatattatcttgttatctaccattgagggaccaattttcttgtatcgatccctgaagtaggcctgtgtgccgtgaaggataaattcgactataccaaccaacggtagtccttgcactcctcgcattacccagttgtaaacctcggctagattagttgtcattatgccatatcgagaactattggtgtcgaacaatagagaccacttctcctttggttcattctcaatccaatgactgaactttcggatagatgatcctgacctccttctcattgtgggtgggtcatcatgtagtgcaccaagaggtactggaggctcgtcaccttcagcttgtggtcgacgagattgctcgtcagtttgcttgcttgtcaactcatccaacttattccacaactcattaaattttttctcttgattctgtgaacagagcctcttaaaaagatccataagatgcttgttcttgaattgcttgtaaaaatagcacccatgtgacgcatgcaccaccgactccgaacatcgggccacttagctggaattcccttctcctcccaaccattctgcaagtag

SEQ ID NO: 61031 - DNA, 1131 bp, Oryza sativa
ggccgtgtatttggccacctttccggccagagccaactcggcctgctgtttgttgccccagaggaggacaacatggagacgatcgtcgcgcaagatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 61032 - DNA, 12813 bp, Oryza sativa
aaaaagaatattcatgcccatcgcatctgctataccttgatccaacccgtgtgcaattcggataacacaagcagctacaaaatcacaccgttttggtttttggaaccagtcgtgggtagtctgtaactctgacttaagcattttggctagaaagtgagagcgcttggcaatggctagagacggggcactgggagcaaccaagcttcaccttgctgcagagtgtttctcctagttccatcattgtttggttgaagtctcctggccttgaaaggttaacaggttgaccagtgagtcccttgtgatcaggaaaacaatgttcaaaagccatgtggaagttttcagatcagtataaagtttccaattcaaaaatatttgtatgaaccgtttcaaaaaaaaaaagctgtatgagaaaaatgacatgattagggcttgcacttggatggggatcagggaactgcaaattgagcttgtaaattgtattgcaaattggctatatgaacatgtgcattttgactgaagttgtatacaggtagttcagtacaatgccaatgatgtgcaaaataatgataatgtaatacaatgtatcaccaaactcagtgctattttagtacaagtcacagcagtaggacggaagaccttggcctggcagactggtggatgcaggtcagactgttttcggaagtgctacaggaccaacttcgaccgcacttgcttgctgatttgctggcaaatatggaaggaacacaatgcacgggtatttgatcaacaatccagaagccctgaccagctagtggaagctataaaagaagagattgtggtgtggaaagaagctggctgtttcacggtatataactcttaattttccagctgcggtgttgtagttgttcctagcttgtgggggctgcggctttgccacagcaccaattcgacagcctactgtcgttataagcaagaaactctttgtaactctattttttctcctatcttaataaaatttggtcgccggttcctttggtcgacccggcaaaaaaagtcaagtcacagcacatagggatatgtatctgcacagatttatcagtgatcaacaaagatagttgcttaccaaatctcttcactgttgagccttggattcttttgggttatcgggaataacgtatagcctgctgataacttgaacaatatttccatccccaacagggacaacctacattagcaagaagttgcgtaatcatgtgaggatgtaaactcttcactgctgagattcttttgggttatcgggaataacgtgtagcctgctgataacttgaacaatatttccatccccaacagggacaacctacattagcaagaagttgcgtaatcatgtgaggatgtaaagtatcttagccatggtgatttgaataggatataaattgtgcttctgctgtgcaagggaactcgcattttcaacaatttgctttgctccctactttgcaacaaaaaaggtaaatcttattaagctacaaagatattcatcccaatatgcatgccgaaaatattgctttgctccctaccaacatttctattagctgtctctcaattcatctttcttgtgcattgattctgtgtccacttcactaaaatacgagcctaactttttttgctgctgccacaataacaacagattctggggatgcaaatcaattgctacatgcccatagacaaacttgataagtccaatgagctaaagaaaacacaccatctgatgagcacgtaagaatgtaatatccaatgttagcaacaagaaccaatatggccccaactacaacacaaacagtaatactatactactgccaatattcccaaaataccatactactgccaatggtaacaaagtgcactgaagagtagagcttacaacactccagccttccaggtaaggtaggtctcccaaagaggttggcaatgcaccagtcaattgattgattgtctcaaggtgactgcagttcagaggaaagcatcctaaggagtaaacaagaagaataaaatttccaaagtatacaaaataatgggagcacacatatactgtaaatcacagcagtaccgcacccagtgaaatcaggattttgaccagataatgagctaccatcagtacttctgaatttgaaaaaaaacaattatgtagatcagataaaatccaactattagcagaggagaggaaataattaacattctgagcttaaattttacaagccccgatagcctcattaatttcctttaatgttcttccctaataatatgctggaaaaaataatccttagatttcaaatacttcaaatgttgaccagaaaaccacattaagagaaggcagatgacatgaccattatacattgaaagtatctggggtcttgcctctgaactgcattcacccaagaccatcatgctcgtaagcaaaggtcaccaccctctttcacccaacccgattcagagtaccgtgagaccaagatggacatggtgcttgctgttaatatttaccacaaaacagaattagaagagagcaggtgaattttcttttcatctattctaaaacacacagacatacaattgccttaccatcttgtattggtagatctccatggaattcaagatagagataggtcgatcagacgaatcatttgtcctcttgaatccaaaccaaaaaaagatggaagtggacatggaacattcgttcattaagcaagaccttccctgagcattctcctgtacatcaacagttggtttactgaattttgtcttgcctgaaatggctagacattcaatatttgcaaaatatgaaactgcccatgcatttcctgggaaatcttccaaataaatatggtaggtagagcacccattttaccaactacagcagtttgcatgaccgaccttttcagatgctactttgtagacactgcaaataggaattttgtagttgatattcattgtccctagagcaacatcgagaaggtaatttgctcgtgacactaaatcaggcttttatattccatcaaatggagtattggatacctgagcaataataaaggaacagaggaggcacaacccttcagctagttgtttacatcaaatgttcttttcttaaaaagtgctatgtgtgttgcagcatgtaataccaattgaagtggatacaaagatcaagcttgttaagcacacattactgtagttcagctacctctctaagacgaccttttcatcacagtagcatgtgcagtcaggtattcctttaacgcaaaattatatatattattgatgttaagttttacaaatgaacaacattttgtaatctactaatattatgggtttctaaacaacttatttcatccaaatgttttgaacccatttaaagctattgacaacgaaagtactaacacaatgctatgcagtagtgcatacctgactgacacattgctttatgcaccaaactttgtgactggacggtccaaaagcccctcctcctcaacaacaccctcaggtaggccagcggagcatcttcttctgtttaatattcaaaatcaactacttttcaaggaaaatatacatactaatgtgaaattttaacacgtattttatgtgcattgtgctcacaagcagttgtattactaatccaaatgagaacattggaagtttgaaatgcctatgatagtatgaatgtatgatgtcaagtaaactgacctctccaaaagcctccatttttaaaataatctttactgattcagtatttatccctgatctacccactgaaatgacttattccttctgcagaaatttagaatgacacactatcaacacaatatgtaattgaagacgattaagttcacacattcggattttcattgcagacatactctatgtaagatgcaccctctaaagacgacaacttgctagtgtcaaactcaattatgtcttcagtatttggttctaaaggaaagcaggggagtcctccacaggctcaatggttgaggtggaaacagcacctcaataggttcaatctcttcgatagtaccccataccccgttcctcagacaaatcatagaactcatttggtataccatttctagcaccatcacaacttttagtacgaactgctgtgtagtagctctgatttccagccaacagaaaaacaacacctggcatttcttgattacttctattttcagattttttttttgagtacgttataacactttctgaaaaggattgcttcagaaacaaacattagcacctcaataccaggaaatgaagagaccaaaatgttgagagtgccattccacaggaagattggaagcagcaaagaaattggttggcggctgctttgttagatgggatctaccatttagatcctcaagctggttagatctgggaggttttacaactgatcaaatatttccacaaaagcaccttgctggatttctttgagcagtatcaacatgtaatgcaggagcctttcccttaaagttagtcaaacaatgaggtatttaggccttcaaaaaggaacattctcatgaaaaatgagaaactcacagaaagaagggaagaatcaaacaagaaatacaaagttgacatattgaaaaagttcataactagaagtgttaaaagctaaattttctccaagcatgagaaataaaatatttacaaactcacatacatttttaccctctaataatttccccatcacctcaggttccacatatgcaattacacatgattattaccttataagttagtgactagcatcttccatatgaatcaggtgccacaattttttccatgcatttttagttaataatttgcaaagattgcttagatgtaaataagaacttaacatggaacagaaatatattaatacttcaaagtatttgaaaaataacatcttatttttcatgctatacgtaaacaagaaacagcatcaatgactatgtacaaaagagcataacagattacctgagcgaaaattccaactggaggtgaagggattccaagtgatggtgacttagcagacattggtgtagggacaacaacagaactgaaggtatggccaagattgttacgccctgcttgcagtcaaaggattcaccgtcgagccgccagaacagtggggatgaattcttttcattatcccgacaacgtttcattagttactgtaactgtctatttaaacagatcaatatcctcacaaaaactgtccccgcacagcatacacatgacattcacatcactagacgatgccttcttcaggatatgcatttccatttcccaccttcccatcgtctcctacctctagctccaggccttgattcttccacctgtaacacaccctgtggtgtgacattgccacccccttgaggcgatgacaaaaaacaagcttacatatcatggtaatcttccaagtagcacaagccgatggcatttctccccattgcaccaacacttgagtgtgaacagtgttaccctttttaacaagacagcaattcagaattgcagatggttccagttctctaatgtgctgttgaaatggagagggcaattgagaaaagatcggaacatgagctggcacaaactgcttgagctgagagacatgaaagacagggtggataaatgaatctccaggaagcctgcaatttgtatgccacttccccaatgcgaaacaagatggaaaaggaccaaaatacttaaaagctaatttgggtaaagctgaagcaactgatttctgatcataggttagaacttcaaatacacttgatctcccacttgaaacaccagcataatgtttcattctatttttggccttagacagctgctgctgaagcatgtcagaaaataattgatgatcttgcaacaaagtggatgcctcgtcatcaccagcacctccagtaaccagctcagaaggaaggaaatggcatacaggatcagtaccgtacagagccttgtgaggagtacagaacaatgaagtatgatagcaggtgttataccagaactgaaccaatgataaccaagaacaccactgagaaggagaagctaatgtcgcatagcagattcgcaacttcaaggtagcctgaaccccagaacatcccacaaaagcagaagaatgataagctgtgatttgactcagtctgcaatgcagaattttcaacaacgcatactttgaccttatgtttgatgagcccatccaccaaagtaaacccttgagaattagtgcctgatgctgccaattcggtgagaagcttctgagcagaaggatcaacaaccctcctactgctccttcctgaccccccccccccccctctccctttttttctcttttcccttaatcctctgcctcttccctgttcgcttgttcattgttctcacgtcgaatgtcttcaagctggccaaactttactagggaagttggtgcaggtgttcgtatggcgttctttacagtgatgccaaatgagactagatgagaaaccaagtgatcacattcttgtttctgcatctgcaaaatgagcgatagaaaaacacctataatttcaatacaccatccatgatgcatgcatgccgttcgaatgatgagagaaaacggagatcttacttgatctcccccttgcacatatcgaacaaaaaaatctggtgctgttgggggtcctccaagcccacctcctaagagaccccgtgctcgctttgaacacatctctgcagttgcagcagaagtacgcttgtgtccacgtccatgtaatgctggctcctgaggtaatcttatgtttgcatcacccaccccggggtcaactggagaccatttcatctctctcggagggggtgcgagactctcatgctcaaacaatcctccattccaagcatcaacatgaaggtaataaaatacctgaatcagatcatccaatgtaaccaatacatcaatgccacagtcatgtggatggtgtgttaaattcgtcaaggaccccatcacttgagcactaattgaactccagttcttgataaaactattgacatagtctctacccaactccggtgtgatcacctcaaggattgcatggcaatgacgcctatggatttcacgagatttggattccataatcagcacaacaaaaagaccaatccacactggcaagtcctttgggtcctgacacttgcttggaacaaatgtacacaatccgtggaagcattttctaatgaattgcaaattaacagtagtgtttcctgtcccattgggcgatatggtatggtgatttcctttgaatctgagaaggtggctgtggacactatccatataaaggcccatcaaatcttcaaattccatttggaaaaatccatttgtagtacaaaaaccaattagccatgccatcctggctaatactacgagtatgacatagcgaccttcatgttgcaggacatagtaaaatgtcccatccaaaggggtagtgtatataacttggtccccaaaacgtatgcggaagggtgaattcatgagaagccaatattgaaaatgagcctggcatctgttgaaattttccaagaactcttcctcagtaccttcaagacgtaatgtcactgtgttctgtgagcaaaaagaagaaagtttaaattaatgccatagaaactataaagagaaacataaattagtgaataaatccaaaatataggaaaacctcatattaatgagacaaaagaaaaaaactgtccaatctaatttcattctagaggtataacagaccaaagaggcaaagaacacttgggactacatgatccaaagaactctcctatacagtaaatcataaaaaaccaattcttgataaaacttactcaaatgaacatactaattgaaagtttagaggctcccaaaagctcacactgccggaccacaaacactggcaacagcggcatcctatcttacccccagtggcagacatcgcacaccccatgaccgctcctagtaccaatactgcacactgcctacaaggggtcgatgagacaagtccccttcccgttgttatgacccaagctcgtgagagatcaaatcacatgaactggtgacagtgttatgggtagaatttgggagaatttgggggagaaaacaaagtaggtcaaggggaacaggggaacacaggagagaagagaacacaggaattgtactcctgaactcctcactggaatcaaaaactttcacatcaccataatatccttgtaattatcaaagccaagagtatgcaattattcaagccattaaatctcatcaagtgttcctctgcatctagtttatgtgcattgccatccacaagcacacacgatatttcttaaaacacttgatctgctgcctctgcaaacaatgaaactccaccgacatgagtgagcacgatgtcctttctcctcagcatggaggatgcaactgatcttcaactacacttattggacttgaggtatagctaataagtgaagtgtctgtaggactgtagctgcagagcctgtcgaggtggcaagtccaatgtccaggattcaacatcaaacacatgggggaatcgctagcttctggttgctggagcacgggctgcacatacttgacatctaacaagcaacaccatctaaccctggagttcatgttgagctcatgctgcgtcttggcatggcgtacttgagtgagacgacagcctccacataagtaaccgcctcaattgcactcatcacccgctctgacaatacggaacaaatacttcgtgaagcacctctgtggtcactggacagagcacatggctcacggtgacgcgaacaacacttgctgtggttagctccttgtttcttggcatttcatcaaacatcttctgggcatcaacactggaggtcacctctggatttgaaacttgaacacgaggaatccgcgcgaggtagaaggccccgcgagaaaggtggtagatcacccagagccatggtcccaagcttggcccccaaactcatcaagcttcgcccagaatcaaaatgccaccacacatggcttccttcctctgttcccctgctgctccagtgagtccaatggcgatggtctccgtcaaccgccgccttcccggcttcccgctggttgcgctcgcgccgccgccgccgccctcagcgccaccgtgtggtgctctctctcgctcgccgcccgcgcgccactgccatgcccctgcggccatgcgcaaccttagattcctcgtcagctgggctgggctgggccgggagctatcggctgacgcccaagaacaaataacccacgccttcccgcccttgatgccgcctcgcccgccattggtgctcctccccggctgcgcgccgcggcgccggtggcggccgccggcgaccaaacgacgacgggcagcggcggtcgatcccaatgcacgcaaagatgatcggggaattcccgcaacggcgcgacatttgcttataccgcttccgatccatctcaacaacaacaaatcgatcatgaaagaaaccctagcaaaaccccccatccgacaaggcaaaggaagaagaagaagaagaagaagaagagcaaatccaacaaggcaagaacaagaaaaaatccaagaagaacaaatctcttctcagaaaaaaagaaaaaaaaaacaagaagaagaacgaatccaagaaggcaagaagaagggaagaaccgatcgatcgagcaagcgatcgatactcacccgggggcgtgggggaggatgaaccgccgctagattcttcttcttcttctccctcttcggcgccattgccggccaagaagctttggctctctcctctgcctccggcggccggcgggttagttaggtggattaattaattatttgccacttttacggatggtgataaatgatttgccattggacccacatgtcatagacacatgagggcccacatgtcatagacagcgagtggcaaataattaattgccacatcttaaaagtggcctagagttaaatgtcccttattaggtgaccgttatgctgagctggcagaaatgctgactcaaatatctaatttcttgtttttttccctaagtgcaaataatatgattggtttccaacctgccaacacatattaatatggagtattttgttacccttgtggaaaatagagacgtgtaaaaaaaatagctcgtaccaagcacaggcaattatcaatttaattcattgacgcatcatgttttactttttttttcggctgaatttttactcctatttggtttgcaaatgattgtggctgcccctcaatttcatattgataaaaaggcagacactctaaatatgcaaattaaatgggctgagaaatggagtaaataaattagatgatgagcttgccgcaatgctgcagtatatctgtatatacacagaatatacagtgctctgctatgtgaacccgccacctgaactcctgaagtactgagcattttttatcaaaactccaatcaatttcttttacaaaaagaaaaggttatatctcccaactttccgaattcctggtgctatgaggttcaaaatcattagctcaacaacacatatcgtcaggtgaattccattgcccattgtttatgaacaacaaacagcagcaaaaacacaccatggtttggcttttggaaccactaagtgcgtaacattgactaaagcattaattttggctggaaataacaagcggctgcattatgttgctcctagtttcaccattgctgtggttgagatctcctggccttcaagagtcgaaccaattgaccagtggatctccctgtgatcaaggaaacaatgttcaaatgccatgtcataaacggacaaagctgaaatttcagagttttccacagattctctggggacaacaccagctttgccagacagggaacagggccaaaacaccggccaccaaccaacttaactgctgcaactctaacagggatctcaggaagagaaacaaaaacaaaacgagtttaggttctggcaaagaacagcaaggctccaaaaccctgctcagcctaaaccagggtaacttctaggatcttcaccgccatcgactccgcttgagcttcttctcctttgcgcatcgacctactccactgccaaaggaagaaaatcacacgaaaaacaagggttagaggtgtggacaagattttgttcgctgcacccagcagctgagcagcataagacccttttcattcattttctggccaggcatcttctatctcagaacaaagaatgcatctctcagatccttcccaattcttcttaaccagataggaggtggattgaatcttatctttccaagcaagccatacaaagtgctttaccttctggggcattggctcttgccaaatatctagtcctctcatatctttcaccccatgaaagtttagcattttgtagcaagactttgtagaaaagcatttgttcttctcaaaaggccaaagcatcatgtcttcctcatcagtaagagatttcagccattcgttgcccaaggttttcccactccacctccaccgggccaaaagaccttttgaaagaaatcccctcaggccaagaggccagagcatcaggcaccagaatctcttgttggttacagatttgttttcaaaggacaggacccagtccaaacatctgaccagaaagagatatgagttccttatcccaatttccattcagagttgttttggacccagaatttaattgagtgcaagcttctacaaaattgtgaccctccctccttttcagattggaaaaaccccttgatctgtagatattttcttcttaacagctctatacaggggctcatgtcccctgattccagcttccaaatccatttggataacagagcgtgttatacttcattgtttctgtgaaccccatgcccccaaactctttatgactgcataaatggtcccatttcatcatgtattttttttcttggagccattacctgcccattaaaacctgctcctaactgtgttgatcttgcgatgaatgcattctggcaaaagatagaaacccattgtataggagggaatggatgataggcaagaattgataaggatatctctccccccagatgagaaatttgacttccatgtacccaacctcttttctaacttttttttgacgagaacatcttttctaacttatgtggtaggaattttaactcagagatccctaccttttgtggactgatgggtaaaactagatacttcattgggaagaacctgcagggcagttgagcatgttagcaactctgttcaactcattttactccaaccccacagcaaacaccttgcctttatcatagttaatctttagaccagacatgtcctcaaagcagtaaagaaggaacttggtcacagcaaggtatgggataaaaatcactgtatcatctgcatttgtaggtgagtcaatcccccagggaagaggtgtgggaccagccctgttaggatattggcgcttttggctgcatcaaatagctggatcaacgcatcactcacataattgaagagcagcggagagataggatcctcctgcctgaggcctctgtaagtgctgaaaaaaattagatctctacccatttatgttgatacagacttttccaccttctatacagcttttcacccagtgaatccatttttcatgaaaatgctctgtccaacaccccataacgaatccccatctcactctgtcaagccttctcaaaatctagtttcagaatcactgtcaaacaccccataaacgaatccccatctcactctgtcataagccttctcaaaatctagtttcagaatcacgcctcttt

SEQ ID NO: 61033 - DNA, 726 bp, Oryza sativa
gggcctgttcaacgtggtgtagcattgatcagtggagatttaatgtcaccttaattactcaacagttttactgttttgctaataaaatgttttacaaccgcctttatgcaaatagccgcaagccatccttgtatccccttgcacgtctgtatcattggtgtggcttgttgagtacggtggttgtactcagccttactattattccccctttttcagaagtatagtgtttctgagctaaagacgaagttggaggatcaaggctcagaccccagttgagttttgcctgtggagtgaagctgaagccccgctaggatcgccttttccgctgctgctgctttcgcttcggtgcgaggactaagtgcctcttctgtaagtattttatgctttatttacgtttggaactatatattacttgttgttttgtgtaccctggctggtcttggacagggatttaatacacaaaatagtctggaaatttgggttaaatttctgggcgtgacacgcttcgactcgttcgtctcgcctgtatcctcctccgccgcccttccctccccttctccctctagcacctgcagcctccccttcgctcccctctcccagccggccggctggccgcttccctccccctgcgtccccctctcctagctggccagccagccgcttccctccccttgcgtccccctctcccggacggccaaactgtgagcaagcggcacctgtgaccgg

SEQ ID NO: 61034 - DNA, 983 bp, Oryza sativa
tggttatacgttagagggtctataacgttataagccgagaaatgagctgagaaatccttcccaacagttggaccttttaatctactactattggtgcttctgtctgtattagcggaagcaccaataataagagatcggttcttaattattaattgttgttaagagacatgcacataatctctaggcgtttcataatcataaaacttttgagatgtgaacatacaagaacttggttacctgtataccaagacacgatagcctctagatgtaagattttgatggtacttaatactgctctctatgtcctgagaataaggtagtccatcgtcatggcacctcacccactcatccacagttccctatatatgttatgaacatcaggagaaacaagaaaagtgtgatgtaaactgcaaaagtgaaacactaccagtcgatatggaaaaataatattaatttaaataccttttttattccaagattttcccgtgtgttgttgctgttagcccagaaatatgacaaatagttgggataggtctgttgatagaagaagtaatgtattgattcagcaaaagttttgatggcgtagcaagatcttatatatgccacatcatccttcactaataattattacatttaaacatcatgcaagcatgctatattatctataattttataattattgaattttagttctttaaaatgcaagaatgttaaatcatcatcccgcataattcttatcttactataaagctataacccactaaattctaaaactctacatgcaatgatgacacatcatctttcactaataattattacatataaacatcgtacaagcatgctatattatctataattttattttataattattgaactttagagcttaaaatgaacgaatgttaaatcatcatcccatacacctatatagttcatcctcacttagttaatattatttctctcctctcatttagctatatcat

SEQ ID NO: 61035 - DNA, 1216 bp, Oryza sativa
  unsure (1)..(1216): unsure at all n locations
nnnnnnnnnnnnnnnnnnnnnnnnnnnnnnnnnnnnnnnnnnnnnnnnnnnnatcctccatttgtgcaagttacacgatatgcacatccatcatcatagtggtatgctggaaatccaacgcttaaacattgcaaagcacctctccggctcaaactctggtgcagtgtgtccagcaccctacatttggagagagtaaaacagtattacaatgcatattcaaaacaagtaaaatcacaaacaataattagttggtcttttgtcaagttcttgaatttttttttcttcttctatcttgtcgttgatactgactaaggatgaaatataactggtttctttcatcgaactgttaataatgactacgggttagatatagaagttccttgctgtagaggccactaaaggaatagtttacatcatcaatgttgtttgattatttgaatgctagaaataaaataaattaattatatgtcctacgttcagctcaaagcatatgttattggatttgtttccattatacgaaaacggtcaaagcgtgcctcttaggctgtaattttgctgtatatttgtgttgagttgcatcaactgcctttggtcattgaaaaacataagctgaatgaggaagagagaataatacttttatacttcaacactccccaatgctatacgtacaagcaactcatagaagtgggctgtgtttttttatttaactatgatggaagccggtgcagatgcgtgggcatattagttattgttttatgaaagcaatgctaaaagaagtcgctaaaagaagtcacctcttatcatttctatgacgtgaaatagaccgtaaactttaatatatttaaatgataaaaatgtctcctagattaaaaaatcacttttgtcccagccacataatgaaataatatgtggagaaattataattacactttgtcaacttatgtcacgctataggatagatgggaggccattaatatatatgttgaccatgcacttaaaattgttatggcaatggaaaaagctatggttgtttcaatttaagtgaaaaattaaaaaccaaattattttacgaatttattagattttctccaaatggctcaacttagtctgtattgacatttgctattttctgtttttttattttacatggttcttattttaagttagaaatataggcattgtgtacatttaactgttattttagttatgaatatgg

SEQ ID NO: 61036 - DNA, 1916 bp, Oryza sativa
atatatatatatatatatatatatatatatatatatatatatacatgcatgtatagtacaattcatttgctcgctagctatagctacgacttcgacgctggcgttacgtcagaagaggaaggaccgacgttatgaattgtcgatccgtcgtagtagaattcaccatcgggattaaggacttcttcgttgatgaaccccatcagttgttcttgaacagccgtgataaaatccttgtgtgggagattttccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtggtcatactcgcatacgtagtagccgcataagttagtaccctggtcctgcttcgcacactacatgagaaacgatgagagatttaatatactctttatattaactgtaattagagattcaattcaatataattttggatcatgcatgtactcactggaaaataaaacctccgtccaagtttttctttccaagtcccgtggaccaattgacggaaccgatcccaagccctacatgtgcagttgctagctatgattaattaattattacccgagatcaacataatagcaacagagtcccgtgactttggaatagatggcattatattacctgtctatcagttggaagaccttgtcaaaaaccttctcctctttattcattgagtcgtacacagtgacttgcatgcgtccaagtcgaaaaagaacaggaccaagtggaatctggaatatgcgtgagatgagataaatatcagaatgtacatgttatatgtatgggaatgaaatttgttcgaacgacaataaaaactcactctgtgttgtacggcaatagtatgaatgtcttgaaatgctgctgcgttaggagatggacgagattgtcctctgtatctttctcgtacttgtcaatcattttagtgttaatttttcgagggtcgatgaacccagtatcgtaaaccccccgccgtcgggccctttgaatctccattctacaacaataaaaggaaattattattgcttacatatatgccaggagctaattattgaacgaaacaaatcgaactcaaagatacttacaaaatccatgcgcccagaagagagacgtcgagggcgtccagatggtacagatcgaagacatccttgaaatggatccatagaacatcttctccttgcaagaagtcggggtttctgatcctcgctccgaacatctctctacccttggcgctcatttccatgtaccgttcatggaatttgtatatttgtgtcggtagggactgcagctgctcaggcctgacaagtggtttaccgagttcaaacttgtatgccacttccgccttcgggattggtgcgcctccaaccaactgagccacagttaaaccggtgtccgaaataaaatccgttatgccaaagtcttcgccggtcaccaatggctcgaccacttggtttggttgttctccaagctgaggaactggtttggacttcttgtaataggctttcctaagtgttcggtcatagtccgatagctttaaggcctccttgtttgtggtggatattcccttgaagaaattcttcatgctcgggtcaataggtatcttcttttcaggactccgaggcttgagttgcctcttcacttctcctgccacataagcatcaagctcctcttgactgcaatcgtacggcggctccttgtttttggtggtgtcaactttggccttcttcgctgcccttgtgctggcaggaggtggagcttggcgagaccttgtcttgagaggtgcaggcggacacggtggaggtggaggtgga

SEQ ID NO: 61037 - DNA, 2505 bp, Oryza sativa
ggactgtagtggtaagtccctgaaatgtccgttggaatggccattcccgacgccaccttcacgtgatgagaggttatctattagtaatcaacctaagcagcaacgtgcggaacgtacaagttaagaatcatatattacatcgagcataccttgattgataagttcttgaagggaatatgcagctcacatggtgtccgttgcatgatctcatcaacagggcaggtggtttcgtcctgggtttgcatggcgtccatgcactgtgatcctacctgccccgttgaggcgcagctgctacgattgcctgatgggctgaccattggaggaggtatgtgcagctgggatcgtgtgactgatgtgctgccatgcgttcatccaccttccgggccacctcctcttgcatgctgagctcgtagctcgataccctatactcaagatatgcaatcttcgcctcggtatctctcttgcttctcatccgactcctgtacgtgtggatgtcctccttgaatccaatcttccagggaatcacgcctttccctcgtgttcgtcctgaatgctcgggagtctgtagggcgagtgacagctcgtccttctctctgtcgggtcagaaactgccctgagaagaggcttccactgcatccgttagtcgactggcagcctcgcgtatctgattgctgaagaccagggagccatcaactgggttaagcattccaccgtgagcatagtaccagaacttcgattgatccggccatttagcggtggccggttcgatacccctctcaatcattcttgcctccatctcctcccacttcggtattgcgatgctatagccacctgaccccaagtggtgatgatacttcttcttggcagcgttttccttgtttttaccatcatcgcttgcccttgttgtcctgtcttgtaagcaaccaactcgtcccaatgatcccttagctttgagaatacgtcgaagttcggtgttagtcccttcaggatgtatttcttgtacagatctcccttgaagctctggaactgttctaccattttcttaagagtccactgtttcactatgttctccgtacccacagggagcgtgaacgtctcgagcattgtggtccacagcatctctttctctgattccgggacaaagctttcattatccccgcgtgctctagttctgcgccagtacaccttgctgacaggcacgttatctctcacaacccaaccgctgtggcgtacaaaattcttggctgcttctaccggggcactaggtcagccttctgcgtccacctcagttatgatgtgccgaccctctatcttcttcgcggcacctcgttgtccgcgtgccctcttctgtccagcggagggatgacttccactagcctcctcctcgttcccctccgcatccctctccacgttcccctcctcgttcccctccgcatccctctccacgttcccctcctcgttcccctctgcatccctctccacgttcccctcctcgttcaagtactggtttggatcctcgttcccctcttttttgttccagtactggctgcttccctctgcgattgtatcgtacagtatctgttcgtcatcgtgatcagccatctattcatagaagaaatatttgctaagcgtaatattaaaactctactaatcttgtattaaaactcaaataatcatatatgctaagtctaagtgtcgtgtattataaccctagataatcatatatgctaagtctaattaagtttcgaatattacatctctaataatcttatattaaatctctaacaatctctaacaatcaaatatgctaagtctaattaagttccgtatattaaacctctaataatcttatattaaatctctaacaatctctaacacacacatatgctaagtctaattaagtttcatatattaaacctctaataatcttatattaaatctctaacaatctctaacactcacatatgctaagtctaattaagttttgtcacgtcttgataaattcattccgaaataaaaattattttctaaaaggaataatagaattaattaaaattcgagaagaaattggcaatcactaaaatacgtacaagaaaaatttgaatgtggtccggagaatttttgttaaattctccgtggtctaacaagtgccctcaaattttcttgaattttcagagcaccggaaataattattaagcaacaaaaacaattatcaaagtttactaaaaagaaaaactaaaaataaatcctccttcctcctttgggccaagcccagcccaaagtctccctctcctccctctctttccctcctctcccgggcctctcctcctcctcccggcccacctcttccctgcccctcccgggccagctccctcccctcccctctctctcccgggcctcccctcctccactcctcctaggccgggcgcccagcccaagccggtcccaaaccaagccgagccgagccagccgtgcacacgcgcgccgtgcgtgcgctgaccgcgc

SEQ ID NO: 61038 - DNA, 3571 bp, Oryza sativa
tccgacctcccccgtggctggctccctctcctctcctataaaatggaatccccatcctccgttctatcgttttagcctcatcccgagcctccccgtggtcgtatcacctctccccgccgtcgcccttctctttcccccgcgccggccgcctccagccgcctctccctcctcgcccgagcgccgtccggccgtgccgtcacctcctccagcgtcgcagccgcctcctctccaccggcctgccctccgtttcgcgcggtgctccggaggcgcgttcccgctgtcgtccagtggcgttgccgccactgtaccacctccagccgcccctgccgcgtcgctcaggtgcgggccggccgcgccgtctcctccttcggcgtcgccgcgtcgacctccaccccggcctgctctctgattcgtccggagaccgccgtcgcccgcgccggcctctccatcctcttcgtcgccggcgtcccttcggtcgccccttcctcctccccggctcgtcggctcgctgcgccaccaccacccccggcattgcagcggcaaggtcgccctcggcctcgcctcccctttgtccaaacccctccgcgctccatcgtcgtcgtatcgttcgttctcgtcgtcgacgtcccgtcgatcgcccggctcgtcatctggctgcgctgccaccgtcgtgggcatcgctgcggcgtgtcccacgccgtcctcacctccgtgcagctactgccggctgccctcgtcgcctccccgtcggtcgtcgtcttcctccttcctcctcgtcgtggcgttcgtccctccgtcaagccgatcgcgttcgccgcccgcgtttcgtcaagtgtgcagcagccccgtcgtcgtcttcgtcctcggctccgcgtcatcaagccttgtgccagccgcgtctcgccttcgtccaaggatcgccgccgaagtcgttccctcgccgttcgcctccgtcgtccccgagctgtctccaccgcgcccgttcgttgttgtcgttcccacgcctcatcgcgtggtggtaaggatctctctcctttcgctgccccgtcctcgtcctttcggtgtcgcccgtgcccgttgtgcggttgtcgaccccggtgcccgtgtaccggtgtcggtaatcgttcgtgggtgcgtgtggtgaccgtgtttgtgtgcccgctcggtagccgcgtggtttccacgtgtgcagcccgcgtggtgtctagtggagtccgtttgtcggccactcgcctcggttggcacacggggtccgcttccgtcgacccgtgggccgtctctgtgtactcggtctactggggtcccttaggttgacatgtggggtccgcatgtcaacagcgcagccttcctgtcttttccaagctagcgcttgcacatgttttatagttgcaaaacctaattataataatccgcaaatctccatataacagcattaaacttcggatgaccatgtcttggtcatacgagctccgaatcgatccgttcaagtctcctaatgtttgttataatctaaagaaccgtgtgctttctttttatgtattgttatttcttctttataggcttgtagctttgcttgtgtgcttcgcgtagcttctgtcgttccggaggttccagaagcgtggttcgcggtcgtccccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttacctttgttaagatattattattgctattgttattattatcttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctttcttcctctttcaaaacccctaaaacctgttgtccggtggggtttgggtgcatgccagttgtgggaagtagcaccccggccaatataaggattaagctcgggcctctgttgcaaagcactaccgtacttccacatgtctagtgggtaaggcttcgtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctccctacctgtctcggggtttccggccgtaggtggggttgggttggtactcttgtctatggttaggatgggttggaaactatgtcatgtcttccgtccatatgccgtggtggcatgtggcacgtggttgcacgtgaggaagacgtgtcttgtgggtaaagatgtacacctctgatcagagtaaaacctattcgaatagccgcaccctcggttatgggcaagcctagcaatgtacccaagttagtgtttttaattcttaaaacctgcttaacaactaaaatgtggaatggttggcctgggttggcttgggacgagctgggacccagggtcaggttgccagttcggtctgaatcatcgtaggccttgggttacggcaggttcgtgtgggtccacggccttgattaataatactgtgtagctctaggatcgtctttataaaatagctttgggcaactaaatgacttttaaatgctgtttactgcaaaacttaacccctattattatctccttgtactcccttgcattaatcatgcaactcccggtgtgacttgctgagtacggtggttgtactcagtcttgctctatctttccccccttcagtaagggaagctttggagaagaagtcttaggtggagtcctggcttataccccagttgagcgcctatgaagatggagccgtaggcccgcaagtccgctgctgtttatttttgtttgtcaggcctgaagtgcctttgtaataatgtaaatattatcgatataataaagatgtgccttttgtatcatgtttgtttggtgtaccccggcttttcctggaacggggattaatacactagcgttcgggaaaaggtaattttctcggtcgcgacaagtttcgtatattaaacctctaataatcttatattaaatctctaacaatctctaacactcaaatatgctaattctaataatctaataatctttaacactcacatatgctaactctaataatctaataatcttatactagaaatctaccaatcttatattatatctctaacaatcacatctttacatcacctgcctgcgcgaattccttcgatggctagctaccacttcagcttgagggacgacgacgacgacgtcttctctgcaacatgcaaaaaaaatgtgttggtctaaacgcaaaggaatatataatgtatttcacgttttcaagtatatataatcatatatatatgctaatttc

SEQ ID NO: 61039 - DNA, 5021 bp, Oryza sativa
caaatttatataatcaacattgttattagatgaatagtattttctatctttgtgctcaaatattggttggatcatgttctattgacacatagacctaaaacaaatatttgacaagattgactaatattaacctggtggctgaaatgtgcaacatatgtagcatgtcaaacaagtgctgtttttactaattacgctcaagccagtacaacaaaaattcaggttgaacagttttctatgacaaaaatacactaccagatgactaggtgccctcttggtaagaaccacaaattctactttgaatattcagtcaagaagcatgtgaaatattccatgttggttggtgccaatttgacttggctgttcatttagcataataaattctggcagaactacagtggtataagcagcagttacttttttctttgctccaaagcagaagaattagagtagaatagttgcaggaggtgaatgagatgtgggcagggcttgggtactaccggagggcttgatttctgctggtgatgattagtaaatagattgatcatgaattcatggctgatcctgtgcgagatgacgtggatctgcaaggggaatgtttgttgcattctttgtaagaatttttcaacttttgcagttcctgtgcactgttcgatgttttgtctcaaagggagagttatatttagaatctgttttgtgttacagatgagggaattatgactattggttgcacaaattggtgaggtctgtggcattggagattacacagagggagccattgcctcgatagccttcaatgaggttgggctctacataatttatatcctattcagatcactatgggtatcctttacatatactcacatgattgtgcaactttcttgctaatgtgggatgtccctgttgtggatggaaatactattcgagttatcagtgggctctaggattcctggtaagcaactgtctttgttgatcactgataaagccttgtaaacatatctatgacattccacgactttttatatttatgacaaaatagctctggtgaatatcacacttcattgggctgtactcacaaggttctgtatggtactgatcctgtgtatcattttcttcctgctgagctggttactggaggtgttggtgattatgaggcatccactttgttgcaagatcatcaattgttttgtgacatgcttcagcagcagttgtctaaggcccaagtagaatgaagtagtatgttgatgagaaatgctccttggtgttttgagtgggagatcaagtgtattcgaagcttcaatcctatgatcagaaatcagttgcttctcggcttaacccaagttagctgttaagtagtttgatccttccccatcttggttcgcattggggaagtggcatacaaactgcaggtttcctaaagattcattgattcaccatgtttttcatgtctcgcagctcaagcagtttgtgctagatcatgtgttttttttttgctgggacagcttgtccatgaagtgtggcccgttttttttttgtccatggatgtcaatgccatgtgggccacatgccacgtaggcaccacgttaaccaaaactagcctccctagtgtattaggatctcttttgcactgtttttgcaagttggaggttaagatttgttgtattgcggttgagggatgcaaattaaatttgacggaatgataagggacataaagtgaacttattactccctcttgcctccactctcgccactgcctcctctcctctctccctgccgccgcaggggtatagcaggccaaacgggcggcccggcccagcacggcacggcacgccgacggcacggcccactagggcacggcccgttaggcacgactcctgtagcgggccgtgccgtgccggcccacgtgccaaggccacggcccaagcacggcccaagaaggtgctgggccgtgccgggccggcacggctactgtagtggcacgtgggcttgtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaaataaaaaatatgagaaatatatgggaaaaattagaaaatcgtaggaaaaataaatgggccggtgggccgtgccatgccggcacgctacagtaaacgtgccgtgccgtgccagcccacgggctgaggcatcggcccaaacacggcacgggataacgggccgtgccggcacggcccacaggctggcgtgccgtgccgggtctgggccggctacagtactgccgtgctcgggccggcccggcttggcacggcccatttggccaggtctacgcaggggtcagtggcggctgggctgatgtggcgtcggcggtggtgatgggtgggtggaggaggaggtgagatgagggcgttgggcatgggcggtgggtgctgcctcctccctcggtgagttttcaccagccacaccttctctacaagacactaacatgtggggcccgtgtgctggctcagctagtcaacggggtgaaccggtgaaagatgcccatcggacgaaactatctcccaaactgtttgaggagtgatttgcgacggctttgtgagttggagataagtaatacctgattttgcggttgtggcatgagcggagggacgtaaagtagacttattcctcttctaataaagtgctggcccatcaggcctttctaacagcccaagcccacacagccagactacacaccaaccgaagtctgaacttgaaactggccgattccgatcaaatgtcgattcagcacgaaaattaataaaaaggaaaagaaacaaagaagaggcgactcgatgcagttaaacctattcgattcgaatccgatggaaggcggcggcagcgattgccggcggccagcctccgacgatcacgaggggacggcggttgccagtctccctagctccaggaagaggaaggcggctaaggatttagaggaggaggaggaggatttgcagccggaggaggaggcgcgtccgccggcgccgccggcgaagggtcggtcgtgtctgccggcggcgtgccatgaggacggcatcatcccggcatttgtgatcccgggcagcaagcatcgcgacgggtccatctacaggacggatgcgcactactggcacggcctctaccacctcgacgataccagcgaaagtaagcaaagcatcaagcatctccaattccccccaattaatcccactactcctcatctgctctcaaagttttcatcaatttaacagttatctgttctccaccttttgattgataaatctgttctccattttatattacaagtcatttgactttttctttagtcaggcttctttgcgttttaacaagtttatagaaaagtttaccaaacatccaaaacaccaaattaatatcgtaaaatgttgcattgaatattttttgttaatatgtttgttttgtgttggaaatatcgttatattctttcataaacttggtcaaatttaaaaaaattgagtagaaaaaaagtcaaagcgatttataatatgatgaaactgaaacggagggaggagtatatactaatcactggttacttaatcgattcattccatcatcagctcgcctggaaccgatgacaccatcatattcagagcaggactgcaggccatgcgtcaccgattgccagtggcacattggttgctccatgatgcagatcttctccctcgagctagccgaaatctcaaatttcgccaccggagctgctggtgccggtgctattcagctgtatgggttcatggctgcgcgggatcttttggacccgctgcgaaactacgtcttcaaccgcaccagggacgatccgttcaccatccgcgacgtctcctatccgtttatacagatgactggccctaagaggggcatcacgatgaactcccgcgtgatgatcgagtacgacctgaggatcaagaggggagagaatgaacaagatgatctggtgctcatcgacggggctgccaccttcagcgagataacgaatttcataccgtacatttatcgcatccatggggattgcggcatggcggtggacataacgctagcacacttcatccttgcaattgaggcaacgttgcaagttcgaatatatgaactaaaggatggctgtggcagcctaaacttgactataacttgtcgtgttagtcatatgaccccacaaattaagctctttcaaggtcccattgataagctacgtgaccaaaataggtttgtggttgttgcaacactgaacactttgatgattacagagttcaagctaacacatcagcatggctcaatcagtcggagatttgagtccagggttgtaccacatggaagtatgtctcattgcgccaagtttgcggatttagccactataggtgtggagatcttttggtcaatcttacccacttcgctacaagaaggcttttgagccttctactttgttacattctatttattttcaggcaaaaaatcacctacctgtaaatagctaagagcaatgcaagttttttattaggatttgtgccatatatattgccatatgaaccagaaccaaccaaggcttcatgtgtatgtcaattgttgggcaaaccttgccatatgagcaaaaaatatttttttttctttcaattgattttgtggctgttgaatttgcacggagattgggatatcaaccacaacaagcacttttagcagtgattacgactccttccagggcaccagtaagttgatgatgtgatatacctaccttttttgttcttctctttgctttggatttcttgttctaacttcactcaatcagctaggaagaatatttatgcaaatttatattttcctgcctctaccctactccatattgctactagataatactatctccatattttaatg

SEQ ID NO: 61040 - DNA, 1286 bp, Oryza sativa
tatatatatatatatatatatatatatatatatatatatatatatatatatatatgtatatatatatatatatgtatatatatgtatatatatgtatatatgtatatatatgtatatatatatatatatatatatatatatatatatatatatatatatatatatatatatgtatatatatatatatatatatatatatatatatatatatatatatgtgtgtgtgtgtgtgtatatatatgtatatatatatatatatatgtattctatatatatgcataatatatatatgtgtatatatatatatatatatgtgtatatatatatatatatgtatatatatacatatatatatatatatatataatcaaccatgcagcaaacagggccatgcaaataaaaaaaatggtacacagatctttagtcccggattcgtagtcccggttggacaaccgggactaaaggggggttacgaagtaggactacaaacggtttctccaccagtgtagggagttttggtgatataaatagacgaggggttgaggctagaaggataactacttttgagagagaaaagttaggatttacttcgatgtttcaattctagttcgtgagttgagagaggagtgctttaagtgcactttgtaaacacatattgatgcaataaagttgatatactttcaagtgtttcgtcgatacgtgtttttctggatcctgacggtttgaccggaggcaagtctacggtctaaccgcgggcggtcacacccgcggcaggaagggggttcaaccggtggcaaggcggcagttaaaccggtggcgtgtgagcggttcgaccgggggcaacagaactacgtcgagatttccatcgatttgagggtaacttttatttccgctaaaagtttttgcgttttttattttccctatcattcacccccctctggtaggcttggttacttgtgttcgatcctacaacggtgaggtagacggccaatctgagacgagctcctccaggcggcggcagcccaagcggagacaaggccgtccgtcgaccgcggagcccggtggaggtcgatacgccgacggtcgccactggaggtaaggcggtggaaaccgcgggcccgaggtggaggactatgagcagaccgacgatgaccggagactctgctactgctgcttgatgacgatgcaaatgcccgagagatcaatctctcttaggacaacgacttgatgatgcgaataaaaaaaaacggtggccgccccgggacatctaaaccctcccgggacga

SEQ ID NO: 61041 - DNA, 6465 bp, Oryza sativa
agtgggaggggatggatctcacctagcatgctccgctagcgcccctcaccccacgcttggtggttgtgagaggaagggggagaaagagagatcgattcatggatatcctgtctctccatccctccacaatcttggttctcactctcacagtagagcggaggaggaggtgaggatgagaaaggaaagaagagtcgagccgatagctgagtaggtcgtgccgtgccaggctggcatgtcatgccgaggaagaggccgaggatgggcctggccatcggtcagagggcccttttgactaactatagtctataggtgagcacacgtgcccgtaatgaaactcgtccatccctaggctgcaggatccgaccgatttagcctgagctgcatatccggattctacactgaaaatatttcttaggtgatgatcatatctcacactaaccctttaaccaaacactctaaaaatagtggcggtcatatcatattcaggtatatcccatcaagtcatcaaccaaacaaaccttatgtttatcaactcagtagttatatgtgcacaggatatgctactttataatgacgttaaatttattaacccttcttttaaaatagtgagtccataaatttattataatgacacatgacggtataagaacgttcatataaaaaattaatgaacttttagtatataatagatctcacattaaactagagggtacgataaatcatattttgctacctcatcataatcattttctttacaaagcaaccattaaattctttttttaagtactgctacgtactactagtttttttttttttttgaaaacacaagtttattatatagattaaagacagagttcacggggaacaagttcccctatacatcgccataactgatacaacttgcagagcaaaaccaacctttcaaaaggtaaagccaaattgtctaaggggacaaactttccaaataaaccaaacagcagtaagagtgtgcactccgcttgacagaccggtgaccctttagctgcctccacaagcctctactaagagtgtgcactccgcttaatagaccggtgaccccttcagctgcctccacaagaacggtacaattcgagattgattgttgagtcaaagattttggttaagcttcactggactcaacatcgattttccaaggagttctccatcaaatctgaggaatgctaactgcaaacctgtcaacaagaatcggacaggaggtctgcactcaacccgaccgaagcactcgacatggttactgctgcagataaaattagaagtcccttaagaccaaccaggcctaatcatgagacaattaggacaatggcgatagaactgctgccttgctacatcccaccagaaccttgcggaaggaaatgatgactgccaagctagagtaagaattaatgaaaggcatctgtaaaaatggtttgcaatacaagaatgacaagtatttatttgctttcataaaataaatggtaacgtgagggccggggagtatttataaacgttagactacgtgtgttcaattatattagatttcagttttttcttcataaaattaattaaggagagtacaattagtacaaaggaaagattaaaatattttactttgtcatgaagaataattgaactcgagaggacctagctgccacttgcatgatgtcttgtcccctgtctattagggtgtgaccggtgatctacctgccctgatcagtgatcctagatccgtacgtagctcgctctttcgtcctataaaaacccaggagcctggctgccaagattaaaccctatctcgcggtgagctcgatacgacccgtctccactctagctagtgtcgtgattaaatttagttagctatggcagctggtggtgcggcgccgctcaggatcaccggtggacggcagctggtggtgctcctcctcctgctgataatcacgctgttcgtcttgacgcagcccatgatcgccatggcctccgccgcgagggctttgggagaaaacgacggcaaccctgactgtgtcatccgtgaccaccctgctggcgaaaatggaataccaccatgcccgccgcgtccctaataaacctgtcggtgatcgatcagctgtctcagcgatttaattagtattgtaatcgtcgtgcgtacgtctacagcagtcagctgatggtaaaaccaaataaattttagtgctagctagctagctcctctccggagaactacgatagatgccgtacgtatatatgcgtatgtttggatgtcatgcatgctttgacctctgcatggcctattccgacatttgctacggtacgtgcgtcctacagctagcagccggctatatatgtgtgtcagtgtgtgtaacaacgtataactgtgccttttatatttcaaataagtgtctcattcacatgatgctgagacagtagttacttctgaatgtatggctctttcttattactatatcacagtaccaataaaaagcaaaaaaaaaaagtattctattaccttttctttttgattacacacgcgcacaaaccactaaatgacaatactacactcacacctgtgcaacactactaggaaaaacgtttttgcaggcggccaaaaacagtcttctcaagcggacggccattccgcctataggcaaaagtcttgcgaaaatcacaggcggccgactggtccacctaggggggaagaaacctaggaagaccattttcctaggcggactgaagcacgatgcgtcacctgggaaaacaggaaggagccgccgtctaagaaaatacgcgccaaaatttaaaatttcccaccaaatttattaataatattttttaattaactaatgcataaataatattaggaactaacaaacatttaatactgacaaacaaacatatattgcattagtgaaaagtatcgtcaatatgttacaatattttttacatttgtcacttcaagtagatcaagaaacaaatgtaatgatcactacatagtaacgatggtgcagttagtcacggatgaaataacacagatgtgtacaaagaaatctattggacttacctaaagttgtatgtggccattatgattcttttatgttgaaatttcaagaaggctcgtccaatgtactgtgtgacagtaagtattttagtcttgtgcaagcccttcttgtattccgctatctctttaggcattttgtccttgagctgctcagagtttggtcatagcgtcacgatatgctgtgtctaatagatccttgttggatccagatatccgataggctccactgtcttctcagcatccatgtattgcatcgtataaaacaagttcgttaataataatcgcatgcttctgtattctattgatttatttgtataataaatgcgcgttcatactcacaggcaccatgcaccgaaaaagtttacatccatctttttccgatgatagatggcgtggagatcagagaaatctaaccacaaggaacctttgttggccatgaaagcatcaggcggtaatcgaacagttaaagacattaggcctttcttgctggcgtctatgtaccatttacgtagctttctcatctcccatggaccctcatcaagtgcataaatctggccaaagtgcttttcaaacttttccaaacaatcaacagttgcaaagaattatgggccggcaagttcagcggccttcttctcatcttctctttgcttggcacattttttaccctctctaaaagcgaataccatccacttctccttttgatcatccttagacttggagttgtgacttctgagcactttaggcacttcagacttgtcggtggcattgtcatcgaccggggttttgtccatgtcatcttttgcaggagatgggtcctcatatacctctggttctattttggctcattccaaacctggtgcgacttcgatttctgttcggaaggatgacaacttgcacttcctgttcttgcacgtccggttcgtttttctggcataatttgcacctctggttctttttccggcacaatcgacattattgccaatgtagatggcccttaagtgcccttaggtagctcatgttcttccgccttatcattcaatggtttctttagaggtctctgtgatttcagcagaacattggtgctagtggcataggttatatcttttttgccataaaattacaagaacgaccgcatccctttatatctttttttcgccacaaaattacgagaacagccgtatccctaaatatggttatacaatcaggagttgggatgtccaggccagactggtgtataatatttaatttatctctattggaattgtcaatgatctgtccaatcagagataatgcttgaatttatgattgcctattcagagttggtagtgtactgctgcataaccatatcgaaaaataaagcaaagtacatcactgctttacttcaatcaaatgctcatccttgtccccttggcattaattattggcccttaattatttaaagtgtgaagcttttcaagtccacgcatatactatacacgcatgtgtttgctcaaactttcggatactgtttttcatacatgaaatcttatattactaaaacagccttggaataagtcaccacatttaatgtggaggctagaaatttctacattaattagaaaaaagaaaagaagagtccaagtagatgtataattaaaaaataactgaaattcggaattaaaagtaagtaatattgaaagaagagtacatataagaacccaatataagattaattaaaattcataataaaaaataaaataaaacccaacattagaaaagaaaaataaaacaagaattcaagtaggaataaaatttaataataactaaaatttgaaattgaaaataagcaatattaaaataagagtccatataataacctaatacgagattaattaaaatttgtaataaaaataaaataaaatctgaaattagaaaaataatagtaataaagagttcaagtcggaatagaattttaaatcaactgaaattgaaaataaaaaataaggaatattaatccatataaaacacaatatgatattaagtaaaattcgaaataaaaaataacataaattctgaaattagaaaaagagaaataagagttcaaattggattacagtttataaataaccaaaattaataataaagaataaggacggttgaaaataagagatcatctagaacacaagacaagattaattaatttttttagtaaatattaattaaaattaggaataacaaataaaatgaattctgaaaatagaaaaataattataagagttcaagtaggagtacaatttataaataaaataatatcggaatgaaaaatgtggaattttcaaaaacaaatctagaacacaaacgatgacaaatgacaacaaagaggggagaatcaacatgccattaaaggaatagagtgatcacgattgttgggacatctcaaaactattaacaagacctcagaaaaaatcccaatgatgactaaaaagagggaccacggacaagctattaaacaacacagtcattgtggttggcgggcttctaaaaattataaaatgaaaccaaacgagacaataaacactaaaacctacaaggtctaatttttaaaggtttcagagagaatgaatagaagccatgataaatcgaggaagcaaataaaagagaggtgacaaataagtaaggaactattggcgtgacttttaaaaactataaaattaggaacactgggatgataaggtttggtcttttgaagtcttaagacaacaggtatttcacaaattttaagaaaaaacatgataaaaaatagataattttgtatgggtgctagtcgtgcaattgcgcgggccacccggctagcaaataaaataaattctaaacatagaaaaaataattataagagtttaaatagaaatatgatttataagtaaaagaatatcagaatgaaaaatatggaattttaaaaaaaaagttcatctagaacacagcgataacatataacaataaagaggggagaaacaacaagcctatgaaggaatagagtgttggcggctgatgggacatctaagaactattaacaaaaccccgaatagtatcccaatgatgattaaaagaagggacgttagacagactgttaaacagcacgatcacggcggttggcgggacttctaaaaagtaaaaaagtaaacccaatgataaccatgttcgatttttaaaatctccatgacaacaaagagtgaagcagcgggcgagccatagaggagtacaacggtgacggagcgtggggctcctcaccaggagaccgcgcaggcccccctttgccggttcggccggggacgctaagtgaagttctaagctctcaatctgtggaatgttcgctaaagtggaaacgcgcaagacacgggcgatgtatacaggttcgggcc

SEQ ID NO: 61042 - DNA, 1908 bp, Oryza sativa
ttgtctgccgacgacataaccagtgtcagaccggtcgcaaaccagtcactcttgtccaccacgcgtcagattagcaatctgcatgttcgcccttcttcatacaatgtcttgcttgtaatggttgcgatgaagcctggcatatatctgaccgggaccaacgtgccatctccaggagctagcacgctggctccggctagggacgagtgcctggaggctctcatcctgacgggatggggcgaggcgtgtgtcagaccgcctgttgccacctatcccgcgatctgaccggtctgtgaccggtcacagaccggataaacgagcgcgctgcactgcgttacatgcggcatgacgcgctcgtccaaaccgcaataaatgcggttaggtgagccccgctgtgctcatctaacccatacacgcggcgcaaaacccacaaggggtcggggcgcctcggccctcggggccgaaacgggagcggtccgacccctcggggagacaagagaggggcggccatatcaccctcgggcccgacccccccgagggggtcaggccacgtgggtgatcgcgtctgcccaagcctctagtcatgatactcccggtcccatgtcaccgacaaatggcaaaatcgctaatggtttggcaggacttctagaaagtaaacatgaacccaaacaataattatgttcgattttttaaattccaatgataataaagagatgaggtagagaagtatggtgacagtgtttgacgtgacttgtaaaaattatataaacgaaatccaatgagaccataaactctaaaaactagaagatccaatttttaaatgtttcaaggaaaataaatagaagtagtggtagatcggggaagcttaaaaaaatttaagtaagaccgtattaaaaaatagataactttgtattggtgctagccgcgcaattacacgggccacccaactagttctgtctaagcgatcgaatttcccatagtttaagtagattcttcaatggtattgatgctaaccaaatctattattgatgctatcgttaaagaaaattctagttaagagttctttctgatctcccaacacactataaaaaaaccattttttaagacatcccggtttcattttccgaagtggatcataagaaaatctaattgtgattacggtgagagggccaatggtctaaaacctcatgtggaaatcaattttcacaggattttcaatggtggttcattgagagaatggctggtggaaacggggtaatttttaaggtgattttattaaggaaatgtatgtaaaattgatggtttctgatcgaaactgaaaattttgaatgtcaaacgttaactggcagcgatattactatcgctcaacatggtgactctagattaatcattttatatgaagctataatagaaatgtaaaacaggctacgtttgcttataggcggacggccgccctgcctgtgaagaccggtttccaccgccggcgataatgcttttcttagtagtgtactatgagttcatgagcccgctccacatggggctgagcctaatgcggattctatagacaaattgttacctgcatcatgagctaagagataagatgaattcctagacgatgtaccattttgtacgacctgtagcatggcggccgcttgtggagtggtggatgcttcagggtcccaggacatgccacaagcgcttaaatccagtggtttgtattatatggtctatgcacctgaaagcgctcatgtgaaaaaaaaaatatgacaaaaaaaccttcagtcaaaaaatctaacaaaaaccttatgcctctaagggccagttcttttctccaacttaaaacttcaacttcctcgttttctgttagcacgctttttaaactgttaaatgatgtgttttttaagaaaaatt

SEQ ID NO: 61043 - DNA, 1687 bp, Oryza sativa
gcaaattgttcattgagtgcttgcaaatgtgcgtctgacttgttctcaccgtaaatggatatatagtaggggacatcaatattgactgacaccaattgcagtcaggttttcctattgcactacaatcgatgtttacacaacaccaaccctttaaccacatgcatgcatatattaatatcgaactacctcaattgcaacaaactcaagtcattgtagtgaagaaagaatagagcttgtgaaaataccttcaccatgtcgtccttctccaagagagtagctcatcatctcacatcactgctaactgtgatgcacatcctcctgcaagttcaggccacccccacgcttgctgacagaactacgacctccatcgtaacgacaccggttctctgccttccggaacaggcctcggcactgctccagctaaagggctcgttcaacgtgacggccggtgactactccaccgtctttcgatcatgggtcgccggtgcagactgctgccactgggagggcgtccactgcgatggtgccgatggtcgtgtaacctcactcgacttgggcggccaccacctgcaagctgacagcgtccaccctgcattgttcaggttaacctcactcaaacaccttgatctctctggtacaacttcagcatgtccaagctcccgttcactgggttccaggagctcactgagctcatgcaccttgacctctccaacaccaatatcgctggtgaggtgccggcaggcatcgggagcattatgaacctcgtgtatcttgacctctccaccaaattctatgctctcgtttacgatgacgaaaacaacatcatgaagttcaccttggattcattttggcagctcaaagcgccaaacatggagacctttctcacaaacctcaccaacctagagcagctccatatgggaatgatggacatgtccagggaaggtgaacggtggtgtgaccacatagccaagtccacacctaagcttcaggttttaagtttgccttggtgctcactgtcaggtcccatctgcgcatcgttgtcggccatgcaatcactgaatactattgagcttcaccgcaatcacttgtcaggttcaataccagagttcttcgctagcttctccaacctctctgttcttcagctatccaaaaacgactttcaaggatggtttcctcccatcatcttccagcacaagaagttgagaatgattgatctttctaagaatcctggcatatctggtaatctgccgaatttctcacaggaaagtagcttggagaatctgtttgtcagtagcacaaacttcacaggtacgattacaagatccatcagcaatctcaaatctttgaagaagttagaccttggtgcaagtggcttctctggaacgcttccttcttcgttaggtagcctcaaatatttggatttgctagaagtgtctggattacagctagtaggatccataccttcatggatctcaaacctaacttctcttacagctctccagttctctaactgtggattgtctggacaagtaccttcttcaataggaaacttaaggaaattgactaaattagcattgtacaactgcaacttttcagggaaggtgcctccacagatctttaatttgactcagttgcaatctctgcagctccattcgaacaatttggccggcacggtagaactcacatc

SEQ ID NO: 61044 - DNA, 1487 bp, Oryza sativa
atggaaatgatacatacatggcacaaatcctaaaaaagaaacttgcattgctctagctatttacaggtaggtgattgtttgccagaaaataaatagaatgtaacaaagtagaaggctcgaaagctttcttgtagctaaatgggtaaaattgaccaaaagatctccacgcctatagttgctaaatccgctaacttggcatagtggaacttacttccatgtggcataaccatggactcaaatctctgactgattgagtcgtgctgatgaacaagcttgaactctgtaatcatcagagtattcagctttgcagcaactacaaacctattttggtcacctagcttatcaattggaccttgaaagagcttaatttgtgggggcatataactaacgtgacaagttatagtcaagtttaggctgccacagccatcctttagtttatatacccaaacttgcgccgtggcctcaattgcacgggagaagtgtgctagccttatgtccaccgccatgccgcaatcaccattgatgcgataaatgtatggtatgaaattcgttatctcgctgaaggtggcagccccgtcgacaagcaacagatcatcttgctcactctcccccatcttgatcctcatgtcgtactcgatcatcacgcgagcgttcatcgcgatgcccctcttagggccagtcatctgtatgaacggataggagacgtcgccgatggtgaacggattgtccctggtgcggttgaagacgtagtttcgcaatgggtccaagagattccggacagccatgaacccatacagctgaatagcaccggcaccaggagctctggtggcgaaattagagatttcagctagcttaagggagaagatctgcatcatggagccaccaatgtgccactggcaatcggcgacgcatggcttgcagtcctgctctgaatacgatggcgtcatcggttccaggcgagctgatgatggaatggatcgattaagcaaacagtgattagtatatactacttgacaaaagatgaaaaatctatcaatcgaaaggtggagaagttgcacaaaaccacatggattttgccacatggcacataacctaagatattatggtcctaaagttttttacaaaaccacaccgttaaacaaattggtataatcctatattaattgaaaaaagctttacttagaagaatgtagcattgtggaaaaaactcataaatctgatatgtgattgtagaactcaaaagaatgataaatcaaagtcaaaatgattgataaagtggttttgtgaaactttatagccataataatacccagggttatgtgccacgtgctaaaacctctatggttttgtataatttagaccatataatacctggcgttaagtgaaatttactcttgttaaattgatgaaaactttgacagtcgaaatggggggtaaaactaagagaaataatattaacttgacagcagatgaggagtagtgggatt

SEQ ID NO: 61045 - DNA, 2356 bp, Oryza sativa
  unsure (1)..(2356): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgaatgggcgagaatggctgctgaattgatttctgagtactgaactgactgaatcaaatacaatcaaattcaatctcaattgtctataataaacctatgctgtcattctgatctggatttcgaattttaatgctcttgtctgttcatatttctgttccaacttcttgtttgcctgttaccttgcttactccataaagcgatgttgagttcagtgagtcacctgcgctgtgcattctccatggtaagcgcaaacacatcaagttttttttgaaaaaaaaacacatcaagttccatggagtttcgtcattttagttccagatcttggtcccgctgaactgcaaattttcccaagaaaataaaaaatttctccatagctgctgtcaggatgtcaaaattttcaaaaatccttcgttccaaacagttcaaattttctggaattaggagataactactaattccaaccttgcatacaaaaaagatctcattttttcgcttatacttatgcttatgcgaactgcttattatagcaatttaaaaataatttgttagtaaattttatgtacgtgttcttcataagaaaatgttgtaaaataaactacgatgaaaaaaaaccacaaaatcaactctaaaataaagttctaaaaattaaaatttacttcctccgtttcacaatgtaagactttctagcattatccaaattaatatggatgttaataaatctaggcatatatacaaaatatatactctctcattccctaaatgtttgacaccgttgacttttttttaaacatgtttgaccattcatcttattcaaaaatgtttatgaaatgtgtaaaactatatgtatacataaaagtatatttaacgataaatcaaatgataggaaaagaattaataattacttaattttttttgaataagacgaatggttaaacatttttaaagaagtcaacggcgtcaaatattttaggatggagggagtacattaatcaatgaatcaatctagataagaccaaaaaagtcttataatatggaacggagggagtagcttataagcgtaaacccaagcgaaacattgggagcttcaaaatcgagaagaagagtccaaacctccaaatccggcccataatgattattaacccgaccttttcagcccggcccaatgtacttgaccaaagcccagcccattttgcaactcctcacctctgcattgtctccgcgtagctgagcaactcttcccctttctcccccaaatcggcggcgacctctctccgatctccaccaccaccaccaccacgcgggcgcgcgcaccaacccggggggcttcgatgcgggcgatctcgtcggcagcgggggggatgctgcgggcgcggctgcgcggcggggcgcgcgtccgcggcggcggcgggcacggggaggggggcgggcggtggacgaccccggggcacgaggagcagcccaagggctacctattcaaccggccgccgccgccggcgggggagtcgcggaagtgggaggactgggagttgccctgctacgtcacctcgttcctcaccgtcgtcatcctcggcgtcgggctcaacgccaagcccgacctcaccctcgagacctgggcgcaccagaaggcgctcgagcgcctccagcagcaggagctggcctccggggaggcccaggccgagtgatctgcgcgcctcaggtcacctcgaaccctagaatactgcatctgttttactcccaataagatgtttgagatgtgcgggatgaacactgggttctggtttctgtttttgttctgtttcctcgtggaatttgtccaatgatggcgaatgccctgaacattttgaaatgctttgtaattctattattttctcttcctttagttggggtgcttttaagagttttcgtgaatttcacccgttcccaactaactcagttgcagatggcatgttggggttaggttgagcaaatagttgaacgttgcttaagcattatcttattcttgatgaatgctgaatccaaactctaaacacgaataactatccctcttaccaaatatgttgagcatcatcgtgatgaatgctgaagccaaaccctaaacacgaatagctactcctctt

SEQ ID NO: 61046 - DNA, 11064 bp, Oryza sativa
attgattttttatgggacggaggggatacaagcgaatggattaccattattacaaagttggagttgtttcaaaataatattttaagaaaattatatatagaattctttatatatatatatatatatatatatatatatatatatatatatatatatatatggtgttcttttctcctgaaaatgaagatgaagattaagttttttacgcaaaactaggtggtattaacgtatgattgattgagttttaattattacaaattttaaaaatagattaatatgatattttagagcaactttcatatagaaagttttctcacaaaacatactgtttaacagtttgaaaagcgtgccacgaaaatcttaattttcatccaactcttgttgaagaaaagaacatgactatatatatcggttaggagcttgggaagcatatgccatggtaatttgttacaagagaactcaactggcctaggtaaaaccgtgccacaaacagtgtcggtagagcatgaaatgccctcgcggtgagccggtgagtagtcgcaacgtctgcatcgctgcatgtcatcttatctttctctgcctccggccattcttttggcctaaaatttctttgtttggcagctgtaatgggcgaagcaatgcttttaatccgataaagctgtaatgcgagacaaatcttcctttagcatcatagttctttgtctccaagaacattccatttccaccgtccaagtgtcatgtaacgtcatcacatcaccctcatactgtcatacagaaaaacttatataatcacattatttttactgacatgtggggccggctccaaaaggtcccgcacaatggcagctggactatagtgaagtcctttccgcttaattatgccttggcctcttgtgtgagcagctaaccatgcaagcgaagcgtccctgtactagaagccatacggcggcgctccgtacgtagatccatctgctctttggtcacactgggatgtactaatgctgtcaatcatttcgtgctaatttccaaaaaaaaactattcatatactggtaaggcatacgggtatcagtagtacatctcttgaacatgagcttcattgttgtcttgactctgaatatttgacggcgggataactacgtgcatggatttgttttagggtgtttttttaatagccgaataattcgtgataattattcgagggtaaaaaataattgattaaacataattgaaactaatttcgtaagaaattcatatatactaacaaagttttctgtgaaaatattactatttagaagttcgggaagcgtgccgttaaatagaatggtttcattccttataaaagaacatcaccttagtgggattgaatcggatgtaatttactctgaaaagtttcatgggcattattttgttgtttgtgtgaatttcacacaaactctaccactccatggtgacatcgacaacaaataacaatagatctatttttgcggggttgtcggtgaggtcaagggggcgtcgggggtgatctcgccgcgcctcttcgacgccgtcctccgcccactgcggcgtcgcctccgtgcgcacgctccccgtcgctgccggcgccggggccgctcccctcctccctcgtgctcctcgccaaggtctccatcgcctacttctcgtgagccacgggtgccgctgtccttgcccgctgctcctgccgcctccttgccggtgagcgtagatggatcctccgctgccaccgtagaagcagaagaagctggcggtcccggtgcctcgactgccgcaacgccgacgacaacctgctctggaacctctacctcctctccatcctgatacctggtaccctggtatcaactgatacctgttaccctgggtatcgagctgatactaggtatcaagccttggtacctgggtatcaggccttgctacctgggtatcgactgatacctggtaccctgggtatcgagctgatacctaggcatggtataccatatgcatggtatcaggtaccagatgcctagtacctaggtaccatccatgggtaccatgtgcatggtatcagataccagatacctatagttatcaagtacaacctggtacctgatacctattgtacctagtaccacaggtaccaggtcaaaggtgtgggaatggggagcacgtcgtgtcgccgtcgccgcctggctgaccggtggccacacgttcgttgcctcctcttctattctcccttccttagttcctctcctcaacgtttctcttctccttctgttgttgttgctgtcggtgggggcaaagaggaggatttagcgggggagttgtctgctgctcccgctgctctggggcgccgacgccgacgaggaggtgtgtgcttctccagctgcaaaggcaacacaacaccggcaagggaagcgtgcgataccatgaggagccggctaggtatcatgcctcttcacgttgacaacagggacgcaggacgctatatttttattttgtcgtgtgtgttaattatcccgtgacatcacttttcccgggtatcccgtgggctagctgccctccaaaatgaaaggccccatgggaaaagacaaataaaaaaaaggtttgcggattagccattattaacagagccccaatatagatcagagggcccgcataaaccaaaaggaggccttcttgatctaattttagggaataaaagtgtttttaagaaaggaattaagcccccaccctttgtttagtaaaataaagaaataaatattccgaccactagatctacattctacggtgtattatgaccattttagtagcaataacactgccaggtggttagtggttaacctgggctttctgccgatttttttttcaagtagtcctgattttcacattttgtttgtactgtttgaccactcgtcttattcaaaaaacttgtgcaaatatataaaaaaggaaaagttgtgcctaaagtgttttggataataaagtaagtaaaaaaaataattccaaatttttttttgaataagacgaattttcaaacagcgtaaataaaatgttaaaatctcttatattagaggacggagggagtatagacgtgttaatttggagtgttcaggggcgtacaatgtggagcccagtgagcagcgattgctgcgacggtgagctggagtggtcacgttgccgccggcggccagccggccggccaccgtgtgtcctgtttggttctcgccgttgcacggctatcacaccggcggcgcatgacaagtgagaaccgcgtgtagttttgtttaatcaccggctaaagagagccgcctaatccgattctgtgacgctggtggtgacctactaggctaccaccaccgacagcctctgcctggaatgaccagggtcggggattcccagagaccactgaccagtacgttcacctcatgatccaagtgaataatttcgaattcttcgtttcctactccctccgtccattttaatgcaattataagttttttattcaactttaattattcatcttattttaaaaaaattataattagtatttttttattagatgataaaacataaacaatactttactttacatatgacttatacttttaaattttttaaaataatttttaaataagttgaacgattaaagttggacacgaaaactatatctatatttaaaatgggatggagggaatatcttttccattatcactgctttttattaacggtcattatcactgctttaattgttgccttgcaagggaatgttttgctttcttatttatcgttagcacgttttctaatctcataaacaatactccctccgtttcatattataagacttgttagcattgactacatttatataaatgttaatgaatctactatgggtacgctggtacaaggatctacgtaatacgacatcaagtaggcagaaaacaaatattataccggttcaggccccttgataggtaatagccctaatccaattgatatgagattatatgatggaaaccacagattacaagggggatagtggaactcgacgataccgacgagatcgtagtcgagttgattcgactagatcacccggcgacttggctcctgtaggctccggcttcgtaggctgtggtggttgccttgattatgagattcgatgccttaggtcctcccggggggtcccttttatatcgcaggtcaactggtctccaagtaggactcggagacatcggacccagcacgatacaatgacgacccagttctgtccgagtaggactccttccatttgtgaactccatgatgaatttccttaacgtatgccaaaaatgtccgtatacgcatatgtataccatatcgatatgtgacgtatatcgaaaggtagagggtataccttacccgtaaccctgacagtagcccccgacttctgcttaaatgaactcgtgtaaccgatcgtgacttctgatgtcgaggttgttgttgttctcggtgtgaggaccgagggataaggagtgatcgacaacgccctgtgaagctcaatggtcatgagtgaatttaaattgaagtccaaaaaactactgcgcgtaatggacccagaaatttccggcggtaatctctctcctttccttggaattcgcaccatcggaagtgcgactatttaagggagttttgcggatccaatttgaagtccgccggttgtgaaaaaactctccagcctccaagcgtccctcgtcttctccgcttccgcaaaaaccctagctagctcgtctcggtcctttctccggcgaaccccggcggcaatggacctcgacaagtctacctccaccagtgcgtcgctgaagaagctataggaggatggcgctcttcccggtcgcgggaccatggagagagaagcaggaggtactgaaccccagcctgtcctgggtcgcatggttgcgatcgaggactatattctttatggttttcttcctccgccttctgaatttcttctcttggtcttgaatttctacagccttttcttgctccatttgaaccccaattccatcgccttcctcagtatcttttcgcatctttgtgaggcctacattggggtagagccgtttcttgacctcttccgtttttactatgagttgcgctggatggaaccaaaaaaggtgtccggatgtgtcggtttccgacttcgggatggcctgaagtcgcgatacatccccttccagtgcccttcatctcgcagcaaatggcgggggaggtggttctatcttcagatagaagattcggatccggtcttcattgtttctaaggagcaaccagccaagatttcatcttggactgccaaacccgccttgaccccatccctcaaatctttcgtcgatatcattgatgacctccgagaacgggggttgtcggggtatgaagtcactaccgacttcattggtaggcggatccagctgctctaggcttgagcccacccagcctttgactattctaggccggaggacgcgacccgggtttctcctcggggtattttttttgtagttgaattgactcccttatgtgcgtgttcctcctgacttatcgaattctggtctcgatctataggcttgaacagcgcaaccgtgaagcgtcgcgtcggccaattgatgatcagcggcccgacaacgacgagcaacgtccccgtccccctttgcgagaagggggcagtcgaacgcgaagctgccatcaatgtaagtgtactcagcggcccttttgcattttacttccgggatcacattgtgacttcatgaagcgtaggctctccctctgactgatatcatcgggccgctcgtggatcatcaggcggcggcgtcgctgaaggaggacgtcgccaaggaggcgtccgatgttgctgccgctgctgccacaacgagtggtggcaacgtcactgatggccttgtcaggacgtccagaaaggtgtcaggttcgagtggctctcgtctggacgcacgccgtgctagatcatccggttcgatgttgtccttgcggtacacgtgtcgaacctcgatcccatcgaaccttttttccagtttcctgacttctgcgagatacgtagataactcggggctagagcacttgtaatctttatgcacctggttcgtgactagttcggaatcccctttcacgactagtcgcttgactccgagtgcagctgcagctcttatcccggtgagtagtccttcgtattcggctgtgttattggtcgccctgaagttgaggtgaattgcatgcttgaattgatctcccgaaggtgacgtcaagatgaatcatgtccctgctccttggctgttgagtgcgccgtcgaacaccattgtccacgtttcgttgttgatttggttgtctgacctattatcaggcatagtccaatcggctacgaagtcggcgagtacctgggacttgatggttgttcgtggcacaaagtggacatcaaactggcttagctcgactacccattttgcaatgcggccgacaacgtctttgtttctcacgacttcaccgagagggaaggaggatacaactgtgaccttgtgggcttggaagtagtggcgtagctttcttgatgtcatgattaccgcgtagagcagttttcggatctgtgtatatcttgtctttgcgtcgtggagagcttcgctgacgtagtagactggtcgttgcaccttctctctctcgacaacaatgacagtgctaacggaatatggcgtggcggcgatatagagaaataattcttcattaggttggggggcaacaagtacaggtggatttgataggtagcgcttgagtgcaatgaatgcctcttcggcttcctgtgtccatacaaatttgtcttgcttcttcagcagagcgaagaaaggttgtcctcactctctcacctagcgatgaacttgcttagtgccgccatgcatccggttagcttctgtacttcctttagtcttgtaggcgacttcatgttttcgattgccttgatcttttcgggatttgcttctattcctctgccagagacgaggaaaccgagcagcttgcccaatggtactccgaacgtgcacttctctggattgagcatgaggcgatatcgtcggaggttgccgaaaacatctgtatacgcgtatgtataccatatcgatatgtgacgtatatcgaagggtagagggtataccttacccgtaaccctgacaatatgaaacgaaggaagtacatattttagaatatatatatatatatatatatatatatatatatatatatatatatgaaggttttttggaaaataaataaatatatttttcaagtgtataacatttattactcaattaatcatatcctaattacttccatccgaaaggctaaagcaatttgcagcctaagtcaaagctaaaatttaaaattttaaacttaattttaaattattataggtgctttttaattttaatttctgaacttaatttgaaatcactaattgtagaaatacaaaagtcgtatccaaaattatgtttcgttgccgctattaggcgaatccaataaacgtaaccctatatattctgaaaatatctttaaatatactacctctgtttcaaattgcaagttattttaacttttttaagtcaattaaatttatagaaaatttacctctgttttaaattacaagttattttaacttttttaagtcaatcctctttagatttgattaaatttatagaaaattatagcaatgttttcaaccaaaaaaaaaactatcagaagctagacgtaatgaaataaatttagtgctatacgtattgttatatattttacaatcttgataaaaaataaatgacctagcacttcccaactcacttatttctattgtgcgcgcatgctttttaaattgctaaacgatactttttttttgcaaaataaatccttataagaaagttgctttaaaaatatattgatatttttttaaaaaataactaatatataattaattatgtgctaattaaccgttccattttccgtggtgcacagcccttataatataaaagagggagtacataataaaaatttaaaaaagactcgttatttggagaaaaaaaatggttgagatgccgtggaaagcggcaggtaggctgaccgcgtgcggtgaaccgactcgagtcgagagagggtgcctcgaaatgcacgttgatataaacagcccgcagcgaaaccaccccaaaaaaccaaaaacccaccacccccacgcggtgccactgccaccgcccctcgccgctgacgaccgccgccgccgccgccgcacggacattccgcacacgcccgcggggggcgggcggcgccgcgtcgctgatccaacgcgagcacgttcgtcgtccatccatcctcccgctcggatttggagtcggcaaccgctcgggctcgcgtcgcggcaactgaagcggcgaaattgcaacaggcacaggcaggtgaggtgaggagcattctgatatattattatttttttttgcccccaccacctccgccgttccgcttccccggcccgaatcatcatcccccaatctagttcgtgtgcgctgttgtgcggtgtgggatttcgcggtgtcgtattggattcgatattgggttggttggttggcctcgtttgctgttttgattgttgattttcttctcctctaataactgcacgcgctgatcgtttctgtacctgcgacatggatgagatgtccgcatttttttttgttcgtaattggggaggggaagctagccgtatagccgattgttagtatgttttgatccgcatttgcgcattgatcggagatgatagttttctcatgtcacctttctgtttttttttcctttacttctttcgcgcatatgattggcttgaattctcctgcactagcggttacctgataaaaaaaaattctgcgcgtacggagcatcggaatgtgaatttggggaccatcggtggcatccgaaatttgtcaatatatatacactagtatgtgttaatcttgaacttttacatggtgaattgctctagccatttgctccatccatccaaagtagtatcactgcacttgcctagtatttagctgcttcgtgtggtgattggtgaatgtgggcaatgactaggaggacttggggttatttggtatggaatccagtactggatagctcactgtcactggtggccagtatgcatattcatcatggattgtggttagctttttccaaatctgcggcttgtcagatctgcctgtattatagttattgtacagctttatgtctggggctctttcgcgccgttgggacctcaaattctccaatgcaatccaagtcgcatgatggtccaagaccagcgtgccccactgccatgtgcttaacaaccaccttcttcctgagatcgactggacaaggaagcataattgtactgaattctcgtgttattacgtcggtttaaggtgaaaaatcttgcttgagatgcttctttaaggtggagattctgcttagctgtacagctgttgagacaagctggagatcagttattcatttgatgtcctatcacttgttcaatgttatgaagttatgaacatgggcttcttagcgttttactctgggtgcagtgtaagttatttatcttctctgaacttgtactgcacttgtagtacattttcttgatctcttcagttaaagcaatttatgtacaagctgttttgtgcgtgactttttcctgtcataatcattatgttgcagggtcggaccacccttgaaagctcttttgctatcttgctcattgacctgatcaagttgctagacctttgctcttgttactaactttcttggtgttatatacaggtatcaagtttctagtgcactaaacaacctttgagatgggtactgtagagaatatggaagggagagaagagcgttcgactgatgtggaacgggatggtaaacaaggaaaagaagttgaatcggactatgaaccagctagagactctgtttcatctcagggtgaggctaacagcaatgaagataccagagccaaaagagtctcaagggttccaaagaagctagtgaagaaagattcaaaggaaaacagcccacgctcaggcagaattaattccaatcgccaagtgcagactaagctgcaatatatatcgtcaaacaatttgcagagcaaatctccaaagccaaacaaaacatctgatggtgctaaaaccattgagataacaaagccagatacagtgacagttccttcttgtccttcatctgaggtgtctgaggagatggatgataaacccattgagaatatagtgacggatgataaatccattgaggatgtagctgatgataaggccactgagggcacggcctcttatgataaggccactgaaggaaaagctgctgatgatacgaccgttgaggacaacaccactgatgaaaggagcattgagagtggcactgatgataggaccattgcgggtatagcagctgatgttaaatctagtgaagaggcaaaggagattgatatattggatgaagccccaaattgtgatcagagtactgctactgacgaggaaatagctgatactgaagaaagcatagcttatgatggtaaatcagctgcatatgaaaagagtgaggaattagaatctaaatgtgaaaggttggagcaggaacttcgagaagttgctgcccttgagatttctctttattcagtagtgccagagcacggttgttcatcgcataaattgcacacaccagctcggcgtctgtccaggctatatgttcatgcatcaaagttttggtcctctgataagaaagcttctgtcacaaagaacttcgtttctgggcttgtccttgttgcaaagtcttgtggaaatgatgtttcaaggtaaagtatctgtaattggatatagtatgtaactctgtgtagcttatatttccgcataccatcatttttaaaataaatctttatgtaggttgacattctggctatcaaacaccgttgtcctaagagagatcattgcacaaacatttggcattacacgccaaccaat

SEQ ID NO: 61047 - DNA, 15900 bp, Oryza sativa
caaacatttggcattacacgccaaccaagtcttgctatgaaggctttcagcacaaatgttaatgcaaagatgctcggtaagaactcttcaccaacgcggcggaaaaacaactacagtggcaagcatgctagacctgctatctggccattacctgatgattggcgggaaactggtacactcgtggctgcactggagaagattgaatcatggatcttttctcggattgttgagtcagtgtggtggcaggtaaaacctttcttatgctttctcggcactttttaggaaattgagtacattttattctctgtaaaactaggatagcagacagctttttcgattcattttgttgtcaattttctgaaggatgtttccttttcaggcattgacaccccacatgcaaacactggtgaaagatatatcaagtccaaaggctgggagtttgttgggacctgctttgggtgatcagcaacaagggaacttctccattcatctttggaaaactgctttccaagatgccttcagcagaatatgtcctcttcgtgctggtggacatgagtgtggatgcttaccagtgttggcaaaactggtatgtttaatcattgatatttaatttgagaagaataatcatttttgtgaagtttatgcatgagttgttttattattgtcaggtgatggagcactgtgtagctcgtttagacgttgctatgtttaatgcagtcctgcgtgaatctgcaaatgaagtaccatctgatcctatatctgacccgattgtcgactcaagagttctaccgattccagctggtgacttcagctttggatcaggtgcacagctgaagaactcggtatgtgcccaaattgcaaaacaactacgttcttagtttaaaaccacttacgttggaacgtttcctgtaactgcatgaagaacaaaccagaacatgtgttttaaatcatctcttccttgcaaacaaaaccaaatgttaatggaccaaatgcttcttcagatcggaaattggtcccgatggttgcaagataagtttggcatggttgctgctgcccctgagaagcatggtcaagcaggagatgagagtgatgacagaagtggtgctgctgatttttattctttcaagctgctcaacgagttaagtgatcttctgatgctcccaaaggacatgcttcttgaaaagtccatcaggaaggaggtcagtattcatgcttagtcactccaactcttaagttggaacatatattcaggttcagtgctgcagttaaaattttgtcattctgtttaggtctgcccttctattggcattccactggtaacaaggatactctgcaacttcactcctgacgagttctgtcctgaacctgttcctggaatggttttagaggagctgaatgccgaggtacgacgtctatttgctaaatgatattattgcattgtagcattacaaagtccaaatacaatcttgctcaccatatgtaatgactaaccaagatacttctatagtttcactctacaccttctcaatcagtgttggttgctaaattttcacacagagcttgctggagcgcttcacggagaaagatgtgatcaccacattcccctgcgtcgcggctcctgttgtctactgccccccttcaccggaggatgtcgcggagaaagtagcagacgcaggcgggaacgcggagccggacctgagggcctccatggtgcagaggagagggtacaccagcgacgacgacctggacgacctgggcaaccccctggcgtccctgtacgacaggagctctccaccctcaccctgcaacggggcctctcgttcgactacacggcaaggtggctctatgtcgaacgcgagatacgagctcctgagagaagtatatggtcggagaggcctggtttgagtaaccagtgaaagtgtggaacggaagacgaaaagagagcctcttggtcttgggttgcagatttgctgtgaggtgaacaaggggttggaaattggtcgggaaggaactgctttgcaacagacgctgaatgaacgaacagcacttggatatcctcatggcaaaatgctagagtgtttagaacccatccccccattcttctcatgtatatttgcattttgattctgttgaagtgattggttcactcttggcaaaaggggataaatttatttgttggtggtagtgaggagaaattttagtgagtggtcagagtgagcgtgacttctgcgtcagccatcgttcgatgggccgcctaactgatcacaaataggaataagttcaactggcgtccctcaactttacagtttacatcgatttttttttgacatcccttatcctctgccttgtttcactgatgtggcatcatagtcagcaaaaataaaataaaataaaatatagagcccacataccgcatctctttctttcctttttctcttctcttctctcgagcgggcgtggcgtcagatggggggagaggccgtcagcggcggccggcaaagcgagcgcgacggcgggcagagctggcgcagcgggcgggctctgttgccgatgttgtgctcgtcttgcatggagatcccctcgcgacttcgtggcggcgggtgagcgcggcgggcgacccatggatcgagctagtactacgtgctatggcccctacctctgaattatgctgctgctagagcttaggtgggtatcgaagaactggacactgcagatagctttttattgataatattaacttgtggcaaatgacgatcaagcgtatagcaatgagtgagagcgaagagttggtaagctaatgctactgctcttgatttggagcacacactatacggttgcgttgtattaaaccgcaacccaccccccaccccaccccccgggggcaacccacacccctacccctacccccacaccacaccacaccacactagcacatccctgtccccctcaattcccgtaatggtgttactaacggtactatcaatttctactgagtaattgttttactggtagtagtgtttgaatcgtcgtatacatacatgtgttggtcccacaccgtaactaaccactaatcaatttcccccccttttttttttggatctacagaggcaggaagccggctcggcagctgtggcatcaggaagcggaggcggcggcgacggcgatggcgtgctacagggaggaggcggcgtgctggatctaatgggttaggcggcaagaacgggcatgtccatgtctggcgaggaggcgaggacggtttcgctctcgtttccgcggttgtcgtcggctccctccctcaagcgagaaaagcaagaagcgcgctgcctccgccaaggctgccgacgaggcctccaccaaccgcacccgcgctacctcccgacgccaacccctccgctggatccccattgctgtatcgttctcctcggtgaggtggggacttctctagggtttggggattaggggatttatagggttcctctgccctccctgcgtataggaacgaatcagaatttggtttttctttatttttttctttacttcatgcgatgggattttgcatggtggttctgctccagatctggaagcttcaatggcatgggtatcatgtgagaagctccttgctggtggatgccccttgttcttctgttccagatgtacaagctacagggcgacacgagctcctgctccctgcactccataggttagcctgcatcgacgaggaatacttgaggacgccaggggtgaagaagggtgtagcctttgggagccttgccgccagatccgccgtatccagcggccccgcgcgtccccgacatccctcttgccgtggtctagggtgctgcgatgtcgtcttgccgtggtctccattcggtttgttctccatactattttaattggacatagtttttttgagtaattggacatagtttttttgagtgctcagactgttgtgggatctattcaataagctgtaatgacttgttgtctttccaattgctgaaatcttggaggttttttttcggttaatttggctgaataacaatgttatgcgatgctgtttgtgctttgattcttcaggtactaattagagatattggagccattgtttaattactttacgagcagttcaggtactttactagcaattcaagtgacaaatttggttcactaatctagttctagcagtacaaacaatttcagcttttcctagttttagagttttgattctggcatgaattgtatggggaatatgattaattcctgcacactttaggatgaaggtctggtctcatttcacttgagcagttcttgcacttcttttctttcaattgcgggaatgttcagatcattttttgcttaaagtacctgattcgttcttagtttgtgtgtttgttggcctaaatctttcttcaattgcacagctctggaactcttgctgaacagaatagcatgaatgattctagtgtagggaagttcttatttttattttttgttggatcatggaattcagcactaattatagactaacagtgttcttgagttttcaggcatatctctgataggctagtgttatatggttattatggggctcatgagttttgaattttggtcacgattttcaggactgcaaaatatgcagtgagatgtgtaaactctgagatatgtcatatttttacagcatgtgtacagtattcgtcgtagttttctgaaattagtactgcatgtcctgtgagatgtgtaaactctgagatatgtgatatttttacagcatgtgtacagtattcgtcgtatttttctgaaattagtactgcatgtcctgattctgaattttcggatagatgaaaactcaaaaagctcgatcgaatagcagttttctaaatttttgttgttcaaaggagcacatcaattgaattctttttttctgaacttctgactagatatgttcgctgttgaacatacccttttttctctgtatatttttgacagaacagacatcttcagactaagactaaggtctaaattttactgaaatgattaacttctaatttttgcaggcatcagcatctacagtgtgcactcttgcaggtggatgcacatcttgatggtatggtggttggtatttgctctgctgaagatgtacatgttctaatttttttggttgctcatctatatctgaattttctttttaattgtgaattcatttgtgttcaggaaactagaaaagaacatgagaagattatgccagtggtgatggtgccactggaatggcatcctcgacatgtccttcgtcaacgttcgtcgccggcagccaacacaaagggtcagcccaggacgaccacaccacaattgatgacaggcttcggtggcaggcgatgcgatgccctctggattgtgctttttttttgggtaccgggtgtatatgtgtttgtaacgatgatggcacgatcaattgtaaaaacaaagtccattatacccgtattcgtgcagtaaaatatttactaccttatatatcaggcccaatcaactactaagtaacttttttactccctccatgattggataatcccaatacatatcaataattttttttattccatgaatatgttgcttcttatctattagtaaatcatttactcatgggcgagtctctattagtaacgcatgtactcattgccaatatgagatgtggctagcaaacgatattcttatctgttagtaactcattgtgggccaagtctctgttagtaatgcatttactcatgggccaataagggaagtgccaaacaaatgttactcttatctgttagtaactcatttactaatgggctttgtctctgatagtaactcatttactcgagaatagtaactcgattacttatcaaaaacatactaatagtaaatgaattactaaagtcacacatattattgttggtggctgggctagcaaaaggtgcgggattgatacatcattcaatttttacgtatagtaaatatgttacttatcgtatattgcgccacaaacaatcatttagtaattaatttactatacgttatttctaaaaggtgcagggtgagggatgtggggtgggtgcagctgggggggtaggagggagggtgggggttgggggttgtgaggggagtagtttagttataacgcaccctaggtgccgtttagcacatccctatatatatatagacatcggccgctgggacaagcatccaccagagcttgtccgccgggtgaggtagcccaggttgttgatggtggcatcactccgccactccatgccatgacaaaaatcgtcagggctccagcggcagctcagggctcaggtagcggcgcgaggagcgcaaacaacggtgtgaatcctgctggagcgctgccgcaacgagctctgccgcctcatgcttccgcggccatgccgctctcctccgaacagaagtgggagagagagaggaggaaggttagagaagaggggaaatagagagagaggatgatatgggtctcactgcatatttttatttttatccgaacacacgctgatatgtgggtcccatgttttttctgactttatcaatgtcacgtagacgccgccacgtcaaccaaactgtcttggactttctttgcaccggttttaagaattaagggactcgtcatattgcggttcagggacgaatttcggatttggcgacaaattgagggacgtacaatgaacttattccttgtggcggagtcccttcctccgatccggccggcccgacctgtgatccgacgcagctgaagcacgcgggcgcgctgcccgccaaaccggtccacgggccacaacgtcacgcgcgagtactctccgtgcagcccgcgcgtcgtccatcccgcgatacgatcctctcgcgtggcgcgcgcgatatccccccgaatcaccgccaaacctgcactggttctctcgcgtggcacgcgcgcgttgatccaaacccgttgttgtacgtggtttgcggccggcagcttgcggccgccctgcgcaagcgcacacacattatgcatgcgacgcgcgcgatcggtgacgagtcgacgacgactccgcgggagttgacgataagagatcgccgcccgcaggtaggcatgcgcgtcaccatcgggggcggtcgtaactttgtccatcctcgcgtaggcaaacaacatggcaagcaagcaggacgtgtttgtgaattggctggcacaaataaaagcaagccactttacgtactcctccagctgttacgtaaaggacggacgccgcggtatctccgtgtactgtgttgtaaggccctctttgattttgtaaaaagaaaaacaaaaaaaaacatagtgattttttttttaaaaaaaagtttgagtcctactttattttcttatctggtccttataaaatggctcgagagaaataaatgtgaggaaagttaacacatgatatggctaactttatgggaaattttctttgaacctttttctctcctctagtttctttcttttgtttcctcacgaccaggagcggatctacagtgttatgacctgtctcagacggcaccgacgtctttcgacaagctatgcttaaattgcttgtctatatattataacactatattctaaatataattagtatgctataacaccaatgaacaaaattatggatccaccactgctcaccatctattgcaacgatatttatttatttatttctgtattttgcaattctttatttaacaattacatttatattataatcctaaccttttcatgtctgtttttatcaattctactacatttttaaaggggcccacactatatccgtgcatgtttatttcactcgtgtctttggtccctttttttcctcaacttccgctacttgcgcgccaccacacaatagatacgcaatcccaccacagcgatgcaaacgttcttacagttgtcattgtccaagcttctttaatttccacacatgctttaatttgttgcgcactgcacttacgagttacgacatctcgtatgatctatcttgcactgaggtaattaaactcatttccagttgatttaatttacatatttgaagctttcagttcccctatgtatgaaactgattataagccgtaatacttattagcgacttaaaaactaatttatcgcggtttaaattttatatatgtattttttgcttaaaagtcaacgcaagtaaaacaaacaattaaaaacagcaaaatcaaccttaaaactaagatttaaaatttaaattaactactaccgaagagtggaagctgtactatttagttttgatgaactctctctatatactccctccgggttgataatacttgtcgtttaggcaaaggcacggtctcaaaaaaacaactttgaccattattttctattataatatgtaaaaaagtgttaataaatatatgattttattaaagtactttttaagacgaatctatacatgtggtcaccatatttgaaagacaaatattttaaaaataattcataatcaaagattctaaagtttgatctcacccttgtcttaaaacgataagtattagcagcccggagggagtagcataaactactcgctagcgtaaaagaaagctacctgcagcatgcatgcacccatgtggcaactacgtgtgcagattgaagacaaaaacttgagttgcttaattagaagctaagctctcaaacacatcacacgtgtgacatcatgtagagtaagtagctagtgcaatgcactttcacgaatcaaacgagttgacacggcttgttcgtccagtctactcaaattattgccacatgtgccaatgtcaaaccatgcaccagtactagtaatatatccaagtggctacatattggagttagctagctacctgatgatcgacaggagatcgatgaaacaactcaggcatgccatgataagataatgatgcatataaacacgtcgtattcatttgggtagatatgtgagagctaccccagtagtcattagtggcacacatttggctagaagatcgagagcttataaacccctcccctcccattggggactgtacgatagggtctaacattctagaatgagagagagagagagagaggttggatgttgagaggaccgaaattctgattataacagtttcaaaaggtgtaataattaattttatacctgtaattaatttgatgtaacatcaacaagaagttagggtgcttacattaacttagaacatgtacaataaagtaatgtacgtgggttgtacaatttgtacaatttgctacatcagatttgtgctagaggagagaagatgagagataagaaaaacgggatacatatttatagtcagatatagcacgaactttaataaactatgtgagagagatggaaggattatgtattaatgatacaatatatatctacatctaactattgtatgagcgagctaacaggttggctattggtgatattttaatttttggagctagttgttagctatattattaaacttgctcttacattgatcaattgtaaaatgtttttcataggtggaaaataaccgatgtgagacacaatattattcaagagatatgtacaggtttttttatttttggaaaaaaaaaatactatagctagctaggtgcacgggattgggattaaatccatgacccgttgaatgaaacatgcgtggactaaccaacgtacgtagcaaagcgaacattttacattaaacagcatagacgacaaccaaatattccatccgtttcaaaatgtttgacaccgttaactttttagcacatgtttgaccgttcgtcttattaaaaacttttatgaaatatgtaaaattatatgcctacataaaaatatatttaacaatgaatcaaatgataggaaaagaattaataactacttaaattttttgaataatacgaacggtcaaacatgtactaaaaattcaacagcgtcaaacatttcgaaacagagatagtatttgagtattgagctaatatgttggttaattaaggggcgctattgggcggggggaacctgaatcaaatcactcttttacgtccagatactagatcaaccatggatagtgctaagctatgacctcaagagattgatgcgtcaatgaaatagtacaaattaaagtaaattttacggtctttctatagtgtcattttaatcttttaaattactgagtgtactcataggtacaacttaatatgctatccgagttaactttcttcgcgaacgtgcaactatccgagttaactaaaaggtatcgagttcaaatattgatcaatgaaactgaacaagaaaaattgtcttacatctccgtttcacttgttaaagtaatcaaatcttaatcccgcatagacaagtgaaaaccacgtctaacctttttttgagagaaaatatattttttttgagagaaaaaaccacgtctgactaacaaaaggttcctctccgacataactacatgatgtgatcgatgtgatcaatgatagagccatccacccgtaagtccatagtatgttaatgagtcacaatgtcatggcgatattacgtcagaggattatgatacatggcatgactggcaatctgttattagagtcactagtacagagggtatgttcggcaggccaactataactgctgtgtagggcggctgctgctgcggttatggtagaaattgtatgttgctactgtagctgttgattgccatctagtcacaccaaacacccagagtaattttactcatagttttgggtgctcaaaattagatagtagctaaaaaaatcaaagttttcctcgttaatagaaaagtaatattggtaggtggatatgtgtaagggttgatgagggttattagaggaataactcatcgatttgcggactgatagaggataaaaattaatttattttgacatatttagaaaataccacacgttattttgaaaaacacagaggttaccggaggagagttttctcaattttcattggccagggatgcgtcaaggcggcgtacgtacaaagcgtaagtcgttacactgaaaatttacgctagtgctgtagctgctagttgaggccaagttaatcttgcatatgcaagggtacgtagctagccgtgctggagaacgtgcgcgcgcgtacgatcgaattaacagcagcaaggggcctcgctctccggtgtcttttcttgccggacaaagtaggtcgccacacctctcgcgacgtgcgtgcattccatgcatacgcatgtcgtgagctagctagctccatctatatattgtccttgacgtgcatcgcggcatctagtacgtaccgttgccttgccttgcctggacgaacggaagcaacagcaacgcatatgagatctctccggccatgcatgaatgcggcccatccttgtgccaattgtcggccaatggtgtacctagaaacccaaacggcgtgtgggagaagcatcaccggatttaccattgttgtcagtctcctttaagcatctgctctctgatctcactgttaaaaaataataattctaatttttaagatgagtctgaacatatatgtcaggctctaaacacttcaagcagtagtagtacgagtttgtaagctagtactctctatgtctcattttaaatgtaaccatgattttccgtgtccaacttttaccgtccgtcttatttaaaaaaaattgaaaaaaatttgaaacataagtcacgtataaagtactattcatactttatcatcttataacaataaagatactaattataaaaaaaatcaaataaaacggacgatcaaagttaggcacgaaaactcatggttgcgcttaaaatgggacgaatggaatagttgtgttgtgcctgcgcatatgcacgttgattattactccctccatcccaaaatatagcaaacctttgagggagtaatgattataaaggattgatgactgatcttgaagataatatatatgcacacacatatatatggcgtgtttagctaggccctgtttggaagattagcccagggctaattttaagagctaatgtttagtcatgaattggtaggctaaacattagcatagggtggcatgtttggatccatgggctaattcaaggctaaaagatggagagagagagagagtagaaagagaggagagagaaggagagagagagctatttttttatggttcccacacaaaattagcctcattagcaccccttggaggggctaatgttttgaggagggctaattcatattagctcaaaattagcccacctgtttggattattgagggctaatttaaggctaaaaggtgagggctaaacattagcccatggaaccaaacagggccctgcatggtacaaccgctgtgtagcgcagcacagcgtatcggttattacagccacacaaatcactgttgaggttgttggttgcgttgtggaacatgcccatagccatttaattacgggtagtggttttgtataaagctatatacagctatattatcatgctaagaatggtttctttatgtggttttcgtaaatggcaaactattggcttacataatagttgtgaaaatgcagtaggtacagtggcaaagctaggtgtgatgcacttgatagggcagcaacaagagatgtatgattttaaccataagatctcatatttaatccgtaacacactcgtattttttttcttaaaatatgttggagggacgtctcttccttcaaatcttgaaaaatgccatagttagttataggctgttctcggctttcactggtttattcaaatgtcatagtccagattttaaaatacatgtggacagcaatggaggtagcatacacagtagtatttcgtttttttttttcagaatagtaagcactacgagcctgcaaatgactgaagctgtgtgtatactgtatagtgcatagctatgtgtaacctagctaaagcctgaatgtttcagctctttcatagtctgaaggtttatagaaaagcagagagtactgcacagatttgaaatttaatctcagccccgtcgtaaatagaactttgcatgcattggaaaatattgacgtagttcttcagatcaacagccagccttcagccacagctcaaagcaagtacagataaactgaacagtcaagctgtacgaaccatggattatatatgaattagtgcacgtacatggtcaaacattgagacggggtttaatgattaatctaataaatcaacactgcttaattcatgggacatcttttccgaatatcgaatcctgacagatcgggaaaatggcatatttcctctgctggtatagtaactcctctgtcagatgtcaatatgtcatagatcagcagcaacattgtgccattttgtgccatttattgtcgactcaattattcagtaattagattctgtattttgttggcacaatgttattactgaaagatgtaattcaaaaataggaattacatcccacgaaaattttggaatcgtccttgtgtcatcatgcagagagaatcaataactacaattatctgaattttttttatcgaaacacatacaactatctgatcgaaaatgcttccgctcgggcgtctgagaccaacaaatcgaacactgtaccgtagtcaattagactgcagggattaacccttgtgaagtacagtattttcagtcaccctagcctctagtgagcagaaaaggattcggattttacagtcccctaccgaaatagttacccttatttcacaaacctacccttaccatgtcacaattttacagtacaatctcttctactcaattttagtttacccctttcaccacaggatcacataattaatgattttttttgaggtgaaagtgaaaaaaagagagaaatactgtagttcgagtggaacaccggagaccggacgtcagaactccggcaagaactccgtcaactcctcctcctccggctccggcgaaggctcgtgaagcttgttgaaatactctaccacgctgaacccctcgcacgcggcaatgtcgtcggccggcggcgggatgtacggcggccgggagagctcgccgagcaagtcccacgcgactccggcgaagaacgggtgggcacggacctcgtcggcgccgccggcgaagccgagcctcttcgtgggctccttgtcgagcagcctcgcgatgaggtcggtgagctccggccaccgccgccgcgagtcggcggagaactccggctcccggaggagcacgttgcggaacgtctccttccggctccgcccccggaacggcgtcctcccgtacgccatctcgtagacgagcacgccgagcgcccaccagtcgacggcgaactcgtgcccctcgccccgcaccacctccggcgccacgtactcctccgtgcccacgaacgagaatgacctctcgcacgcggcggcggcgccgccgctcgcgctcgcggccgagcagaagctcgcctgcttcttgccgcggcttaccggcgacaccctcgccgacttcgccttcttgaggtggtcggcggcgccgccgccgccgtcgcttctcttgaggaaccaggccaggttgtgggtgtactgcccgggcgacgacgtcgatgtcgtcgcggccaccgacgactcacttctcgcgaagattcgcctcagctggctccggccatgtccctgcagctgcggcggcggcgacgacgtggccgagcacgacgacgacgaggtggaggtggacgcggagggggagacgggcgggagcagccgggagaggtcgaagtcggtcagcgtgacgtggccgtcggcgcggaggaggacgttctcgggcttgaggtcgcggtacgcaatcccggcggcgtggagctcggcgagcgcggagacgagctcggcgacgtagaacctgatggccgcgggggagaagacgcggtcgggctgcgcgtggcggagctcgttgaggtccccgccatggcagtacggcacggcccacgccacgaggtcgcccgtctcggcgcgcccgagcagcgacgggaggtgcgggtgcgcgagcccggacagcaccgacacctcccacctcgcccgccgcgccgcgtccccctgcctcgccgccgacgcgacgacggacctcttgtcgaagaccttgagcgcgtagtagcacgccccgccgccggcggcgtcgtccgccgccgcggcgacgaggaacacggtgcccatggcgccgcggccgagcacgcggacggcgcgcacggcgtcgaggtcaatgtccgccatgcgcggctgctgctgctgctgcatgggcgcgcgcgcgcgcgctctgtgtgtgtgcttgggagtgtgtcgcgttgtgagcgacgaggacgtggaggcgagatataataagctggtagtagggggccgggctaaacccgcgagacggttgcctaattaatttgttgtttttgtcttgtttaacctgcagagattaatgaaacaaagtggcaacgccacttcaagatttatactattgttatctccggcacagctttggcgttttctcaattctcatcggttctgtcaaagagacgatcttcggagcatatactggcctagggtttcaaaaccggctcagtcatcgaataccgcacggccttttttttctgtctatatatcatatgacataaaatctcacctcctatcatttgaattttgaaccattggatgtgctttaagattcgcgcagccccttaaaccctaactcctattcctccttccccggttccagatcatgctgccaccctcctcctcccgtcccacacgcgatccgccgccaccaccgccaccgccacccccaccgcgctgccgcccgcctcgccggctggccggaaaaagtcaacggccctgcaagccccctc

SEQ ID NO: 61048 - DNA, 8205 bp, Oryza sativa
  unsure (1)..(8205): unsure at all n locations
gccccaagnaaacccccntcttccccctcccccaacccccctcctaccctcaccccaaccccaaaccctaacccgccggagttggaggagagaagccgatgcacgaatcttggcatggatccaatggtccaaaatctgtaagatttcatcctcaaatttcattcgaatgccatatagcaatcccctttttttcgataaacgcgattactgtatagtgtccgacaaaatttgaacaaaggtaggagtatttgaaagttattcccagtgaaatatactatttttatatttccatcttttatatttccaaaggtgccatataagcaacgagtcatgtaattgatgattgaaaaacacatggttttatttttgttgtttcataggtaatacatgcaagaaactatatattataaacaatttggacatggttttatcctctgacctcttggcacgtcggaacaatttggacatggttttatttagatgaaactcatcgatctcatctctcactttattatatttcttaccacatcattaaaaaaatactaacataacaccctatttaaatagaatgaaactactatattaggatgggccttatcttaacctcggtcgtctccttcgatctaatggctagaaaattgtctccaagattcagccaaaaagagagcagggagatatggagaagaccgactccccggcaatgacagtgttgccgctagagccgcgaggtcggaggagggtagtggataagtcggcgatagaggaattagatcagagtggtaggggagctaatgggggcaccttgccgtctcccatattgggtaggaggagaggcggggagggaaggggaaggtcgattggcgggtcttgttggcatgctgagggcagggatcgatgtggtgacacgagtagggtcaaccaataagtcaccaacgagataaaggttggctggagctgaagggcaccctgaaagaccttccagggagaccagtgaccctataacgatataagtctaccctatgaagaccaaataacctgaatatgttgaagaaggggaaaaaaccctcgtaaatgtttctatcaaggggttatgcatgtaagagtttgtgtaagcaaatcctaaggttagttagcaaggctaaaaacctacaaataaatcctaaggatatgatgcaagggcatgttgtgaaaaattaataccgtacactttactgtttttgtctatatttttaagataagtgtttatcttttaacagccatatagttatttaatggtcccttcaacaaactatactgaacttttgaattctcttgaactataccagtttactgactcaatacttaattcctacgcgctcaataagactgatgataactacaataactgaagtactgaaaatttaccgtcgcattttcaaccatacctctggcttgggttttagcatttctaagatattgtatccgaggaaaaaatgtgtaattgtttctctctaactctagtcaagaaaatacattgtttgaagatatcttaaaataaatctgtcatgatttacatgaaaatcatatggtggatttaaataaaaagcagtttaatatagtactatcatgtagagctgtttatttgtggaagatttgaaaactagctttatcacttcagcatggagtaagtgggtggtggatgccgttggtccactcactaatacgtgtgcatgataagctaaattatgtcaattttgtgctgcttatgcctcctccaataaaggtgagtcagctagctaataaatctccatatcagcttttgtatgatgtggaagagagagaagataaggagagagaatgcactatctcttcttcaagagctaagcttctaaagaaaatatgagaggaattgtgaaacccaaagcattttaaataatatgctataaaataatttattggagagttaatttttttctcttgtataaggtgaacaagcatatccattaaaggaggcgttacaagagagatcatttggcgtggagctcaaggtgagaaaggtgagctttacacgtgtgcacagtatcagcaaccgaagattttttttttttttacagtgactctacaaacaggcacttcacatagtagtattcaaaacaaaatttaaactgctggtcatcaatcatatgatgcaacggaacgggcatattccaaatcggacatcgtacgggattatcgagagactttgtgttgcgattgtacatgacaaaagattatgataccgataggacgaaccgtaccattatattgtgcttgggatgctgctcatgagtcgtagcttgtgttaattttgcatatttgtacgatgtacctaacgaattttgaatgcaaatttacgagctaaattaactggccagagcagaacccgtccttcagcgacttctgcacgtcgccaatattgacttcgagtcaaaatttgatagtacgaattcggtttgattaatgagacaaaatagagtgcgattgatgcttccctcctaacatgataatattttgtttaatgctgaaatcaagaaagtgaaggtcaaaacatatcttttcgtgaatcagccttgtctgttggtgcttgtttagttcgcgaaaagaaaatttttaagcgtcatatcggatgtttaaccggaatttcggatacgaataaaaaaactaatttcataactcgcctgaaaaccgcgagacgaatcttttgagcctaattaatctgtcattagaacatataggttactgtagcacttatggctaatcatatgtactaattaggattaaaagattcgtctcgtgatttctcccataactgtgtaattagtttttttagtctatatttaatgctccatgtacatgttcaaagatcgaatgtgatgttttaggaaaattttttggtgaactaaaccaggccttgtttagttcatatggttagctttaccttttgaaagtgctactatctttttttggtgaagttcgctcccatggtgagctgcatgcatgtgacagaaaaatcagaattgaagttgacattgtgcttactgcttacgtgccaccaaattacagtgcttaaattcagaattgaagttgacattgtgcttactgcttacgtgccaccaaattacagtgcttaaattcggttataatttagaataatcagggatcatattggcttgcttcaaacatgtccaacagagaattgagcttgagtacttggactgtagtttttttttttttactttcatacagatatttatagatttcttcagttagttctttcaaatgtgcaatacgaggagcagtataccatcagtatgacagtcatcaactggtgagcttgtatggcagaaatgggtcctatataaattgaattactaattaattttagctgcagtagtgccagggtaccacctggtccaccagtctaccaggaacactgttcgtccgtaaacatgtgtgtgataaagaagatactcagagccgtatttatttcagtatggcacaggagccatccaaaatggcctaaaatccagcgtcaagttgcaaacaaaaagtatatatattcaactaagtttgctgacaaaaaccaacataaccatcagggaacataagtttatatatgttaaagggtgggtggttcgtactacaaagacggtgtacttctatgaagaaaatcttcatggagtcatgtttaagttgagtgtgttagctacttttgttctcttttgagaggaggtttgattgctaagtggcagcaatactaattgctccaattctgtcgtttctgaagatatataattcttcgtggagcccagagcctgaatttgagggttgccttacataagcacattagaataaccaagaaacctgtcccatggtcaacaatttgtatatcgacacttcaaccaacaaccataaactccaacagtgctaagttcaaaacgagataatgggtaaatggagaacagagttcctgaaacactacctgattacctgctataaaatggaatagtcactcctagttcctagtgttgcctaactctagaaaatcttcatccgccgtcgatcgagacagggacggatgaagcaatttcacaggaattaaactatctcctatgaaattcctccaaaatttctacgtttcaaaggaaccatgagtgtgtggacggaggacacccggcagtttctgttgtagatcatcccctgagtcgggatgtgagaaacatcacgtggcataggcaaaccatcctatccaacaccatctgtgcggcacatgtatgatgaaattatcaacagtgaatcagtgtgatggtttggatgatgctctgaacttgagccgtggagagggaccagttctggatgatcacttttcttgatcaggcgccggtccggtcaaggcctcgatcgctcgtttcgtttggtggttgtctaccactcattaccaaagctctgggacgagaccgaaaacttctttgttttctccttaaacaatgattacctgaaagcaagattagctataacaaacgtaacgtggctccctggctaatcaaagcatatggcgtcttgtgccgttgttgcttcatgccactgtgcacgcaaaggccattccttcctgccaagggatacccagctgggaatgtctctgacagaagagaaccaaaatggagacgtgaattcagacgtagtatctgaacatggagaagaattgtggattttggtgtctctgcagatgcagagaccgacagatacacatatatacgtatagggatatgctcagtgttcagtgttgttgccacctgccaatccgtcaggttaacgatccttttggaaattccacccgtgcattcttgtgtgactgtgtgcgcgaatcatgctctgctccattattggagctgagcttggcgtttggcatcttcctgtttatctggttaacttcgtcgtcacctactggctactcactccccctagtctttaacaagtcgtaaagctgaatagttgctaacatgttagcccacactgatgcagggggttaagagtattcaaatcggagcttgtcacccatttaacaataggtgtctaacttggtcggccattacacgggagtattctagatcaaagtgaggtaatcagcactaagtaatttcatcaacacaagaacagatgcatcaacacaagaacacatagggacataggataggaggcccttttttgcagctcctgggtgcgtgatgaaccgatgattagtgaagctcaattagtagctccttgacctttgccgccaacgaacgcagattcaggcatcgtttcagccataagagccactaaactgaacaataccacttttgttcatatgggaagttactaaagatcacccctgtgtgcgatcacatcagagaagtgaagtcacgtcacgttggattgtggcgcagattgctttatgcaaaagcgtctcactctcacacaaaaagggggtcaaggccgacgcttagctgttcaactcttggcgagggcgaggcttcagatcagatcagatcaaagatcaagatcagaactaccgcgatgaactgctctgcaacaaccgacaaccgcggttaatgtccacaagttgtgtgagcactgttcggcgacgaagcagaaacgaacaacgatccgtgcagagagacgagcgacgacaccaccggcgccgcgtgaattcgcggtagccgagccggggaagccgtgaggcgcgacgaatccgcgggggatgtgatcagccgaccgccaccgatgggccgtgcgaaacggcaaaaaaatgggcgaaacggccgaggccgcgcgggacgggccagcgctcggtggagttcgtggaattcacgggatttcacggggaatttggcccgcgtgcgtgtgggtttacgaggccagccagccagcccaccgtggaaagctactggctggctgggttgatgccttgatgggttacaagtttacaacggttgttgggtttggattctataatcaggaggacgtgtcactccgtgtccagttctactacttttttctctttggaagcgcaaggtgcaaagcatgtgtactctatcgttcatgtcgtgacgctatacaggtcaaacatggagaattggagataagagattatggtgttctgacagtacttttgtagtccatctgctccctgtttgttgatggtgattgttggtaaaggtgatctgggtatacagaaaatgattcagaaaaagaaacacacactaaaagttgctgctatgtttcttttttcccttcagttactaccaacaacagctaaaaacacttgctcaaaaaaaactgaaattgaatttggcatctagatgatatttaaaattaaaatgttcattttgaactatgtggataatctcaaggaaatactgatctaacggtggaacaattaacatttttttttgcaaggaacaatgaacatgattgcctgattgggagggagtaagaaaagataacattgaactttcctcaccaaagacctcgatgagaataccatgtgctcatccattttgcccgttctccgtactgccacatgaagcacgctaaactccatttcaacaacaaaaaagaattaagtaatgtaaacctcaagggatcagtttcggcacaaacaatagaaaagcccaactggcaaagccaaattaacgagaagagagaactatatcacgagaactcttgactattgattgcgcatcacatcgagcagcctaaggaatcctaatcatcatcatctacaagaacacaattcgcctaccatcacgtatactctattgctaacagttcgtgttagaccaaataaaaaaatataatcagaagtaatcaaagacgagtgaagaacaggtcagagtgagaccacaacacttgcgagaaagaagacgactggccatcacgagcagaggatgtggacgtggccatgtgaagagtcaggccgtgtggcctccacgacagtataacccgtgttcatgcacaaatcgcgccgtatcttttactactcgcacataatttctccgcacaaaatgacttatctttttgttgagaaaaatgaaaagtttattctacttgggtagtagtactatgttggctgatctttttttttctccctttttagcggttcatgagagacgcgcacgaattgatgattagttgcttggttggatgaataatttgcagtttacaaagtgtggagaaaggttccagtttgagatgaacacggaatgtgtcggaactggaattggatggattgtttatagggcagcaaccagctaccaagtgattgctaatcaagctactcaattccattcctttcatttcaatgattgagcaataaccatatgccgaataattttgtaaaaatggagcagaaagtgcgagacaaatacacacccaatccatttgttcttcgattctttttccctcaaccacctcacatcaccattattgttacactattccttttccaccacttatcctcccgtttgcaattaaaaagaataaaaagggaaaaacaattgcgagaagagaacagcataataataacatccacaccttcaattcccaatttttttctccatttcttgctaaaacagtagattttttttttaattttgtttgcctctcagaacctaacgatcttggccgcgcgcaccaccgggttgtccctggcgatggcgtccctcgccgccgacttgtagtcgtagctgcagccgtggcggtcggagtaccggtgctcgccgcagaacaggtggccgcaccggcaccggaacccggtgaggccgacacgcttccggcacctggagcaccggttcaccgccgacgtcttggcgaccggcgccggcgccgtcgcgagcgcggaggccatctcctccacaggcggtgggagaggagcctgaggctcaaccagcggcgccgccggcctcggcggctgcttgtcgagcaccggtgacgacaaagaagacggcgacgaggtggacgccgtggccgccaagaagcagttctggcagaggttctgcgtggccgggttgcccgggaatccgcagctgttggcgcacagcgtgatctccggcgccctgagctccgtcggctcctgatccttcttgtcgcgctgcgccatcgtcaataaccaaaaaagaatccccctcttggtctcaggctctctca

SEQ ID NO: 61049 - DNA, 5346 bp, Oryza sativa
gggttggcgcggcggcaacgcggccctcggtttcacgggtggattccgcagccaaaaaagcggtaaacggcgtgcacggccgttgggtcggtcgcctcgccttctcccacgggcgtagtactacggtagaatcgtcacggcggaacgtgacatgccgccactcatggctcgctgccggccacagttcggcgctgggagtggaggagctggatccagatgggtagccgtggctcactggctcctgtgaccgtgtactggatgagtagtacagtggagctatcgttccgcttatttcatgaataaacgaaatgacatatttacaaacgaaaaataatttataaataaaatttttatatatgtattcttaacgatctaaaaataaaagatgaaagataaattttaataaaaagacttaaaatcagttttaaatttaatattaaaaatttaaattttaagtataagtataaacgaaaaggtgaggccctaagcgtgtggagacgtgtgggtggaacggtctttttccccgtaagatatgttgtgtttttaggacacgggacccgggcaagtagccaagtagcccaccccgcggggaggagatatgctcgaccgaaagaggaggggagggggtggaaaacgggaaagcgaagaaccggggcaaagcggtaaaccaaaccatcggcaagccgcatcgccgtctcgggtcggctaagcaagctctcgttctagctgggaattggaagttggaacccgtcgtcgtcctcggcctctcgacccgtcgcgtggcgtggcgcggcgtgcccccgttcaccgcacgttctcgttctgccgatctgcctgacgccgcgatgagaaaaattaaggaaaagatcccccctttctgctgttgctgccgtggagctctcctcgcgtcgctttccgcccgctgagctgtctggattagcatggccattcctttccttccggccggccttcccccccccccccccccttcttcttttctccccctccctccctacgtagaccgtgcccatgtcactgtcacacatacgtacgtacacactcaaaagccaaattgcaatccgagaattgagaatactaaatcacggcctctctctctgtatatgatatatgcatcggctgtacgcatgtcgacatggagaaggacgattcgtggaccggttttggtccagctacgtacgcaatacattgccccgtacatacgcgccgcgcagccacgcgctgatggcgttttcatgtgaaatcacggcgtagtttgttgcccgattttacagggaaacttcacggcctcgctgagcttaactcgtcctgaattaacaaagtacaaggcggccaaccacgaggagacacgcgaaccggagcgcacgaagagaatccccggataagcggattccctttgccccagagaggacggaaaagacgccggaacagcacgcgcgacgccacgcgagagacggagcgaaccgaaactttccccacatgagtacattgacaattcggcaaccgatcgattgatcgatcacctcacccgatcgaatcgaattggggtaaaggagagcgaggaaaatatgccggaatgcgcgaaatatctctctgcccttggataggtagcagcaaaagcaggaatggatggatggatgatccgtcgggtactttggatagagcattggagctaacttgcagaggttggaagatgcatggtcgtgatcatatgatcaattgatcattcaggggaagcttaattgcgcacgctgccgacaacgggtcgaccggcagccggccggccggccgcccaatcgatcgaccggcaaccaactcgaccaatgatttgtcctgccgatatatatacacgtaattgttcggctaatcatgagctacgaacgaaccgggctgttgacgaacacatgttatatatacctacatcataattcgatgttaattgagcttaattcggtccctcaaaaataacctaagatgcttaatgcttaatccttcatggtttccattgaattagctgttccctggaaaattgaagtcggcgtggaataatatccatgatataaaggcatcgaaaggctggaccattgctcaaaaggatgaggtcgagtaccgctcaagtgactgacaggacaatgagctagtaccagaaaactagctgcaggtataacttttgaaagccgccttggctggctgtaccaatcctttaccggaagcacgacaaccaggaaaaccacatccaaccgaagatatcaacaggactgtatattactgccgcaacacgtcaccgtccgtcttgcgggcaacagagagcgtcagcgtcggtgtgtccgttccagtttgcggaccgacttgatatttcgattggctttggattgctatcccttgaccctagaatcacctttgccaagtgctcctttttcgctcataaagttccagttcaggatgatgctactagtggctttgcacttcaggagtttactacataattgtttgtggagtttagacgtggcgattgtgggtggatggccggcagctggtgtgatatcctccgtcgaacggcggcggctgtgatcgaacccggcggcgacgctgcgcttcacacgtgtgtgacgctcgccaccgcgtgtctcccggccactgagcacgagcgccagcccagcacgggacagttcagggtcgcacacgcgtcgagccgtcaaccttcgtttactcgctcccggggccgatgtccgcttccggacgacgccggtttgaccgcaccttccggcttccaggagagtcgtcgtgatgcccgcgtgcgcgttttgcagattgggccgcgtaggggacacgctgaaaactgggctgccttttttggtccaacgtgaaaggaaaaagtacatcgaaggtccctcaacttgtcaccgagataaaaaaacgtcctcgaaccataaaaccagatatcgaaggtcccttaacttaccaaaaccggtcacaagtagtcccagggcagtatttcacacggttttatcctacgtggcactggttttgtccaccgtggtgctttaaccttggtcttcgtcgctgagtcaccagcgccacgcgaagctggcgcctggcgggacggagtggggcggcggtgagcagacgcgcgggcggagtgacggcacccgaagccgacggggtggcggagccaagcggaggacgccagcctcgttgtcgtcatcttccgacatagggaggaggcgtgggagctggagccggaggaggggctccgctagaagccgctactgtagaaccaggagcacatgatcttgagctccagctccgacgccgcctcagccgcgtcagttttgccgcgcccccacgctgtgcgtcgacgccacctcgtcgtccatcatatcgaacattgatgcggccgcgataatcgccttggcgctccccgacagcgactcttccggggcggccctcctcttgccccctcatgtagccacaccgccccctgcggcggcctcgactcttgcgccgccgcttcatgactcactgcatgacgccagcagggagcctgacggtgacgaggagcaggatcgctgctcccttcctcctcctctctccctcttgtctggggagggcggccagtagcggtcgacttcgtcctcgaactcgccggcggcggcgagctgttctccctgccggcggagaaggatggagaaggcagtggagcggcaccgcccgggctgctgcttcccctgccgccgccgcccgcccgcgcgccgctccgctgcacgccgcctacacgctgctcctcccccgccgcttgcgctcgccggccgtcccccgtgcagctgcttccccgcccccgcgcgcgcccgcaaccacctccgccttcgccactaaagccgccatcgtcgtcgtctacttgtcttcatccaccccaaaatgtcgtcgcacctagacgggcaccgccgagtagccaccccttttccctcaggcgccgaccgccgcgccgcggcgatgcgccggtgttgatgaaaaacacgaggcctgggtcgttaatagccggccatcacccaatcggagccgatgccgccgctggcgccccctccaattggcgccccgtccttctcctcccggcgccactcccttccctccctcctccgcctggcgccacctcgattcctcccctctgcgccgtctcccggccgcgctgccaagccgccgcgcctcgcagcctctctcctcctgcgtgcaaccgcgccgccaccaggctccctctccttgccgccaagctctcccccttccacgctgccggcccctcttccccaccgccgccgcccatcacctgcgtcgctggcgcccttcctctgctgcgcgcgtgtgacgcgtgaggaggaaaaaaaaaggcagagagagagaacggcgaagtgaagaaacagagagaaagagacaaaataaaacaagaaagaacagaaaaaggaagtggaaccccccttgactcctccccgtgaaggaaaaagtacaccaaggaagagatgtgacgtggcagtctgacacgtggggtacatgctgactcagctgccacgtaggataaaaacgggctcaaaaccaccgaatgagttattgtaaccggttttggtaagttaaggaaccttgatatctggttttgcggttcgaggacgttttttatctcggtagcaagttgagggaccttcggtgtacttttccgaacgtgaaatgggtggtatcatgatgggctgttcaatctgtcgatatttatgggctgaattaggcttacaggcttagggcaagccgaatttcgtgggctattatggcagcttttctcgtgcacaaatatggatctttatttggcccaccgcgaccccacggcataacgaaacaggcagagcccctggaaagatttcagcaatacctgttcagacgacgacgtctgctctgttgttcgatttccgtccgcatattcgtcgtgtgatcgtgtccacgcctggagttttctggcacaggccgcgctcttctcacctcagcctcaggactcaggtgatcgtgtcaacgtccggagctctcaggcgatcgtgtctcacttcacaggttgacaggtcggcgcattcgatgccgttccaaacgcagaaaatttagagaaacatctcgggacagagcggcgctcccacgcgtggaatcccgcagatgtaaaacttcgttacaatttacagtgttcgcaacatcaagaaacgacattttttcattcgaaaatgctgcaaatctgcaactggcaatctctagacaaatcctttccctttcgatgccgaagcagaattgaagtttgagaatgtt

SEQ ID NO: 61050 - DNA, 13902 bp, Oryza sativa
gttcggcacccgccgcaccatgcccgccatccgcaccgccatctcccacgtccagaacctcatcaccggcgtcaccaagggctaccgctacaagatgcgcttcgtctacgctcacttccccatcaacgcctccatcaccaactccaacaccgccatcgagatcaggaacttcttgggcgagaagaaggtaagaaacccacctttggatcacttccatttgcccgctgttcgtggatcatcctagatctcccccacagatctctcaaatctgatgcgtctttctgtatgctttgtgtttcaggtgaggaaggttgacatgctcgagggggtgaccatcttgcggtcggagaaggtgaaggacgagctcgtcctcgacggcaacgacatcgagctcgtctctcgctcagcagccctcatcaaccaggtgaatgatacgatcccgtttcttctccctatagattggagatttcctggtcttctaatactgatatgatgcaatataacctaattagtcctgatctttgcatgtgttatgtactcatgttgccatggttgtaggaattagttctctttgctccaatgatatatctaggtttgtaattgtttaacaagtcatgcctgcctgcttgtttctgttgtttgctgcttaaggttatatgttgaaactgctaaggcggcatgatgttctatgtccttagtttgatcattggcagttgtgaatgtcattatttacagtgctctacttaggttttaataaccatttcaccatctgtctgttatgtcagtactgaagttacgttaacacatttgtgacgaacaaatccatttcttgaacaaccaagatcccttttgtagttgggctaattggcattgctaagttcttggtttggaaaccatgagtggtgtcggtgctcagggtacagtttgttatccactgtctgatccctatttgaatttggcgtctgcacaacaccatgattatacatcaaacctttttgccaatgtgatttatcttctatttttcggttcgtcgagcactcttttttccatgctttcagtgaaacaagatattttatcaattatcgtgtgttttgctcttgttgatttgtttgtgcccttgttgtgttgttgatcaaaattccctttgcttgtaaacagaaatgccacgtgaagaacaaggatatcaggaagttcttggatggtatctacgtgagcgacaagggtaccatcacagaggatgcgtaaactcctatcttcacctagtatcatgaagtgctgtttcttgtctcccgtgtctgatcatcctctgagttgcaattttctgagagactgaattttgtaatggtgggttatttaggatgtaatggagcatggtatcttatcctacatattgtttctgtttgcgattatgaagtctatttatcatcccctaaagacagtttactggaagcattcgtggttagataaacagcataatgctacttaaaagtgtgagctggtatgttttcccctgcgtatgatggattgcaaactggaggagtgtttttcccctgcccttccactgttactggaagcagcggttagtttcgagacattggcttatctggacatagaggattccattgttagcatcatggatgcatgtgtgatttagagctgcaattcatttgattaccacactccgcactactgatctgacactgacgtacagaatcaacattgcgaatgctttttggggacttcctctcacattctcgctgtagagagtgcgtctagtagagggtgaaaccgtcgctgtacttaagagagagtgcgtctagtagagggtgaaaccgtcgtcgtaggagacgtggcgtccgcggcggcagggcggcgcgccctcgtcgcgctcctggcagcagctccacctccccttccagttgtctctcccggtgtttgggcgactccccctgtcgttccacctgtacacgatcaccccgctcttgtcgctccattcgccgtcgatcccctggtgcggcggcgacagcgagaacaaccccttctcccctgcaaacccgtcaaaagatagattcaagtcttatttaacagtaactagctgggtggtccgtgcaattgcgcggctagcacccaaacaaaatcatatatttttttaagtatgattttacttaaaatttattaaatagctatctcattgtcttaagattttgaaagatcaaactttatcatctccgtgtttctaattatataatttttaaaagtcacactagttgctacttcttatgtcatctccttctttatttgcttgtccgatctaccacaatttctattcattctccttggaacctttaaaaattggatcttatatttttttagagtttattgtcattttgggtttcgtttttataatttctagatgtcccgtcaaacgttgccattatactcctctacggcccgtccactgtcttctctttattgccattgagattttaaaaatcgaacataattatcgtttgggttcatttttactttctagaagtcccgccaaaccatcagcggctttgctattttactcctctaccactcggccgctgcctccctttttttttgtcattgagattttaaaatcaaacatgattatcattggtttttttttactttttaagaagttccgaacctttaaaaattggaccttatagtttttagagtttattatctggttgggtttcattttttataatttttagaagtcccatcaaacgatgtcactatgctcctctacggcccgtccgccgcctactatttattgtcattgtgattctaaaattcgaacataactatcgttggaattcattttttattttctagaagtcttgtcaaccgtcggtggctctacaactatactcctatacaccccgcccgctgcttctcctttttattgtcattgagattttaaaaatcgaatattattatcaatggggtttattttttttactttctagaagtcccggcaatcgccttgctcgtttgcttcacggcctacatgtcgtccctccttttaatcatcattaggattatatttggtgttttattaacagtttttatatgtcgtatcaatcgtcaccactctactcttttataggtctgttacttaatttatcttgtcatgtgttttagatggttttttctttcaatagtctttattttatcccaaattttagttatttataaactgtattcataattgaaatcttatttttctttttctaatttgagaatttattttttccaaattttaattaataccatattgtgttattttaatattcttattttttattttcaattttagttgtttcaaaattgtattccgaactctctgttagtttttctaattttggatattattttattttttattctgaattttaattaatgtcgtattgggttcttatatcatccttctttcaatattgcttatttttaattccgaatttcagctaattttaaattgtatttctacttgaactctttttttttctaatttcagattttatttttattttaattccgaattttaattaatctcgttttgagttcttatatgaactcttcttttaatattccttatttttaattccgtattttagctatttttaaattgcattcctacttggattatccttttcttttctaatttttgtttttattttgaattttgactaatctcgtattgggttcttatatggaaacttctttcaatattgcttatttttaattccgaatttcagctatttctaaattgtatttctacttggactcttcttttcttttctaattttagattttattttatttttattttgattttttattaatctcatattgggttcttatttggaaacttctttcaatattgcttatttttaattccgaatttcagatatttttaaattgtatttctacttggactctacttttcgttttcttcttttttctccgattaatgtggaaatttctaacccccacggcaaacgtggtgcctcctttcaaaactgttttaataatataatagatacttatatttacagctaattattatttcagtgctatataatgtatatttatataaggtcatttcgttaatttcaaaatacgtcgatctaatcatttgaagatgcttataagtgttaaaatgttgtgggcgtctatccaaaatgtcgacacacttcacactacactagcccaagatagccacgaaccggagaaagaagaagatatttatcgcgaggttggctacctgtgacgtggccgtggaaggcgcagtcggtgggggagttgtcctcgtcgagatacaggctcccgcaccgcaggcatcgcttcctatccttctcctcgctccgactgccctgctccaccgcagccgctgctgccgcggccgcgccgtcgcctggagacgcgccgatccgcgccgtcgcaggccgacacggcggtgccgcggcgttccggtggcgagacggcccgcgcggcggcagtaccggcaccgtgcgggttggtgcgagagctgggctcgccgccatggcgtgatgaggcgacgggattggcatcttgtgctaatggagctcgcactccacacgcacacacagacattcccgctgagaattgctgcctcttttcaggttgtggcttgggggtaatgggccaaatacaaacggcccaaactacactggacgacgtagtagtgatgcaggggaagagatctggcccaaattgaaactagcgatgtgagtagtgccgtacccgtactgccatgtctctctccacgccaaggacggcaggacgccaggaccaggagagtacaagcaacttccttgtgatttttgaaccaaccctaataatctccacgttttttctagtagtacagtacataggtagtacttacagtcagtcgttgacgtgctaataacggtggctgtcacgcagtgtcatcatggtcctcatcacgcagtggaggtggtccaaacatgtatcataagcatcattcagaaaactctgaagaaactgcgattagttacagctcgccgacgacgacgggcgagcttccgtcggtccgaccggccgcggtcgcagagcagagcagggagggaagctgctgacttcgccgcgctgcgtcgcgttcggttcttgccagccttcccaagtgggttcctgtcagctttttcctcgcggcctctgagcctctctctcggtcatcatccttcagctcctgcggctttgctgactggagttgctccaactgtttgtttacagttttgactcttggtctccacatttacatcggcggctagaacacgcacatttcactctctcaaagaacttttcaccctatcacattaaatgtttatacacatacatggagtattaaatatagataaaaaactactccctctggtcctatattaattgacgttttggacaaggttgaggttaaacttttataactttaaccatcaataactttaaaaatatttagtttagaaaaacatatatagatttgtctttcaaaacactataataaaagtaaacatgtatttatttattgtatatattataatagaaaaataaggtcaaaggtatattttgtagagcgtgtaattgtccaaagcgtcaattaaaatgaaactggagtgagtaattacacagattacgtgtaaatgcgagacgaatcttttaagcctaattgctccatgatttaacaatgtggtgctacagtaaacatttgctaatgacggtttaagtaggtttaataaattcgtctcgcagtttataggcagaatctgtaatttgtttggtattagtctacgtttaatacttcaaatgtgtgtccgtatatccgatgtgacacaccaaaacatttcgtctcgcgaactaaggccctatttacttccaggggtgaaaagttttggcgtgccatagtgattaaagaaccaaactctgaactcgtagcacctgacatctttgtggcctcaaaatagaagaacagaactgtggcgaatgcactataccaaaacatttgggtcagggatctgaacacactaggctgcgtttgataggatgggttgggaatccatcccctccgcacgaaaaacggagcagtccattagtgcgtgattaattaagtattagctaattttttttaaaaaaatggattaatttgatttttttaaagcaactttcgtaatttttttttgtaaaaacacaccgtttaacagtttgaaaaccgtgcgcgcgaaagaaagtgagagaggttgggaaccttgaggttcgaaagcagcctaaagataaccacggaggaccatctgtgacaattcatcaatctttggacgaaaattcagaatatagaccctcatcgtttgggtgctattatgcgagcagaacactagaatctttcgacacatcgccatccccaacctccgtgattgcaaaatcaaataggaggctggggcttgggtcaaagtaggagcgtccaagttctaagagtttctatttggggggagattacgtactttgacctttttaagtcgggcgaggactttcacacgtcgatgtacatactttaattttgtttactccctcactatggggtggttggaagagaggggctaaactttagcccctctctcaaaaatataagtctctaggagatggacttatatttttgagagagttagatttatttgttcaaagaaaagacgcctaaaaatcattcagggctcttggtatcctttaccacattcactttccatattccctttctttagttcagacgctatcatacctcagggaaaaaaattttctatcaacgattcccacccaactctaaaatgactctcccctctctcccttaacatatcgaaggcctcttatacgtcaactagaccttaatagctcagacttccgagccttgctggatgatgcagaagggccaacataagaggatcaaatagagcgacagtccagattcagggttacttgtccacaccaactaatcaggtatcggaaaatagggcatatttgtttcagccgggagaccccctgggggtctagttttaaggcgattaggcctattgagatgcacatactaccttctttcatcttatcaccccgcctagcgactttgcaagcattacaggctaggcaccgccgaaggtagtccagtccgcttgttagattgaattgaatcttatataacctacgtagctaaagagaaaatcataatagtctaagtggacctctcaaaggtataaataagtatacattagtcttactggttcgatctttttctttttttgttatgatgcccacatttcatacttctcaattcttatttattcaagggttcgtatgtactgagtttagggtttagcccctctcttccaaacaccccctatatatacaagatgtagcttttgccttcttaaaaaaatttagatcaggaagaaggtgaaagagaggagaaaactaatgaagtgacatgtcggactcgccctcaccttttattttctcaaaagatcctcttttttaatgattggagtcatataggccaaattaggccggttcgagcaagggatataacttaaacagtttgaaaagttaaagaggcacaatatatgatttgcatatttaagattgatgttagtgttccatggaattttagggtgccgttttacacatgcagttgattttgcttattttgttcctacaaaaatattttctacctgtgaattttgcatagcgtagctggttagatttcatttcgtgaaacatataaactatggttgaaatcttagatttagcatgggtacccgcatttatggctaatttttccaggtgtaggtgatgtatatgtcaacagcaaggtgctcgtgatgatttcatcaatcgcaaggtacatatcgattgtggagtgcttgtagtgtcttcgtaagccttaaggtatatgtcgacagcgaaacgttggtggtgacttcatcaatcccaagatatattggttgctcatagagaaaagatgtgtatgtattcacaaggtcaactgtgtgcgcgtgtttataagcatttgtgtatgtaatgtgtttcaaaaatatatattcccttattcccaaaacaagcacaactatgagtttctgtgtcccaactttaattgttcgtcttatttattttttttaaaaaaaactaaaaaatataagtcacgcataaagtaatattcgtgttttataatctaataactataaaaatactaaacatgaaaaaatttcaaacaagatggacgattaaggttggacaccgaaatttatggttgcgcttattttgcaatagatcgagtataaaatagccagctctacgttttttctttaaaaaaaaagaaagatgttttttgtgttgaaggaaaattactgggcgcgggagggccggcctggtcagccagccaggccagcggtagcggtaggttgtactttggggcaccggcatatccaacttttcaggacaaagactgaagctgctgctggtgttgattagactttgcatagcagggcaataatttccatatctcccaaagttcctccccacgaattattcaggcagctaccgatacacattttggcagggcgcgaaaaagacaccaatgtacttcagtacttgcagccaacgcagtactccgtctgtggccagtggccagcgcgcgtgtgtgtgcatgcgcaacgcaagagagcgtcgcattgattgtgtgtttctgcgtggcagatggtactacaaggggtacgtggagtccgggtcacgttgctggcctgcccggtccggccggtctcccccacctgcaaaattctcacacacgcgtgcccgttgaggtgacccgtcctccagcagctaccgcgcgccgcgccgatcgactgctccccctctcgtctcgtcctgctttcgcacgccggatcaaacgcaagctagcttcccatggtattcggtgttgttttgcccgaaaagcaatctatttacacctgcaaactgcatatatgaaacgcatgagtttgtggtaacgagggccgggtaagattgacaaaaaaaaaaaaaaaggggaggatatgcatgcagtgcccgtgaagtgcacgttacaccaaccctccatctatcgatccgtcgtctagatgaagctaaggccctgttttgggttgaaagttttgagaagtactacctccgtttcaaaataagtgtagccgtggatatccgtacccaacgtttgaccgtctgtcttatttgaaaaaaatatgaaaaaattaaaaatatttagttacacataaagtattatttatgttttatcatctaatagcaataaaaatacgaatcataaaaatttttcaaataagacgaatggtcaaacgttgaacgtgaataatgtaaaactacacttattttaagacggagggagtaagtcaaaatcaattggcaaggggccgacgattatgagaattaagaaagttggttttttagcaccgggcctagcaaaagagaaatcgccatatactagccattatttagatatgggtggagcccaagaatatcggagagggtctaacaccctactattcagtttataattacctaattagttagatggtcctattataaaaaaagaaattatttgagggagctttgactccatccattccccccttgtctccgccatcgcttggtgagtcatcagctagtgggagtatgtcaaaactagatttcccaacttcttgctgctagctgggttcattctgaatcctatagctattgattcacatagtctagatgagtatatggaccacttccctcggttccaaaatgtaaaaatttttaggtttaaacaaatgagcaattttattgtacttgagagataccatggggtaccaaagatttagtgtaaaatttggtatatcatagtacttaggtatcacgaggtatcaaatttacaattgaaaaggcagtacctcatggtatcttctcaagtaccgtaaaattgttcttacacaaatactaaggttaggtcaaaagattccatgtaaataacttcagttgtcaattttgaattgcttagtttttatttcaagcatttcattgtcttaggaatcatcaatagaatgatatgaatcttgggaataagtgcatgaatccttataatattatgatgtaaaatttgaatcatagaaatacttactctctccatcccaaaataaatcaacttttatacgagaatatacatagactatatccagattaatgtataaaattttatattttatagggcagagggtttatattttaaattggatggagcatttagaagaggtggtgattctataagaagctgtaaccattggaagctagaattaagggcatggtcgtttcaacaactcaggtgagatttttcatggcatgaaaaagaaaatcattaacgagtaattaattgactattaattatataaacttagaaattgattgatctttttaagaaacttttacatataaagttttattttacgaaatgtaccttaaaatagtttgataagtatatccacaaagaattaacgagggagttgcttgcccgagttgcagaaacgaacggaaccccaggcagcacaactcgtaagataggcaatcgcatacagtgtgtcgtcccggcctgctctggcagaagagcaacttcctccatgcctgactagcggcaataataatattccaggtccccccattgattccctctcatgtatctttccctttcaatccaagagatgcatgagaaaagctcatcatttgacatgaacatctcatggtatttgtgtgtgcagcagcagcagcaggtagcaagcatgtacatctgatgttccatccatccatcaaccttgcctagacatacttttgtcggccattccgtggtgagccttcaagtgcgcccaaaaagttgatctccatctacacacatatcctctcctcgtgaaaagaagatccccaagctatttgttctctctcacttacacacagtgacacacacatactactcatctctgtgctttgtttccctctctctctctctcttgtttcttttacagtacatgcaatgcacaggtaggtcacagctccatccaattgtaggataggagtatataaatgtttgggcaaggaaacatctttgtttttggaagtatctccagctacaataccccattgctcccttttttcccttttctagggcaaacaaacaactggacatgtctctcacagcctttctgcaggggaggttcggatgcttgcacaggaaagaacacatagcaacagtagaagcttgaccgatacagggttgggaggttattgttttccagatgtagacgaagagatggtgataaaattggccccatcccaaacgcatagcgttagctctagcaaaacctggcgttgtttgaaccgacaggttcagttgaaattaaaaaagagagctatatggcaaaattatccactcctagcttgaatttgctgccacgagttaattaatactagtactagctggtatctaaaatctcaaaaatcttgggggaggatccatttattaattcttttttttcctagaaacccctttaggactcatttgcaatgtaaacattttctagggttttgataggatgctagctcaatttcctctagctagtacaaatccattagtattccttcattttcaaaagaaggccatgagtttttaattaatgggcgaagataacaaaattccaaatcttacaacacaatgctaaaattgaaaaaaaaaacaattccatagagaggacctagcaagaaaaactaaccccactcattaccatgcgcaacttttttccctccactcacccgaatcctcattttcccttctctcccttcgtttgccctgtctccccttgtgatacttcacaattgttgcctgcaagtaattaacatcctccctcatgacgcaccatatctcctaggcaaaatttgccacaggacatgcaaaaaaaacgtgtaattggctaagagacaccgtgaaaacatgacacggctgatggacagtaaaaaaacatgtaattggctgtaggacaccggtcacattttttttattatttccaggtcaaaagaggtgagatatttttctaaatgcctgacttgccccttctctttccttctttaaacaccggtgggtcccatgtgtcatggacagtgtatgtttaatctaatttttaataggtttttaaccatcaggccccacgcgtcatggactaatttgttcctaattagtagggtgattactatttactaaccataagtggggcccacatctctctcctatcctccttcttcctcacgcacgcggcggagcagaggaacagcagcctgagctgggacggctcggtacgcggcggaaaaagcggcggcgctccgccggggtatcactgccggcgacggcgaggaccaacgccgggatctcctcattcagcgaggaccaacgccatggcgacgagcagcgccgggatctcctcgttcagtgaggaccaacatcgacggtgacgaccaacggccagcctcacctccatcctcatggtgcagtagctgtccacggacatccagggtctggacggcctcatcgccagctctgaccccatcggcttccaggtcggctccttcgccaagagctacctcatgcaggagctgggcgtgcctgagtcccgcctccgggagctcgccatcaccgactactcctccagcctgcagagcggcgtcgtggcggccatcgtcgacgagctgccatacgtggagctcttcctctccatcaactgccagttcaggacagtggggcaggagttcacaaagagcggatggggattcgtgagttcttttccttgttggcttcttttcttcttctttttatcctacactacaaccaagtactacatatgcaggctttccagcgcgactcccctctggccgtggacctttcgacggctgccgaggaggaggaggctagagagcgaggtaggtgcggaggcaatccgatccgatgaattggcggcggcggtgctccatggcagggacaatctcgccatttgaaaaatattatcacctcttttgatctggaaaatataaaatattgtctccggtgtcctatagccaattacacaatttttagagtgtcaatcagccgtgtcacgtttttacggtgcctcttagccaattacacgttttttacatgtcctgtagaaaattttgcctatctcctatttgaccgatgtcatccgccactcctcgactgctcttatgacgtttgctttggtaccttttcatctactctagtttgatatctatgacggtttgtgcgctttcgacctgtgttaccgctcattagtttccatctcaagcacatcatcaagggccactttccatgcatgtccaggtgatggtacattcttggtggttgcttttgtccagacataaaatgccaatgagaacactgttttggcaaacacatggaacccacataaacacacatgccacatgtatacacattagctagtgacatgagccatgtccccttaaggccttaactaacaccctcaaggtctcaacagacaatgtccatgaacaaatccactaatctcataaaatttctcaattgtactatatcacatatttataaacgtgagcacccaggacctgcccgtatataccaaatacgtgttttgcttatggtagtatatggaaacaacatgcaaatgaaaaacagtatgtacaagcttgagccaaactctgtacaaacatttcgtctgaatgtgtatagtatatatgatggac

SEQ ID NO: 61051 - DNA, 764 bp, Oryza sativa
tgaaatgaacagcagcagtaacagtacaagtctgcatgttcacatggaaaccaccattgcctgaacccagcctgcaaatccagcataccaacattccaaccacaaccttgcctttggggtcttaattaattaccggtgtccgtacatatacacggagtattttcaggattgtgtgggtgttttcttaacttagggcgtatatagtagtatgtacaatgtttatttgatagagtatatacgtaatacagtaatatgatgagttcaatatgataatatgcagatgcatatgtgggggcatgggtcgcagtacaggaaggggccggagtcgctgcgggggatacagccgacggcgatgctgcggctgccgtgctactgctgcgcggcgggctgccggaacaacatcgaccacccgcgggcgaagccgctcaaggacttcaggacgctgcagacgcactacaagcggaagcacgggctgaagccgttcctgtgccgcaagtgcggcaaggcgttcgccgtcaagggcgactggcgcacccactagaattactgcggcaagctctggtactgcctttgcggctccgagttcaagcacaagcggtccctcaaggaccacgcccgcgccttcggacacggccacggcgcgctcggcggcaccgccgccctcgactacgacgacgacggcgccgtctccgacctcgaccatgactcctcctccaccgcccccgccgcccgatccctctaacgcaaagacctgcttcggtcca

SEQ ID NO: 61052 - DNA, 12138 bp, Oryza sativa
ctccgtttcaaactagatggctttgaaaataggtcgccagtttcaaaatatagctatctcattgaatggattttttttttcgaatggaaaaaaaatagctatctctgtagttcaaattatatggctttggaaataggaccttcatactttgtcgttcattaaaaatatggtgtgcgtgtatgtgttcatatggatgaatgtacacgtgttatgagcgattacgtttatactgtgtttctaaaaaaaattgactttggaataggagcttcatgcttcatcgttcattggtctgacagatcgagcaaaagaacaaattaatgttcagagaaagaaaagacgggattcatgttcttaagctagctagcccggctatggagtggcaagacacacttgataatcgagatttactagtgtacgataattccaagatcagctgcatgttgtgtgggacgttttttgtcaagaatttctcagataatatgtaggtttagcagctagcagagtatctataatgcaaagagaggttggtgaatatatggatatttttacatagatacatatgtatatcacttaattaatcactgtaaacagataactcttaagtaattaattaggttcaggctttcttcttaccaatcctaataaaattcggtcggcctaattctttcagtcaacccggcaaaaataaaattcagttttttgtttttatataaaggtagtgcaggttttcgttcgcatgctgatcgaggctgagtaactagctaagtataagaagcatacgttaatgggatcaagaggtatatatagaacgagtgagacgcattgtcaaacattattccgacaaaagaactagcaagtaattacacccagctagatatgcagcgttcgttcaagagccataaagctttcctgaactactactgtagaaatttttcatagccagatcttagaaagaaaaggtaaaaattgcgtcgcctactgtcggtatcatttatttgttaggtgattgcaattaggatatgcttgaaagaaaaaaaaattagttctagctagatcggatttattctagcctaagaaaagggatttatcaatctactgaagaagacatatgctttgtcataccatgacgacaaaaacgggggaagacgaacaagaggaccactagtggtacagtttggggatcacgcatgatgctatgtctaattctaagtaaattaatcacttattagtcttgaattgcgacaaaactgaacagcaataacccacaaagaatcgcaaaaaagaataaaattaaatggagcagcgataatctagagcaagcaagaacagtagcagctagcagaattaagctgtgaagagaaatgaagaaattgctggctgacctgcatgttgttgtatcggttgaaggttttgaagcagacggggcaggagaactgcgtggggccgatgaggatctgcgacggcgtcgggatccagtactggcccttgttcagacgcccgatcggcgtcgacgcgaaccctagcggcgccgcggcgtcggcggcgtcgccgccgtcgccgtcgtccctgctcgcgccgccggcttcctccgcctcgtcctcttcctcgtcacgacgcgcggtggaggatcttctcccggctgctgacgagagccccgagatgaggtcggcggcggcggtcgggctcggcaggccgatgtgcagcgcgaccgtgacgtccgcgtcgtcgtcccccgccgcggcggcttcggcggcgcagcagccggagccggagccctccacgtccatcgggtctcccgccgcagccttggtgttcaggtcggcgaagagccgccccgcgcggcgacgacggagctggtggtgtctatcgccgcctccaccgccgccgccgccgggcgtcgagcccggcacgtcctcctcgtccgccccctcctcctccgcgccgtcgtcgtcgtcggtgcagtcctcctccccccgctgccgcgcacgctcttgcgccgccgtcgtgccgccgcgcgaggcgggggtgagggacagtagcggcaaggcctcccggagcggaggcgacggcggggcagtcgtcgtcggcggcgtcgcggccgtcgtcgacgtcacccccgccgtcggaaagaacgggaaggaggaggaggagtaagcgccagccggcgacggcgacggcgacggcggggtggagaagcagtagcggcggtggtgattcttgaggaagctcgcgtagtaggggttctccatggctggcaaggtagcttgcgcctcttgctatggagagatcgacacagctcgtgtgcgtgtgtggtggcgtgggcgtggtagttggcgaggggttattatagggcgtgtgagtgtgagagggaaggcccccgaaggggattgggaatgagtatatttactatttactgtggaggttaattagctaatgtgtgcatggaggacgtggtacgtacgtacgatgtaccgggagataactcttgttttttcggattactaagatggacgcacgcgcgcgcacaccattatacactctccaagagtcggaaaccaacagcgcatctctgatctcagtaaaaacttgttggaagcccaactgcatgtgcatagttttcttggacatcacgatttaaaccctggtgggtgaaatcatgtgcatacgacttcaacaccagattttctacttcagcaccgcaccagtggtgcttcccctcttggtttttttttctttctcgtaaggagggacatgttctttctgcagagtaaggcttcacaagctcgatgaattttgatcggatttcgggaatttggatcatctcgagttatcatgtttggagtttatggaaattcattcgaaatgtgtcgatttttctagattggcgaaaaatcgatgtctcactgggctcgaatttcactggccaatcaataccttgtgactttatcacttaaattttgtattttatatattcattaaaaggttcatgaatagaatcaaaatatagataagaaatatatgccctctttagggggcttctagcagccatagatactccgagaatctcggctagctccccaaacaatccaaatgtttactcaagattgtgacacttagtaaagctaaaaatccaggaattaattagtgctataagctaggggattatatatacttctctatattctcaccagctcgccagatatattataagaaatgttctttttatgggaaaaaaagatttgtagtcaaatttccattgatcgattcatttttccatatgtccttatttgaaattaacgaaaacccatttattgtgtgtgcccatagttacaagctagtgatggtacatgtactattattatgtgtttggtttataaaattttgatggagaaatcttgtccagatgggttttctttctttcggcccggtactgttgttccttatatatacacattattagcattttgttataggtcaatttgttttgtccggggccacaattcacggattattgatgctgctatttaaagatgagcaatagcttgtgtcaaaagacaactaagaacatcatcaccggtcttgaccaaactacaaacgtgcaactttacgagttcttacattaatttccgaaatattgtaataatggaaaaaagatgttttctgaatcggttaaaaaatgaataaaattaactaaattcaggatgtatgaagcacctagaatatgaatatatatggaatgagggatcctaaaggacaaatataggaatcgagacgagagatccgaggatgatatgggagcctagagaacaaatatatatataggacccaagaggataaatatatatggcactttagaagaaaactaagaggacaaatatgggactttaaagggaaggctcaagggatgaataagaaaatccggaggaagattctaagggcgcaaggccttgttagtagggaaaaatttttgggtttggttgtcacatcgaacatacggacacacatttgaagtattaaacgcagtctaataacaaaacaaattacatattccgccaggaaactacgagacaaatttattaagcctaattaattcgtcattagcaaatgtttactgtagcaccacattatcaaatcatggcgcaattaggcttaaaagattcgtctcgcaatttacacgcaaactgtgtaattgtttttttttgtccacgtataatactccatgcatgtgtccaaacattcgatgtaatgggtgaaaaattttgttttgggaactaaacaaccccctatatgaatgtggctacaaaataacacggatattaattcttacaaattttttttcgatatgcatctttggagcaaaacttttattacatatgtacacttgtcatataaattgaatatatagcaaaattataatctataaaatatttttgtagaggaagattcgcatatactgttcttgaatgactaatctaaacatttaaaatatcccatagtaaaaatgtcaccacatcacattttctgtacattagctatgttttagtgtggaatttgcgcttgtcgttccgaaatgatcacaactttgccctttcgagggaaggtgttgggttcctgtccatcgattcagctagtatcttcttaatggcaacatattcaattttgcttgcttgaaattatgaaatgttatatagcatataattataattaccgtttcaagtaccaaatgttgagaggctgatttaaatattctttccgaacttcaaaactttggatattacaatgcgaaactgccctatataaacacatagtatattgtaagaatatgaaaagggtgtaaaatgtgacatcaatatagtatttgtattttttggagaatccattttgctattgttaattagagtctagacgtcataacactcggtgagaaaaaaaccgaagtatatattgatgccttagacctcttcttgatggcattttccaagtaattgatttcatttactatataaacataatgtaaattctccttttatttttaacatggctcttgatgcagttactagtacttatgttcttaagaggatgatttggttggacattgacacagtctccaatacattttatcattactatatcaaactatataattataaaagataaattatgaaagagtttttcatgacacaagtatgtcaacatttttcatattttgaatcatgatacctttgaattaatctattaataacttaagattttgaggtttgactgcacatattttaggacgtttctaagaacaggacatatataagtaataaacagggaaatatatatatacaaataatgtaaattctccttttgtttttaacatcgcggtgggagatacctgctaattgagggagctgagagtaacctgatcccgcttataaaaagagctagctagactaaaaacaaattaacaattgttagcatgattaaccggcagaatttaaaacattattctcgatggaaatttatttaccttaattaatttggctacggtacgtagagatgtagagagaacatgtagcaagattttagctacggagaatgaatcagcaagggaccaacactgaattaatgtgggtttccgtcttttcgccatctgaaagcaaacggggaggtgggttttaaaccggggcccattggtgaatggtgttggtagtaaaaaaatggtggaggggaatgtttggcactttcgcgggcggcaccccagaaatcattggattataaggcacatgcagggatagtgttttttgcttacaaattgagaaaaaataatggaaattaatctttttggccatcaagttgtacaattccaacctgatcgtagacattctttggtacctaagtaggagtaagatatatttacaaaaaaaaactatattccttacgattacacaaccaacactcttaattccaacatgcattgagggcaggtcattactccattttattaagataatgaaaatggactataatgctatgacagattactacatatacatcgcttaaacaaattatagactaacaattcacctattaaagttattcggtggtggtctttattaataggttttctttctctcatccttagcttggagagaggtatatatttccttatatttgatatttacctctttgtgaaaggaggtatcataattaatcttatagattggagttaggataagattgaaacctcatatttatatactcactccgtttcaaaatgaagctatttctaccactcgatctttgattaagctatttcttcacctatctccttctctcaaccgatcacaatcattctctattcaattttttctactttctcttatcatctaatcttaacattccccaaattatttccacctactttcttaataatcgtatctagaattgcttaattgttttagacaaaggcagtatgtttttaatgttttcttctgtttttgagaggtatactacgagtatttgtgttattcatgagaaatataccttcggggtaaagttatataacactgactaggctgtgttcttttggagggattgggaacccttcccctccacacgcaaaacggaacgatagatcaacacatgattaattaagtattaactaataaaaacttgaaaatggattaatatgatttttttaaacaactttcctataaaaactttttgcaaaacacgcaccgtttagtaatttaaaaagcgttcgcgtggaaaacaagggagatgagttgggaactcaagggaatgaactcagcctaagagcaggtgcaatagcagactataagcctgctataaacacatttcgaggaaataagggaggagagataagggctacagatttgtagccagctgcagcacggactctaagatacatgtgtgtattggtgggacaaactataaatcatgtaatatatgtttataggtaactattatattaatcggctattaaattgactatagataatttggagctagtagttggctatactattaaacttgctctaacactggtttatctatacctctttatacctctcggaacaataattaaagtctcgtcattgtcaattgtagacttgtcttataattagttcaaccagtttatattttttttaccctcttaaacaataagatggttgcaccgttgcactacagatttcatttatatatagcctaattacctctgcccaattgtctgtaagatccagaatcatatatgattggccttttctggccacaactatgcatacatttaacacctgaaaagaagaataaatttaaaggccattattaattacacgtggaataggatatattcaaaccagcattcaaggagcgaacagtattactatagatataggcggccttaccagcaagttactgttcaattagctagtggcccgtgcaattcctgtagatgatcgatgtgagattgcgagtgagtgctaatcccaagccagtcaataaatcggggagcatggacagatccagtaccattcatgttcaataattatacatgcattgattggaaattagaggaattaatcttaattattgttcaggctaacctgaactcaattaattagcatagctaactattgagcagtacaataatactaataacaaaagatgctcacttggaaacttgccagtatatagaacaaacagaaacttgatagaactaatatagttaattaatgaaataatttcaaattaatcgggaaaaatcattagctcaagagtcaaaacctagttgttgctgaggaccaccactgattatattgactagtcaacccattccgtgttagtcttcctctagaaatagctccattaatatattacacttgccatacaatgttattattattgttacatttcaaatatacaaatatgttccatcctaaatataaggcacaacaattattaattatttatctagatcactctagtaaatacaatccaggtacccaatgggcttagagattttaagggtgccgaatttaaaaaataaaataaaaggagggagatgttctagctaattgcatgcatgcaatgcgccccttgtaatgaaaatggttacactttttattttaggatggagtagtattgtgtaagcgtacatagtattacctccctcccgaaataattgtattataaaaaaatagatatattagtacatataaataaccacagtaaccctacatgcatataataaaaaaaaaggtcgaggcagatgcgaatggaaagatgagaaggtagaaggcgggatacctccatctaaccaattggacgtgtttcaacttattataaatatatatttttagacagaattaatttgatagttaattacagatctactgtattaggatggacataattgcgccttgtatgactcgtccagttaattcgaatagctgtatataaacagctcacaaagacttaaatacattgtccacgcgattagctatctgtcatatagtatagtggtttctcatattctgccataatgaagtaacttattgcatgcatgtactttatagccaccctgcttgaacatttgatcatcgagatcacaagcaaataattggttaagagattattattgcattgggctatataattaagaagctatagacagatcgaattgtcggggaaggagcattgaaacccggtgcccacacacagtgtgtgcataggtggcctagctcgacggctagccgtctactgttccaattaattaggcagctggtgcgatctctgtacatagccggtggggatttaagaggtaattgatctgatccatgcagctagcctgaggaaacacatgcgtcttaatacatttgtgtgccgggtccactggaccaaaacgagatgccgccgtgtgttatcaattgggtttgggcattcattcatacgctatgcacacattgcaccacctgcgactgcgacctcttcgaattttgccggtatatatgttttttcttcaatttttgagaaggaaaaagtccaggagaaggtggttatattgctctgagtaattttcttgagcttttatcaacctaaaattgtagtgctccctctataggttctggacaacatcagctgtattttctttgttagcctagcgacggctagttcagtgctaaccttctcctaggtatttgcgttggtgttgtttgtgtttttttttggggggggggggggggtgggtgggttattttttcttcgtttttctggttgcgaccttctaaggttgtaatcgtgtaattttttttcctgctctatcaatataaactttacaatgtctggtttgagtcgttcaaaaaaaattgtagcgctccctgtagccaaatatttttgatatggagagaactaaattctattctcccaacgttaaataaattagcccagaagtagctagaactgctgtatggccaacaagataagttttagtagtaattagagcccaccgatgggcgatggtctgtatcgcagtgacttaaaaacgatatggagccactaaatttctgacagacaacatgtttgtaaagaaggaattgttgtgggttgataggtcgccaaacagttatagtgatatatagtttgtcagtataatagattttctctgaccaatgacatatggtaattcttggtcatggtgtagtgtttgaactctgtatttgtacggtcttacataatttgtattagcaatagggttattatcacttttcttatgtagtactattatggagtacgtcctattccacaaacataattattagctaccctcttcttcaaaaagttgaaatgagacagtctgccttaagtatatatatttattttgatttaagcatggcatccaatgggcatgctccatgcaatgcattaggtttgagaggtagaagatcccagcagacagagtgggttcaaggtataagcaataaaggacccaacagtggtggcattgaattggaaatagtggccagagaacaaggggtgtggtggtgtgatgcgtacaatagtaatgtggttgcacggtagggcaaatgggtgtgtgcatttaatcaaaggacatggaaaaggagaggggagaccatcgatcacaatccccttccccggccgtcgcgatccaggcaaatttcttctccgtttctctccggccttttctccctttttttctgcatggtagctaccaatacctgcctgcaaatcggtttctcatgtgaattgaatcaattggattatcatcggttgccctagccttgagggttatctggaggtttgtgctttgcactagccaggcatgccgatatatacaaatcttgtcggtgttgagacagcttcatatatggtctaactgtagaattcgctggcatgcatgcagggagatgatatttttagggttaatttggtgatggccgactagatagaaatcgacgtatttgacgtgacatgtagtctaaggcttcattcgcgtgtgtggtttggttgaaatttttggtgacacgcaaaatgagaaaggacattgttgtatgattaattaagtgttcactgttataaacttgaaaatagatttattttttaaaaaacagtttttacataaaagttttttttacccaaaatatgttatttaatagtttaggaattagctagcgcactcacaataaacaagaaaaaaaatgagaaagtaatccagccaggaagtttagaatccggccttagctagctagaatgaacatatcacgaacgagttcaggggcaaaacgccacatcaagcacgtaaaacatgcttccttgcaagttgcaacattccaagaggataaaaaaactcgtttaatttactgcatgtgccagaattggaggatgggaaattgaccccttttaagctagtagccgccatgatctattcacggtttttactttcttccaggaccattcaattcccttttctacgtttgctggagatcgttgatatctgaatttttaaggtgaggggcaattaatttacagttcgcaatacctatttagatgtgactaaaactttaagaaactatcacatcggatgtttggacactaattataaatattaaacgtagactattaataaaacacatccataatcttggactaatacgcgagacgaatctattgagcctaattaatctatgattagcctatgtgatgctacagtaaacattttttaattatggattagttaggcttaaaaaatttatctcgcgaattagcttttatttatgtaattagttttgtaagtagtttatatttaatactctaaattagtgtctaaatatagggactaaagttaaaattagtgtctaaatatagggactaaagttaagtccatatatctagacacccctgtgcatttgatactttgactgatgagtagatgagtctgccggcagaagggcacatcagaggaacatgctctccaggagcattccggaaagagaaaggattactcctattactgtactgtggcaaaagtatacttcagtgctttaatagttagccgccaccatctattcacggttttcccccttattccaggagtatttccttcgaagtttttagtagttagagtatcatattcatcgtgaagtgtggatgatacagatgcagaactatgtattctttcagtattaaaagatatcaacctgaacttgctaaccaatgataatcaaagcatggtcctcgctttgatgtaatccaatttgattgtaaatgctcctctttgttcccatgccatgttaaatttatttatttttactctggatctctatttttacatggacttaaaaataattatattcattcatcagtagtaacttccgaataataaaaataattgttcccttaacatgttaaatttatttaaaggtggattttgttttataaaggattgtgaattatgtcctctattacttaatagcacacttgttttgtcctcccctcacatgcagcgtgcactcgcataacaaaagaaaattcctagataaaaaacggttgtttactatttaaaagtggagtcggtggttccttcctcccctatttcccctcgtgcgcaacaca

SEQ ID NO: 61053 - DNA, 15091 bp, Oryza sativa
atttttcttcttttttcttatgatggttctctagtgctttcagcacttgtttttacaattaaatatcaattgctagctaacttaagatacataattaagattcaaaaatatctaataaattcgatatctagagttagaatagctgctctacatctaacagaatgatgaaaaaaaataaataatctaggcaataatcttcaagccgcaagttctgtataattctgatactaacaccaaacttgcccaatacatatatgtagtcagcaataatcatgcctcttccccttttcttttacttttaagtaaacaagtgtattcatggatggcacgatgcacagtcactccgtccggacgcagcgaacagtaggaggagcacaatccgatcgaaatgaacaaacataccccctcgataaacaacaatcctattccattattgcccatgccattgcccataacggcttcggcttccatccagcagcgagctagcacggcatgtgatgcatgcctgcacatgctcctctcgatctgctctatatgcctcctctatcacatctgtcagttactcgccatagtctgcatcaccgatcgagtctgcagctgcatgcttctactcgtgacaccccccccccccccaacccccaaagaaaacgggtaataattagctcgttcttcctctgttacaaaataaaacaactttttttatataaattttaacataggtgaaggagcagtacttcgaccacgatagctgaaacaccttagcacgtcgaggaaatcaagcgtacacaccggccggtacacagatccaccgatggatggatcggtgaggaaatgaagcatgcagcagcagcagcatctgctgactgcaatggccatggccgatggctctgcatgtcctgtgccctacaacaccctgcatctgcatgctagctagctgcacgcgcgtcgttgcgtgcacacacacgctatgaatgcgttggtgcatggcgtgttaattttatccggagtccccacagacgacagacacatcaattatataggatctacagtgtatcaatcgatcgatcagcagacaaaaggaacaaattaagtacgcgggggagagagtaggtggctagagaggggcttcgccttcgctcctccccttcgcatgtagtatacgtacacacatgccgtctcgcctcctcaattatgagctgaggcgtgtacgtgcgtactctgctgtttgctgtggactctgtacgtggtggaaggcccacagacaagctcggcaaccaattaacgtttacatgtacgtatctatagttgatcagtccagatctccatgtcgatctggaagatataattagccctggttttgttcctaaattttttttccaaaaaaatcacatcgaatctttaaacacatatatataacattaaatatagattaaaaaactaattacacagtttgtatggaaatcgcgagacaaatcttttaagcctaattagttcattattagctataagtgttacaataacccacatgtgctaatgacggcttaattaggctcaaaagattcgtcaagcggtttcaaagcgagttatgaaattagtttttccattcgtatccgaaaaccccttccgatatccgatcaaacatccgatgtgacacccaaaaattttcttttcgcgaactaaacagggccttagttgagtagtttgcataggtgttcagcgatgtggagattatgggtaccccatatccacacgacatggttatcctactaattttaggggataacttatatctatgaaatatgtaacggatcatgacttgagtattacgttttcttgtatattacggaacggcctaaagttttggtttggtaatagatttaggaaaccgataccatattggttacattttttatcttgtaatcctaccccccattctatataagacgggcaggaggccctctagggcaagatgattcacaactgatcatcagatcaatactacacctggcggattcaaatccctaaacaggagtagggtattacctctcattgagagggcctgaacctgtctaaatccttatctccgcatccatccacttttaggtctcatgcactacccctttatattgtcgaaatcttgttttgacaagcgagacgaagaaggagaagacacaattatctgagcaagtattaaaaagttgccgcaagttttttgattatataaaatatttttaaatataactatagtataattaaagtgtagttatattctaactgtattgtactacttttttttatactagaagaacatgagttccccgtatccattgaaagaaatgcagagtttacaattgtattataactatagtataaatgcattgaaactacgctctaactacattgtaactacgatctatactcaactatgtgtcgaaacatgaattcggcaataataaaagggggtagcgtacgagacttaaaagtggatggatgcagagacaaaggatttagacaggttcaggccctctcaatgagaggtaataccctacttctatttggggatttgaatccgctgggtgaattatagatctgacgatctagttgtctcatgccccctagagggcctcctgctcaccttatataggatggggggcaggattacaagatagaaaccttatccaatacggtatcggtttcctaaatctactttacaatcttatcaaaccaggactttaggccgttccgtaatatacaaggaaacgtaatacccaagtcataatctgttacatattccatatatataagttatcccctataactagtcggataaccatgccgtgtgggtatggggtacccataatctccacagtagcccctgagaccttcacaatcgaaaagataatcttctctcgaactagattactccaaagccgagtgcttcaatcatctttgccatggtctcccgagtacttttaccaaatctgaagactgttaagggctgaaaaataaagtcaggtgcatcgactagatgcacctaataggtgtagccctcgactatgtggttaattgaacaaaccaagcatatagtcaagtaataaataatccaaccaaccgagtggcttcgataattatagtcaaccaagcgacttgatattaatatgtagcatatgcggtgtgaatccctgaataacatgatccgagtgatataccgactgttttgtaaaatatgatgagtgtaacctaaagttggctacatcattgaaaattcacatagcaaaacagctataaagaagcttatatgttgtgaataaagaaatttccaaagtattgggcatacgccatgtgcacactgctttaacagatgtgcttaagtccctagaagacacatggttccaccacacctggaaatatatggcatatgtggtataaaatccgagtaaataaactcataaaggatttaccaaccgcctggaaaatgaccaaaatatataatcagcctaagccataatattggtcaataaaagtgcacacttacgtggcaaaaagcaatgatattgtatccaatcaattgctttatgaacccaaacaacaccttgacttatataaaaaagtcagtggggagctatataaagcattactgtttggcaccttttaaaatgcattgtaccaactcctaaaaaattgagtaactgcggtataaaaggattttaaggtattgggcacataatcacgcgcacttttgcctaagcaaaaagatgcctaagtccctaaaagaacgtgacaggccacacctgaaaatatgggctgcagacatattaggtctaggccaaaaaatatgccttcgacaccctttaaaggatgacgcatgtaacatgctcctgagtaataaatctttcgggtgatatagaccaagtgtaactcatatgaatagcttctgatctgagtgattatcctttatgggatactccaaaatagatataacaattgaattccgactagcgcaagtattcggttgataacccttacggggaataataaatagtccagtctttgagcatagaaaatagacccatgatcatcaaattcatgttgcatgtatccggaacaagtccaaattgaaggtatgatacttgtgtttgaggtagtaagcccctgagtatatagcttgtccttctgtcgtagtcacaattgtccattgatggtagctgacgcggttggcatagagacaagacgaccaatatagagataatattgcccaccagaggtggcaaaaatattggtagtagtgaagatagtgataccaatcaaaagtgatgaagttgcatagccgtggaggcgaagaaaccagtcggcaacagtcaggtcagccagcaatgaatatgaaggcgcccagcgataaagttgtgtagccatggcagcgaaataatcagtcggtgacagacgatgcagctggtgaagaagatgaagatgcccattagtggcgacataataagccatccatgaaggcgaggataccggtcggtggtgacgaaagcaagccgatggtgaagatgtagacacgcatcaaaggcgatgacgaaatccaccaatcatgaagatgaagaaaatagtcggcgacgacaaatgcaaccgatagtaatgatgataagtagcaatcatagatgatcaaatataatgacgaagttgcccatcaatagcagtagagtgggctatgttgaagaggcttgacaggatgttgatgaagataacgatgtcggtgatccagtcgatagcaaccgtgaaagtgaaataataagtcggcgaagacatagttatccattagcaacagagttgatgtcagggccgatgaagcagaggtgttggtgatgatgtcagtgacaataatccatcaaattgatgttatagctgttgcagatgcttcacttgaaggaaagtagatgatgttgtccaactcgtcgaaactgagctgattggttgataactctgctctaaagcaaagacgaagataatgactcctggaattgacttgttggctgattaattgattgcttcagcttgtcgaattttgagagtcttgtatttgtgtagcccccgactctttggttagttgggaaacaactgaacatagagtcgagaactgtaacttcttgtcgtcgagtagtcattgcttgagtgaagataaatattgaagattggaacaccacttgttgtaataaaataacacggcatcatatttggtgacgtatgccaaggtgttgaaactcttgtagtcgtcatggttggtgaagtagcaaagcttgcgaagtagaggcaatagagtttgccgatgccgaagataataaaaatgaagttgctccaccatagtgacaaagttgcatagccgtgatgaagtgaacatgagttggcggcaacagaagcaaaccggtagtgaagacgcgcaattgtgaagataaaagcaccagtcggcggcgacataaccagtcgacgacggaagacgatgatgtccatcagtagtggtagctgtataaaccagacgtagaagcgagggcactagtcagcagcagacgagacgaccggcgatgaagacgataaggccaatcaacactagcagaatcatgcagccatggaagtgaagaaaccagtcggcagcagacgtaggcagcttgtgttgaagatgctgatgcctattagcggtgacggcgatgtagccagccgtgaagaagatagcatcagttagcgtcataacaggccagccgtgcaggcggtgacaccagtcggcgacggatgaggcagccggtcggtgaagcggccggtcggtgaagacgtagatgcccaacaaaggcggcataataggccagccgtgcaggcggaaacaccagtcggcggcggacgaggcgaccggtcggtgaagacgtagacgcccaacaacggcggtaataagccagccgtgtaggcgaaaacaccagtcggcggcggacgacgcggccgatcggtgaagacgtagacgcccaatagcggcggcataataggccagccgtgcaggcggaaacaccagttggtggtgcacggcggaaacaccagtcggcggcggacgaggcggccggtcggtgaagacgtagacgcccaacaacgatgacataataggctagccgtgcaagcggaaacaccagtcggcggtggacgaggcggccggtcggtgaagacgtagacgcccaacaacggtggcataaaaggccagccgtgcaggcgaaaacaccagtcggcggcgaaggaggcggccggtcggtaaagacgtagacgcccaacaacagcggcataataagccagccatgcaggcggaaacaccagtcggcggtggacgaggcggccggtcggtgaagacgtagacgcgcaacaacggtgacataataggcctgccgtgcaggcggaaacaccagctggcggcggatgaggcggccgatcggtgaagacgtagacgcccaacaacggtgacataataggccagccgtgcaggcggaaacaccagttggcacaagccggtggtgatgttctgactgatccattcctggagcgtaagagataagcttaaagccatgaatcccttttatacatatctggatctggatcctgcagaacaaacatataggatgagtagtatctgatataaatataatactcgagaaaaattcaagtattttaaaatatttataaatatgtatttcttctcttgtcaattttgatttccccgagcaaatgactcattacgtttaaacactctgcccgactagtcatagccaccaagcaccgggagtcggcctaagcacttcccaaacatgcatatgagtgacatgagttcgtcattaatggaacaaagtttcacgggtcggagtttactactcgggtacttttgcaattattaagagcagaaaataaattatcttatctctatacttttgatttattccgaataatacttagcaccttgcattattcggtccatccaacaagcccccgggtgctaggaatcggcccaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactagtcaacggcgaaccagttgatgtagtgaggcaaaggaaaaggcaaaatatcatataaagaataaaaataaatgatgacttagctttgtcgtatttcctcggtgacagcaaaagtagccgatgtgggaacgaagcagtccatcaatggtgacaaaaacaccagtcggcgccagtggaaccaagccagtggtgtagatgatggagcccattaatggcggcgaagtccgccaacgtataggcgaaaacaccagtaagtggcggcagaggcaggccggcggtataataggctagctgtgcaggcggaaacactagtcggcagcggtgaaggccagccggtcggtgaacgacgtagacgcccatgtacggtggtgtgaccaaccaaccgtataggcgaggacaccagtcgacggacacccaacaacggcagcatataataggccagccgtcaaggcggaaacaccagtcagcggcgacgaaggcaagcggttggtgaagatgtggatgcccaacaacggcggcatagtaggccaaccgtgtaggcggagacaccagtcggcggcggcgaaggcaggccggcggtgaagtcgtagatgcccaacagcggcggcataataggccagccgtgcaggcggagacactagtcggcggcgacgaaggcaagccggtcggtgaagacgtggatgcccaacaacggcggcataataggccagccgtgtaggcggagacaccagtcagcggcggcgaaggcaggccggcggtgaagtcgtagatgcccaacagcggcggcataataggccagccgtgcaggcggtgacaccagtcggcggcaacgaaggcaagccggtcggtgaagacgtagacgcccaacaacgacggcgtgaccaaccaaccgtataggcgaggctgatttgcatgtagattcgtctctctgattttgttgacattatgggcttggtgcagctaaccggccttagaggttgcgtgtggcatgagcaaacgctacatcggtagtcgagccacgcactatgtcctggtgtacccctctcggcaacatggtagcagtgggaagcattgcaccgacggccgtacatgcaataaaaaatcatgagaagattagtatacgttagtaattaatctaaatatataaattacaaggaggttaggaaccggcagcacagccaaatcccatcactcattaaggaacgattttttgatctcgattgccatcctgtgcatgcgaccaaccatcgctccagtatacatgcaaaacaaacagatatagtttgattagccttaaaatattacacgcttaattgtgtaatgcatatatcaagctagggtttgatattaacccgtgcatatcagttgatcaacacatgcacgtgaagcactcagtcgctgttgatcccatggacatgaattgtccccgtgtcgtatgaaggttacgccggcacctgtacagatcgtaccaggcgacgagcagacacaccgggacttcgtctcgatctcagccggtgcgtgaaaacaagaaaaagaaaagtaatagaagattagtctgcagttagagaatgatctaactagtgaaaacgacaaagccaatgatattaattggagatcgaatcgatgaaattgccgagattgatcccttcgactggattgaatccgagacgaaaaagacatgcttgatgaatccggcgatgtcggagattggttccatcacacttgtgataggaaactcgacgaacccctacctggcgcgccaactgtcgaaacatgaattcggcaataataaaagggggtagcgcacgagacctaaaagtggatggatgcagagacaaaggatttagacaggttcaggccctctcaatgagaggtaataccctactcctgtttggggatttgaatccgccaggtgaattatagatctgacgatctagttgtctcatgccccctagagggcctcctgcccaccttatataggatgggtggcaggattacaagatagaaaccttattcaatacggtattggtttcctaaatctactttacaatcttatcaaaccagggctttaggccgttccgtaatatacaaggaaacgtaatacccaagtcataatctgttacatattccatatatataagttatccactataactagtcggataaccatgccgtgtgggtatggggtacccataatctccacactatggtttggttgtctagcacagagattgatgtgatattcacaaggggtttttttttacatatatatatatatatatatgccttgggctaggtatttttgaaggctcaatatttttgtagtcaatagaaagaggcagtcctcacgccctcttattgggaggggaaaaaagtactaattccatgtctgcgcgtttgggctcgcatcgcaggcatgcaggaatcagccggtcgtccgtcgtctcggcgagaagagcggatcgctgctctgcatgccgttgctcttatgatctgctcgatcaccagagggcagaagccatgcatgatactgtacaacgcctgctagcttagctgccggcctgccgcatgcagcattgccgccccaagaaacaccggaaaacacatagccagaccaccaaaaacgttcgtgacattccgccgcgggcatcgcggcggtgcgcggcaggcatatgcagccggggcatcatggggcatggggccgcgcgggccggcatatctcctcgccccgaaccatccgcgccgcgcgggcaattactcggttcatttttgccacgatccgcgcgcgcatcggtcggcatgggccgcgcgcgcggcgcgcgcaagcggcaacacggcaacgccgcccaccatgtcaagttggccgctcgcccgctcgacctcacgcgtatgcttcggcgcaacatgtccaattgtccgtgtacccgtggtgtctgcttcctgatcgttacggcgtgcagcgggcgccggtcgatcaagtcgagattcgcggttgagtccgtgccgttgatctgtgttttcggtagagcacggtggtatccatgggaagaggaggaatcacgttgtacttgagtggccagattgcttgacatggtttgggccttttaagctggttgttttaggtaggacctttgggctgaaagggaggtgtaactaaacgggcttgcccgtggcaccaaccccacgtttttggagtcttggacttttgtttggcttggggtgagtggacgcgggatgaagttgggttgcctttcgcgattgacctccgccaaggtgcgaacgcacctacggaagggctttccccttgcaaggaagaagtgtaagtggatcgatccacgaaaccatttaattagggtcggtttgaatcaggttaaaaatattattattttaattattaagaattaggtggaacaaacaagtagattattatgctagattattataatatataaggcagattactataatccaattatctccttaaaagagcttttttcagattattgagtggtaaagacccattacccttaaatgcctttaataatccaattaaccaaccaactcgtagctaatttttatgtcagcttattataatacagcttagagtaatctgatttaataatctagattacaataatcttaagctgaaacagacaggacctaagtggataaatcattaagtggattcgtggatcagctcgtttgcttgtggcattccatgtagactgagaatagagaggcagtggcggagccactttacgggcaggttgggtgaccgctcggactctatcgtcatcgtcttcattgtcaatagctgccaaaacatataaaaattaatcgatcacgggaaacactaacagtcgcctgaacttgacgacgctacatataaaaattaatcaatcacggaaacactaatagtcacctgaacttgacgacgccgctgactccgtcactgggcccatcgatgcttgtcaatgacctgtgactccaacctccgactcacaaccacaagttccccgatcagaaccgggacaagagggggacaagaggcataggggatggacttagacagcagcgcgagtaacaggagcaacgaccagaaaagcccgtgcttgattattttgagcacatgcttcttcagtaaagaggaatcagacgattcaagtggaatttttttgtaacgtatcaataagatagagctatgctgcgggttgtctcaggtcctaaataaacgcggacacttaaaaaatctgttgggtaggcggattcgcatctcttacaacccacacaatcttcggttcttggtgcggaagcaatttgcttggctttacatccatcccaaggtatcatttgtaatacatttattggacaagctcgtgcacattgagtgcatcctatacatgtatcataaatttttacggaatgtgacattagatctataattttttcctttcaacataaagattttcgacctggtcataatgaaattagttttcgttttttttataaggagtgtgggggtagtcatggccatctaggcgtgtaggatagcgttgttgtgggtgatgggctgattggggcaagggctcacgggtagagtttacaaaaccgtacgtgcggttatcatttgcgataaccttttcagtttttaaaaccacggaataactcgtggtacctgcgcggttcagctggctcgctagcttgtggactagcctgagttagcttatcttaataacgagctaaaatgctatcttggctcattacaagatggaaatgagtcgacttgagtcgagcaaactaaccaaacacgaatttttgcccggccatatgtgcaggtcatattttatccaggcacttagcattgtctagatcctcttggagattctgcagctaagagatgaaggttcgtctccactacgacacaatgacacataacttatgactctgaagtctggagcatgattcttgtgggagatgataaatcacttattcatgcgttcaaaatgacatcctcaatagcgtgatgacaaagaagtacctttttttttctttataatgggcagagaagtacttgatcctagaaaggcaaaagcacatgtaggtgggtaaagtacaaatattctaacaattgagaatttgtaagtagaggctctaatatactgtcctacttggaatatgatacagagaaaatatcacaaattttttataggagtagctagctggatgataaggtccattgcatcattccaattgtggcaatgttgaaatgactaggcaactggtcaattataaagggatagtttaggactttctgcaacttgcccctcattatgcagttgtttatagaatgagcaattatactgtctggctagctctatcccaatttccctgttctgctctcctacttttgtaaccgaaaccaattttcccttgttatttaagttattcttcagacgactcacgtgtagatcaaaatgtcaacatggggctacgatgtcgaaagatatattaacatggacaactcaatacaaatacaacctatattgactcaaagaatatgaccccatgtttttcatgaggcaagacaatgggattgactacacgctgtacaacaatacaacctatgcaacttactactatattatccacgtaataacctacagcctacaaattgaaatattcaaaaaacatccaattgaactttgactaaagtttctatagcttctgatccatgccaaaaacgacggatcctgcatgacatcaagaaaacaaatcagtaagttttttccttcgcgaaaacgcaaaaggattgtacgtcaatcagtaagttaaaagtatgatacggcaagtattttcactgtctgaattctcggttgtgtagagactagagagttgtcacttgtcagttaatttacctaacgttggcagtaggatggtgagagctgcaaccccgacaattttcaggggcgttccggcgatcaccatgtccttgatgctgatgtagcccgtgctgaagccgacgacgttgcccggcgagccggtgggcagcaggtaggacagctgcgcgccgacggcgccggggaccatgaggaggagcgggtgcacgccgatggacttgcccagctcggcgagcagcgggagcaccagcgtggcggtcgcgtcgtcggaggtgaactcggtgatggcgccgctgaagacgcacgccacgggcgcgatggccagcgccggcgcgccgcggaggaagccgagcccctcggagaggatgtcggtcaggccgctcgccctgaagccgtcggcgatggcgaagccggcgccgaggaggaggatgatgttccactgcagcctccggcacttgccccagtccatgagcttctcgccgtcgttcttgccgctcgggattatgaacagcagcgtcgccatcatgatctgcattgcgagccaagttgttgtcccgtgagatcatgtgacaaatcgtctctgagaaaacaaatcagaatttgttcgatccttggtgcgcttacagtgacagttccatccccaacttcgccgtggaagagtgatccccacccaggaatatcatctgtcaggctcctcgtcatccataggacaatcaaaccctgcaagaatcaattatggatacattaaaattttgtcacactataacgaacccctccatgatcgcgtcataataacgaacctgcacaaaattagttgagaagggcccaccagtgatgatgtggcaaattttaaaattttgggaactaaaatttcaggcatctcttggagaagggggtgttttataggccaaattagtttttggctgtccccaatataggatttttggggctttaattttagccctttgttggagatgctctaaccgaacactgtttccaggttgagataattgctataaccccagaaatggaaacggaacttaccccaaaaacggctagaaccatcttctctgcaaaagccataggacctgtcacaaatcaagatggacaaccgaatcagaatccattatggcaataattatcatggcactgatatttcaatgagtgccactgttatggagaaaaagaccaaaacgaggtccatttcagagttacccaggtttcaggaaatattggccgagaagctgtcagagtttcagagataaccccagaataacattgaccacgccattgatgagcactggccattgccgtgaagtaacaaacaaacagagcaagaacgagaacctaccaagcaagctgagctccctcctgagatggctcctgtccaggtagctgagagcgccctcccggtgttcttggagcagtacaggacgcagagcgtggcccagagcgcgacgaagaggacgagcgccaatgggagcccgaacgacatccacgagctgaaggtgatgggcggctgctccgggaagtaggtggaccacatccccaccaggatgatgttcacgccggtgcctgtcagtgtcgccatcccgccgatcgccgacgcgtacacgacgccgagcaccaccgccttggagaaccgttgcacctcccgcgcgtccgcggcgctgctcgccgaggacgacgccccgtcgacgcgcgggaaccgctgcaggatcccggtcgccaccggcatcatcatcacggtgcacggtgtgttgtggatccacatgctgatgaacatggtggtgccgcagattcccagcagcagcagcggcggcttcaccgggtcgccgcagaacagcgacgtgatctgcaacaaagttcgcgggttttccttggattgttagttgcacggttcggacgaacgggcttggtaaagacgggctcgcggcgcggatcacgtacgttgagagcgaggcggcggtggatgttgtagtgctcgatggcgagcgcg

SEQ ID NO: 61054 - DNA, 1660 bp, Oryza sativa
  unsure (1)..(1660): unsure at all n locations
aattgagatccagtgcagtcctaactgtgactgcaacttaggaactacacattatctcagccatccattttttcaatgaacggtctaaatctgatggtacagtgttgatgctatagtagttctataatttttttcggatgtgaacagtactttgtagattttggacccttggatttgcatcaaaaggtcttagcgtgactgcttatgttgcagtcacactaggtactgcaccggattcaaatccgtttttgagatgtcagtcaccaaacatactgatccctgcatggtatagctagctaacgtctggctttttcaatcgactccttcaatgttcaatgtgtgtacccagacacgccgtagtggtttcccttaatgctcctgtttacttttcctctgaatttagtagtagtagagttaatttacggtcgtctaacagatccagtgcagtgctagtatgtgctgtagtacgaaagtaaaccactttaatgaaagatcctgtcgttacaggcttagtatttaaatgatgttcgtcccgtacataaaacaggggtgtaaagaatttggatagcttccgattgatccggaagatttttagaaatggatagtaccccatccgtctccaaaagttaattaatttttcatacaccccacacacacgaaaataaaaacaaaaagacaaataatccactttatcaacccaatgtaattattcccaattttatctattttcaattgtgagacgataggactcaacgcgataatcgtattgataccgatgtggagtatatataggcacacaaccttcctaaatctactcaaccaatttatataaacagaaccaagagagatataaggagattgggccacaaggaaacaaacgatctacatgccaacatatatgcgtcatgctaaccgccccccccccccgggagagcagtcttagcgtcggctggccaaacgttaagactggatcggaattccgaaaacacagtcgagggcaaacccttggtgaaaatatcagcaaactgcgatgtggtaggtacgtgtcgaacacgaacagccctgtggcgacacgatcacgaatgaagtaaagatcgatctcaacatgcttggtccgttgatgctataccaggttgatagagagatacacaacgctgacattgtcacaatagacaagagtagccttcctttgaggagtgtgaaactcatgaagaagttggcgaagccagcaggtctcggcaacagcattggcaacaaccctgtacttagcctcgcactggagcatgaaactgtgttctaacgctcggaggaccaggagatgaggttatcacctaagaacactgcatagcctgaggtagaccaccgcgggtctggacaaccggcccaattgacatcagattaagacaccaggtcaatagtgggacagcgatgaatatgaagactgtaatccagggttccatgaacataatgaatgatgcgcttgagagtagcaaggtgtggctcctgtgggtcatgcatgtgaagacagacctgctgaacatcatatgaaatgtccggtcgagtgaaggtgagatactagagagcacctgcaagactgtgaannnnnnnnnnnnnnnnnnnnnnnnnnnnnnnnnnnnnnnnnnnnnnnnnnnnnnnnnnn

SEQ ID NO: 61055 - DNA, 1024 bp, Oryza sativa
  unsure (1)..(1024): unsure at all n locations
cttggctcatttgaccatcgtgtggtcgttgatgaccggagagacaccgagttgtggtggtggcgccgagatacgcggaacacgggcgctgccaggacgcgtggtggcgctgcttggtggaaggagccgcatcaggtcgggagccagtgcagcagcagtcgggaatggagtcgctcgtgtggtcgaagaggcggctggcggcaaagcagaaggcaccgagccaagggaccatgtcccaggggaggcaggtggcccgaggcatgcaggcggcccatgtgacaccgcccacgagctagaagatgctggcagcccaggtggtggcgaaggtggcccgtgaggtcgtggagtcaatggcccacgggaggtggccggcccatgctgtgagccatcgtgggaggctgaccctggttgtgcagttatgcggcgacgcccgatcggacctggtattgttgcagaaaaatcctcgagaaaatcaaggttagtagcatctgcattattaactatctcagcatatggaaacgagtgctcatcaaaccccacatgacacgaaatgtagatcctattggaggaaggaccaaaactcctgtaccctttgtgatccttaggatatcctaaaaatactcacatgatagagcggggggcaagcttgtggggtgtggtggcggataggttgggatagcacttgcagtcgaaaactctgaggtgtgtataggaggggtgtgcaccataaagggagaaaaacggtgtgtggtgtgtggagagtcttggtgggatggcggttaatgagatgggtagctgtgtggagggcttccacccaaaagggcggtgggaggctagcctgaaacaggagggagcgaactatgttattgagggaacatagcatgcgctcaaccataccgttttggggggaggtgtgggggcagaacaaacggagagagacaccgttggtgagaaaaaatactttgggcgctagnnnnnnnnnnnnnnnnnnnnnnnnnnnnnnnnnnnnnnnnnnnnnnnnnnn

SEQ ID NO: 61056 - DNA, 1910 bp, Oryza sativa
  unsure (1)..(1910): unsure at all n locations
nnnnnnnnnnnnnnnnnnnnnnnnnnnnnnnnnnnnnnnnnnnnnnnnnnnnnnnnnnnnnnnnnngtgccggtcgccaggaggagagccgtccagaacgccgaagtgaacactggatcccgatcagagacaattgacacgggaacaccatgtagccgaacgatgtctgcgaagaacgcgcgtgccaccgtctccgccgtgtaggggtgtgcgagggcgatgaagtgggcatatttggagaagcgatccacgaccgtcaagatgacggtcttgccggcaacgcgcggcaacccctcgacgaaatccatggcgacatcggaccagacggccatcagaatcgggagaggacgcagtaatcccgctggatgcaggtgctccgtcttgttgcgctggcatgtgatgcagccctgaacgaagtcgctgacgaggtggcggtcgttgggcgtgtggaagtcgcggcggaggcggtgcagcgtcttctggatcccctcgtgcccttcctcgtgggcggccgccacgatcgtcgagagccatggcgagcccggtgggacgtagatgcgccgcttgtaggtgacgaagccatcagtgaccgtccacggtgcgccacgtgtaccggcggcgatctcgtcacggagagctagcaacaccgggtcggacgacgtcgccgtgcgcaggtcatggagtaggtcgaacaccggcgtcgtgagagcgaggagttctcccttcggtggtgcgcgacgggacaagtcgtccgccgcggcattctacttccctggtttatactccgcagtaaaatcaaatcccaagagtttgcttacccaatgatgttgtgggatcgtcgacaagcgttgatcaaggaggaacttgaggctatagtggtcggtcttcaccgtgaattgccgcccccagaggtacggccgccaatgtcggatcgcttgcaccaacccgatcagttcacgttcataggcggcaagagcttgatgacgtgtggcgactggtcggctgaagtaggcgatcggcccagccccttggagaagcacggcctcgaaccccatgcccgatgcgtcgcactagaccgtgaacgccgatctgaagtcttggagtgcgaggacgggcacggtggtgagggcgagcttgagccgctggaacgcgtcgtcggccggcggcgaccaggtgaatcgatccttgcggaggagctgtgtgagtggcgccgcaggcatgcaactgtgaagaagtccgggatgaatttgcggtagtaccctgccaggccgaggaagccacgaagatccttgggcgatcgcaggcgcggccactcgacaacggcctgaatcttggacgcgtccatggcgacgccatggagcgacacgatatgccccaggtatgcgatgctggcgtccccgaacgaacacttggcgcgcttgacgaagagtcgggccgctcggagcgcggtgaagatggtgcgcaggtgctgtagatgcgacgtccaagacgggctgtagatgaggatgtcgtcgaagaagacgaggacgaaacggcggaggaacggccagagcacatcgttcatgagtgattgaaacgttgccggcgcgttcgtcaggccgaacggcatgacgagaaactcgtagagcccatcatgtgtgagaaaggccgtcttgtggacatcatcggagtgcattcggacctggtggtagccggaccgcaagtcgagcttggagaagatggtggcgccgtgtagttcgtctaggagctcgtcgacgacagggatggggtatttgtccttgtgcgctcgttgagagcctgataatcgacgcaaaagtgccacgacccatccgctttcttcaccagcagcaccggcgaggagaatgccgacgtgctccggcggattaagccgttctcctccatcacacggc

SEQ ID NO: 61057 - DNA, 844 bp, Oryza sativa
  unsure (1)..(844): unsure at all n locations
attatacttatatgtagacatacaagacagagggttcctcatgtgtgtaatattggctaacacaagtatttagccctaacgcttcaagagtcattgctgccatgatgcacatattcagggagtgaagatgaaatctccaaattctaaaggtatcagaattcaggtgaaaactacaagaacatagatggctctgaaaaatttaggtgaaatctttgtactactgtatctctgaattatgttcatgtatgtagctacatattcagagttacaagctgccaaagagctacatattcagaattatgtagcatccgatggttcactgtttcggatcaagacatgtgctaaaattagtgagctggtagcccaatctgggcggtgcagcgtgcttacttgcagactaattcgagtgaatcacaggctaaccaggcctatcggtcaacaagtatatgtcaggtaaaaaacatgtagtgctaagggaatactgttcattagctcaaacaacaccatggttaccttgttgatctatgattcaaggttacctcccttgtcattctcccaattctaagtacacccgaaacaaattttgattgcaatcggtgcaaaattcgttaaactacagaacaagcaagctggtcaatcagttaccctcgacttctaagcaactaatggctacaagttcccctccaaatccatcacacaagcaccaatatgcagacaaatcgagtaaatcacagggcaaggttgaaaaaagaaaaacacatataaccaagagatttcattttnnnnnnnnnnnnnnnnnnnnnnnnnnnnnnnnnnnnnnnnnnnnnnnnnnnnnnnnnnnnnn

SEQ ID NO: 61058 - DNA, 760 bp, Oryza sativa
gtggtgcctccgcctacacggctggcctattatgccgctgctgttgggcgtctacgtcttcaccgccggcctgcctccgtcgccgccgactggtgcctccgcctacacggctggcctattatgccgctgctgttgggcgtctacgtcttcaccaccggcctgcctccgtcgccgccgagtggtgcctccgcctacacggctggcctattatgccgctgctgttgggcgtctacgacttcaccgccggcctgcctccgtcgccgccgagtggtgcctccgcctacacggctggcctattatgccgctgctgttgggcgtctacgtcttcaccaccggcctgcctccgtcgccgccgactggtgcctccgcctacacggctggcctattatgccgctgctgttgggcgtctacgacttcaccgccggcctgcctccgtcgccgccgactggtgcctccgcctacacggctggcctattatgccgctgctgttgggcgtctacgtcttcaccgccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccaccgttgatgggcgtctacgacttcaccggcggcctgacttcgtcgccggcgactggtgtcctcgcctatacgggtggttggtcacaccaccgttcatggg

SEQ ID NO: 61059 - DNA, 1765 bp, Oryza sativa
ttcctaccacccgggggctcgttggatggaccgagtaacgcagggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaaccggccgcctcgtctgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggtgtctacgtcttcaccgactggccgcctcgtccgccgccgactggtgtttccgcctgcacggctggcctattatgccgccgttgttgggcatctacgtcttcaccgaccggcttgccttcgccgccgccgactggtgtttccgcctgcacggctggcctattatgccgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgactggtgtcaccgcttgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgatgggcctattatgccgctgttgttgggcatctacatcttcatcgtcggtcgtctcgtctgctgctgactagtgcccttacctctacgtctggtttagacagctaccactactgatggacatcatcgtcttccgttgccgactggttatgccgccgccgactggtgcttttatcttcacaactgcgcgtcttcgctaccagtttgcttctgttgccgccgactcgtgttcacttcatcgcggcgatgccactttgtcatcatggtggagcgacttcatctttattatcttcgtcactggcaaactctattgctgctacttcgcaagttttgcgggttcaccaaccacgacgtctttgtgcaacctcgacatctcggcatgcgatgctgtgttattttactacaacaagtggctctccaatattcaggatttctacttggacatcttcaacacatatcttcaatcaagcaataactattcgacgacaagaggctacagttctcgactctatgttcagttgtttcccaactaatcaaagagtcgggggctacacaaatacacggctcaaaattcgacaagctttatgtcaagatgaagcaatcaatcaatacgaatcaacttggggagttat

SEQ ID NO: 61060 - DNA, 906 bp, Oryza sativa
gcatttttcttgatttactgagacttgaatgggcttaaacggagctcggatgaattagatatgaattttagaagattcactatgtttttactataaacagaaaaatccttaattgatttattgcgcaataattaaattcctagggagagagagggggcggcgccgacatgcggggcccacatggcagtgactcgggtggcggtccgaggtggactgggtccacggaccgggaaagaggcagtgcaccacgtggtgcacacgtggcgctgacgtggcgcacacgcggcggccacgtggcagccacacgggcggtggggttagatggccccgatctaccgcccgatagatcggacggcggaggcggctcgcagccggcgcgcacgggcacggctcaaaccggcccagcgaccatggcgcgcggcgacgcggctcgacgcagcggcggcgaccggcagcgaccggccgggggcagagggcggcagctaagcggctaggcggcggcgcggcggctaagcagcgcgggagagaaagaggaaggggaggaggtgtctcaccgacggcgattgacgacggcgagcgacggagggcgatgacggcaacgggacgagctccggaaccacctagcgaacatgatgaatggggttagagagagaggaagatggaagggggcgaggacgccggccgaaggcggcggccatggcggtgctcaccggcgcatggtgcagagtgggttccgacgtcggaatccgacgggagatgggtggacggggtggcccgcacgacggcgaatgcgacggcgtcgacggcgcggctcggcgcagcgactagcgatggctagcggcggccgagcggtggcgacggcggcggaaaggagggcgacggcgctagggcggtggagtgcacggg

SEQ ID NO: 61061 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnnnnnnnnaatttaattattgcgcaataaatcaattaaggatttttctgtttatagtaaaaacatagtgaatcttctaaaattcatatctaattcatccgagctccgtttaagcccattcaagtctcagtaaatcaagaaaaatgcatagaatccattaaaaatggttttgttctctgtttcagtagtcttatagcctgtttgtattgttaactttgtatgttgcttagattccggctctcttgtcgctccagtgtactttgaaatagtcgccgaggttcctcctgcaacagagcaaggcaagtcatgcttgtcacttaaacatgttgatcctatattgcaaatgctctattgttttcctttaaatactgcattgttttataatgttactatgggatgtttacctactgttacagccatgctatttttgtaccatgctcctttgctagcttgggatataacatgactagatattggactagggattgcttagccatgcttagttcaactagcacacaatgggggaatcacattaatgcatagacttcaggttctagtgttagtgttggattaaagccaccgtcttggtgttagtcaattaaaatataccatatggtgggctgtggatgcatggttttgatggtcgcacccatggaatttaaggaggaccgattcgcgggatgccctgggagaacttatcgtacttaccacaagccagcgtgggcaac

SEQ ID NO: 61062 - DNA, 7523 bp, Oryza sativa
  unsure (1)..(7523): unsure at all n locations
ggggctgtcttgtgggtacagttgggcacctctgatcaaagtaaaactattcgaatagccgtgcccgcagttacgggcgggctaccagactcaccgtgattagactcaccctagcttagtctaatggaattgaatagttcagatcgatggttgggcctgttgcaacgaggggtagcgttgaacagtggatagttaatattgatgaattattacaactgttttactgctttcaactaccgttttaaatgctcgctttatgcaaatgaaccgctctagctatcctttgattataccctgcatcatacccctattccggtatgacttgctgagtacggttgttgtactcagtcttgctccattttccccaaaacccccagagtttgagtacgtgtcagatggtggtttctccgaggagtaggctttgtccgtgtcgtcgaggatgcctgtggagtggcgttcccgctgcagttcaagtcaaggcttagctccatttatcttttattttttccgctgcatttatgtaagatttttatgatgtttgtaagacgtggatctgtatgtcaactttgtcgtttgtgtaccccggctggtcctggatgggggttttaatgcacattctacttggaattctattcgggaatttctgggtgtgacattctgccactgtcaaaacttggcctgattggtacaaaagggtattggctagtaaacaaacccactgagaagaattagggatttcacaatgcttagcccttactctagctaacatggattaggatgagccaatgatctcagctgctacttatttctggtccaataccttgaatgcattcttgttcaatcaaggaccgatgacctcatctgctaatcatgatcactggcttggacatcacctcatctgctaatccaatcagcatgaataccaagaacaaatttaccttaagaactagatccatcggaggttggtcaggtttcattgcccttaatatggggactggccctgtttctgctaaagagcttacaacttttctaatcatgtggctggaaaaatttctgttctgtgggccaagctatggtccaaccaccaactagcagcatatagccgaaactcttgtggataagagacgatttccccttgggaaatatttgctagggtatttgtaccaaactctaaatgctgcatcggctaggatagctgtcgattctgttgttggtgctggtggcccctggtggcttttacatgtttggctaaatccccataccatcaaagtatcacacatatcagacttagccgaagcagatttcccagctctagaaccaactgaagatgatgaaggaaatgaaatcacaactcgccgatgcatgtcttttgggaaagcagcctctacctatagtgaatgagattaatcggctgaattcttctccaattggttcggcaacttctatgatggatttccaagggattctaggatttggtttgcctatgaacactccaacaactttgaacatctagccgatttcagattcgatgagatcaactctgaaaaatatgataaatccagagaagtctttactatggctatttctccttgcatcctttctgtcggcatacatcaaggcaggaatatccaagtatcctatgagttataccatccaataagtgctgcaagacaacttgtaatgggccaactgccgatcggattattgtttgcagacaagatccagactagaggagagattacttcagcccttatgatggacagacttctaaatatcccagggccccctctaggcagcattgaagacattcaacttgccctagtcagaagtgcaaccttcgaccgatggtggattgagtggagaaaacatctctttcatcaatcggcttccatgtacctgaccaacatccatccagaatagattcctcaagtaagcatcttaaccgatcttctttctgcaaactgaaaattcttcaacttcttaaccatcttttcatcttattttgcagaccatagaatcttcgcctccacatgtcagtcaaagtggaatagatatcagatatgctgcaggacttttgcctaacagcggcagattcgctccttcaatcatcggctataatgctcccaagacgtctacactgctccacggacaatctcgcgagccaattccttctgaagctggcaagaggaagaggactaaatcatcggctgttgttccatcattcacaaagaagaaatacaaaaagcaaaaggctgcagctgctgatgatctgcccaatatcgaccctgatgtggagaagtttttaaacgatgaagaaatagaagaggctgttgatgatgcagctgctgatatcagtgaggcaagagaacaaatgccaccagccgatagtcatgctcctcaaagaactccaccgactccaacacacccagctcgtcatctgaaggtatgtacctatttggcatgttgttcttatcttgttctattagaattatgagtgccaatttctaactttgcagaaaaaactggctaccaagaagaaaccaccaactccgccaccattggtaactttgatctttctttatacctttacttgcctatgttaaactaattccatccttttcagcctcctcgttctccaactcctcctcgtcatgaatcaagcgagcatactccatcggctgtgggcagccaccatatcgaagaagaggcagcaccagctcctgctatccctataagaaccctttctaaaaatctataactcatatcagatgttatacaatttttcctaatcagcaatcccaatattgtcctttttaggttttagccgatatgttctcctttgacataaaacaattctttgatcaggaagaagaaatcaccagcctgcccttagctcttttaattgatgatgtcaaaacaacactcttggacattgcacatcggctagggagttctcttgattctcgagttgttgactgtggacctataagagcaaggttcgaggagatccatgatcaaattcctgacgatcaagctagaatcatttcccctgctgtatatcttgaccatcatcggttcaagctggaaaaagcaagacaaaggattgtcgataggcgtgaacgaaaagaacttgaagccacaattcaagctaatcggcaaaccatcaataaagacaaatcgaagcttgataagatgaccgtcgattccatacaaatctacattgatcggctgaagtctcgtagagcagaactcttagctgagctaggaaagaagccgagatcaaagttaaggaattccatcaagcatctgtcagatctgagcaaatccttaaaagtgatccctggaaccgatgctaccgatgcccaagccatagacgatatagaacaaattaggcaatgggccatatcggctattaacaagcttgtatcaagttagaaaccaactgtgcaatacttgtaatgcagacaaaaacatagtttgttctgatattttgctttagaaacccatcattgatattttgcttttgaaatccgtcattttacatatatgtatgcccccttaattttgccatgctgaggacacattgataaaattataattgtgctaagggcgatatgacaaatatcggctatcacatatcggcacgacaccaccgatataacttatatcggccatcatacattggtaaaacacaaccaactatgataaaaacaatgctaagggtgatataacttatatcggccatctaaaggcgatgttaacacatcggctaacatgtatcgacaaaactcagccggtcacgcattaatccaaacacttggataatatttcttcaagtatttcccattgagagctcgtccaaaaacttctccatcaagcccttgcaacatatcagctcccttcaacacaaccttgtatactcgaatcggtcctcccaattcggagaccacttgccgattttgttgtcacgagttcctatcagcagaatcatttccaaaccagctcaccttctgaaaatgacttaggcacaactttcttattgtaatggagagcaactcgttccttatccctcgttactttttccaaagcacgtaatctagattggaccagatcttccgtttcatctaccataagattgtaataatcatcggctgtcaatttatcttgtaaatctattatcctcgagccggtgacactttcccatggtaaaactgcttcatgcccataaacaagtttgtaaggaggaacttgaatcgatccatgacatgccatccgataggatgataacgcttcagctaattttgtatgccattgccgagggaaatcagaaatcttcctcttgatcaatttaatcaaactcttattagatgcttcagcctgtccattagcttgcgcatagtatggtgaagaatttaacaatttaatgcccatgatgtctacaaattggacaaactcatcggacagaaagattgatacctgatctgttgtgataatttgaggaacaccgaatcggtaaacaatatattctttaacaagttgaatcgcatctccagaatcaaccttcttcaatggaactgcctccacccattttgtgaaataatctgttgcgaccaatataaacttatgtccattgcttgaaggtgtattgatctgaccgatcatatcaattccccaacctctgaatgaccatggcttaattataggattcatagccgatgctggtgctctctgaattacttctaatttctggcaatcttgccaacccttatagtatcggaaacaaccttctaacatcgtcggccaaaaatatccaacacgcagaagcaaccacttcattttatgagccgattgatgagtaccacatataccttcatgcacctctcccaacacaaccttagcttgattggcactgaaacatttaagtaacacctcatcaattgtttgataatataattcatcatccaaaaaggcatatttcaaagctttataccgcaactttcctaaagccgattgagaaggatctttcaaatactgaaacacgtcatacctccagtcatcggttgtaatcatagcaatgtcgacctcaatatctttcaccatctgtttatatcctgatgccccctgagccaaatcgttagcttcaacattctgctcctaggagacatgcttcaaattcaccaaccgaaaaccattcatcaattctcggcacttgtcattgtaagtcattaatatatcattcttgcactcatactcccctgctaactgattgatcaccaacaaggagtcacccataatctcaacagcatcggcttcaacctctttcaatagttgaaatcccttgagaactgcctcatactcagcttaattattggtaacatagggcttaatagtataagcaaactcaaaactcgccccccattgttgatataataacaagccgaatgccacaacaatgggtgcaacggaagccataaaaaaataatgtccaaggtattatatcaccggagccgagtgaatcatcaggatgttcacaattgaaatgggctatagcttgtcccttacccgctttagcngattcatatctaagatcaaactctgtcaatgcatatatccacctcccaactctccctttcagaactggagccgatagcatgtatttgacaacattggctttataaactatggtgcactcattggaaaacaaataatgccttaactttctgcaagaaaaatatagacacaaacacaatttttccaccgacgtataccttgtctctgcatccagaagccttcgacttaaataaaagattttcctttccttaccttccaactcatggacaaaaactaaaccgattgacttctcatcggctgacaagtataacttgaaaggtactcctttcagtggagggattagaacaggaggggaactcacatattccttaatactatccaaagcttcctgctgctctgcctcccaagtaaattcctgatcggctttcaatctgagcagaggtgtaaaaggttctaacattccaaataaattagaaataaaccttctaacaaaattaaccttgccgatcaatgacagtaattgtttcttgtcctccagacgttgaatcttatttatagcattaatgctcctctgagatacctcaattcccctcttatgaacaagaaaaccgaagaattgtccagtcgacacaccgaaagcacattttgtgggattcatctttaaaccatacttccttgttctttcaaaaacttccctcaaaccgtctatatgatcgtccacttcctttgattttactaccacatcatcaatatagatttcgaccaattagccaatcagatcatgaaatatataattcatggctctctgatatgtagctccaacactcttcgtaccgaaagtcattacaacccactcatataaacttcctgaaagcagtcttatgaatatcttcctctgccataaaaatctgattgtacccagtattaccatccataaaacatataattttatgtcctgaagcggcatcaaccaactgatcggcaaacggcattaggtattcatccttaggggtagccttatttaaattccaaaaatcaatacaaaccctaagcttaccattcttttttattaccggaactatattagaaatccattcaacatatcggcatggccgaataaaaccagcatcatacaaacgagtaatttcaactttgatatcatcatacatatcagcttgacatctcctaggcggttgttgatatggccgataccctagtttaataggaagccgatgttaaacaatcgatcggctaagacctggcatctcgaaatattcccaagcaaagcaatctctatattccttcaaaagctctattaacttggttctaaattcatatgataaactcttactgatgaaagtcggccttggtctatctcccggacctatatcaacttcttctaaatcatcggctgacataaaaccctgtcctaaaatgccatcgagatcatctatagtatcttttttgtagaaatttgaaccctccacaacgccctcaaagcaataatttgggctctccatcttcaattggctgtatatcacaatcagacacttttagataatatccttcccaaacttttccagacaagcaatcaattccaactatttcccaaacatttaaatcgacactagcaacagtaactgacctgtcggctagcacgatttcaatcttgtcaccttgccattggatcaaactttggtgcatggtcgaaggaatacaacaatttgcatgaatccaatctcttccaagcaacatgctataggagcccttcccatcgatgacaaagaacgtagtaggatcagttttgctgccgatggttagttccacattcagcacccctttattttctgaagggttgccaccaaaatcattaagaaccacgttagtcttgataagatcatctgcattcttccctaattttctgaatgtagcataaggcatcagattcacag

SEQ ID NO: 61063 - DNA, 1772 bp, Oryza sativa
  unsure (1)..(1772): unsure at all n locations
tcttccaagcaacatgctataggagcctttcccatcgatgacaaagaacgtagtaggatcagttttgctgccgatggttagttccacattcagcacccctttattttctgaagggttgccaccaaaatcattaagaaccacgttagtcttgataagatcatctgcattcttccctaattttctgaatgtagcataaggcatcagattcacagcagccccaccatcaaccatcatcttggacatcggcttaccattaacaaaccccttaacgtacaacggtttgagatgccgattctctaccacctctggtttctcaaaaattgctcgctcgggtgacaaaaccaacttggcggaagcttcttccatatcagcagcatcggcttgattagcttcaaattcagcaagtaatatgaaaaccatatttaccgatgaagatgcaacagctttacccttcattaacctttttgctttgtcggcttcaacttcatcggctgttagaaccttactcttaacacgccactcttgccttgttttcttcagttgatggttgatttcctactgtacttcctgaaaacgctccctgttccttatcctctggacccttctcttctgattcttggtgaaaatgccataagggcaccattgcgaattcctgccctcatccttattctgaaagcaatcctgatgtatccgacccaatctctgatgaacaggcaactttttctatcttagccgactttcccttttataagatcggctcaaactccctgcagaatccctgttagattcactacatcctggacagtcttctattgacggtagtctcatctcttcattccaacaaaacctaaaaaattcgtagtcccaatgcggatcaaaaccaccatcatcttcacaatatttttcttcctgtctctcatacctcctctgatatttgttgataatcctaactgagttaagctgtgaattccgatgactcctcccatcggctgctgtcccagatgtatggaccatgttaacaggaaaaggatgatcatcaaccttcatcggcctctttgaatcatcaaactttatcttcccttgttcaatagccgactggatctgctgcctgaaaaccttgcagtcattggtagtatgagacccagtgttatgccaattacaatattttcttttctctaattcatcaaccgatgggattgagtggccagtaggaagttggatctgctttccccgaagtagtagattaaatattttatcagccttggtgatgtcaaaatcatctctcatctttccccgaattcttgaccgactaacatgttaaaaccttcttgtttctcgcccattcggctgctgctgctacttcggagacatcatcttcttcagattcagaaacataaggatattgttaacaccaaaatttggtaagcccgaagtcatcatcggcctagagtcagtatcggtttcagagtcttggaatcgaccgatgggaattatcaagttgctagcagtcggattcttggaggattcggttaaggaaattaatctattcaaggaagcttatccataagggaccgagttcaaggaggatgcggcatggcaatttatctattaattaggcagtatttgttagtttccttttatctttaggaaagtatgtttagtgtccaataaggacattatgttttccttttatctttagaaaagtttctttnnnnnnnnnnnnnnnnnnnnnnnnnnnnnnnnnnnnnnnnnnnnnnnnnnnnnnnnnnnnn

SEQ ID NO: 61064 - DNA, 11946 bp, Oryza sativa
cttcgaagacatcatcttcttcggattcaaaaacataaggatattgttaggaccaaaatttggtaagccccgaagtcatcatcggcctagagtcagtatcggtttcagagtcttggaatcgaccgatgggaattatcaagttgctagcagtcggattcttggaggattcggttaaggaaattaatctattcaaggaagcttatccataagggaccgagttcaaggaggatgcggcatggcaatttatctattaattaggcagtatttgttagtttccttttatctttaggaaagtatgtttagtgtccaataaggacattatgttttccttttatctttagaaaagtttctttcttgtccgacaaggactagtatttccccatgggtataaatatgtacacctggagtcattgtaaaatatatctctcgatcaatacaactactctcagagcatcgccaccctctttaccgaggtttttactaatcttctcatggaatttggcacctgacgcggggctgcatcggttcagtttgatctccggcgaaggggtaagtcctacgttccgctggccctggtgaatctaccggctacgttggtattgttctaggctgcaatgcttcgatctcttggatcgctctgttttggttgatatatttgcctatctgatatctcatttctatctctaattacactgtgtttagatacacatcggtttagttgggactgtctcagttaggtctgacctcctgtcttagccaatatatctcaacaatcacaatgctgatgtaaatagatttgttatatccatcacattagacaaatctgtcggctcatcgagcattagattatcatatacaatctcatgctgcatcggttaggcttaacctactagattgttgttgataatataagtcttgttaagccgattggttcatcctagtgttttatcagggtgctagctgataagttatctggacgttgcatcggcctataaggattacatacaagttgggtttagccgatcgcaacaaaggttttactgtttaatctaatcttgtggattttatgacatcagacctctagccgacgtatgctttaaccttcggatcagtccttattctattatgtcattgctagccaattggtttctactggattatattattgtcatattatatcatcatcagccgattgcctttatattgttatttagatcaagtgtcagatcctacattggacgtatagcggatagctcaaaatcgtatcgctatcggctggtatctgcatcggctggaattactccatcagcttgtcagccgatcggctgttttgtctactatttacagatcttgtcagttacagggtcaatctaattggcacgcctgcatctcaccaagatttagacctgcactggagctaagcagatctcccagggcagtgtgtgtttttcgcatcaacagatatacatgattaaccttcttgaagttctttttggcttctgcaaatctttgttcatgtagtgttaccttttgagccaagtgggccaaactctcaaaatcttgagcagagaatctctccttaattggggttgccaaaccttggaaagcaagatcggctaactgagaatctgtcaaagccaagctataacatctattcctcatgtccctaaacctctgaatataatctcgaacagatccatcatgcctctgtctaattgctgccagatcagaaagtttcatctcatgatttccactgtagaaatatttatgaaattgtttttccatatcggcccaactttgaacagaactatcaggcaatgaagaaaaccatgtgaatgccgatccagataaacacaaagggaataatctaactctcaaagcatcaatagccgatgcctcaccacactgggccaaaaatcggctgacatgctcataagtcgacacattattttgctctgagaactttgaaaaatctggaaccttgtaccgattcggcaatggaaccccctcaaaatattctggatatcggggttgatacaagttcccaatattctttggtttaagaccaaattgctccctcatcacatctgcaatcatatcagcccaaggcttctgttgaggcattccttgcatctgttgttgaatgtggtcaagctgattataccgaggcaagatgtggggctgaggtgatccccctggctgatactgtatctggggtgaataaggctgatactgaaagttcatattaccaccagcataatgttgaggagattgatgcacattatgaacttgctgatcaggaataaactgagcaccaataggctgatgttgctgtacaataggtgtttgctgcccaattggtatttgctgaatcgggtcaacaactgattgcttccccttaaacatagaagcattctattctggggatacttgaggtatattctgccccatgtgctgaggttaaggtctaaccagtacatgaggattaaaccctagctgtccttgtgctgacgttgatgcgcactgtttcccaaaagccgaagttgatgccatcggctgctccggtgctataccagaaacgggttgttgtttgccggtcactagattcctatatggaggaaacacgccatcaggaagaaaagtcggactcttagcttgatgtttggcaattgaaccatcaatcacagacttaatcatgttagttaaagtgttgacaagcacccctgactggttgataaatgcatgataaacaacataatcaatctgatcctgcaagttcttgaactcttgaggctcttcttcttccggtttttcatccttgggtttgtcatgtttgggcttgccatctttggtggtacttgattctaagtcatcattggatggcactttcaatttatacctttggataaccgtacctaaatgagtttgcacaaatgaatgtaaaaactgattctgcaagttgttcatcatctgctcatactctgccttttgttctggtgtaagttgatccattgttattgggatgatattctcagggtcaacctcagtttgcttaatgtcaaccatggtgaaagcgttacaactcgtgtccctctgggcgtgccaaaagtgtgttgatgcgaaaaacacacactggcctaggagatctgcttcactccagtgcaggtcctaaatcttgcttttgggttcaaaggcatgccagttgatttgatcctacaatcaacaagaaagaaaaccaagaaaaacaaagttaaatccataaacgatagccgttcgacaaagggccaatcacatatcgttaaccgctgagctgatgttattggcattagatcagcaatgaagagtaaaacgaaataaagtcaatgctcgatcgactgtagatatcaatgatatgtaatttccttctcaagatataattaaaccaagtgattgggatagatcgaccagctagtcgagacagtataaatcacttatgcttaaaagtactttgagatgaagattatatgtatattcatagcatagccgatcaaacatatctaacatgtatcggctaatactccgataccactctatatcaagatattaaaacaagcaaaatataccaactagtaagccgaatatactttaatgcgataagatcttaatataaagggcaggtttagcatatcaagtaaacatgtagggaataatgtagctaaatcaggtaagatcgggtaaaaccccgatactatccctatcgataatcataaaacaggttagatattgtatttatggatattaattaatagatcgaacttaaacgatgcagcattaagcacaatgataatcacaagatctaggccagttgatgaaaatctatatgagatggtagatatgttatataatctagatcaataacgatatctaactctatctgctgcctctaactctatctgctgcctccgagtaacagatgctggccgatttagggttagattataataccgatagagattatgtagcatatatgataactcaacaatttacataaccaagattagagtgtcactaatcccgagaacgcaagctgccataacaagttttttacgtcttgttgaagatcgaaaccgatgcagctcaacccgaacgcaagaactcgtcgaaacaatgaaaaaaaggatggcgatgcgccgaaagtgttattgaactgtcgtttgatgtttacatggtctcggtcatatttatacccaaagtacataatgtattcttgccggacgagaatctaaaactattacaaccattaagatgcgaacaagtctcttaggtagactcttgccgataaatatctctaaagaaagtattcaaaatatcctaattaatagatacaattgcctatccgtgagcttatctcaatcgtggcaatgcttgcgcagcacgttgatcaatcccggagatgattatataaccaccttggcgagatcggctgcatcggctgtcttctgtccgatccatcattagccgatgctatcttcagccgatgcccctgtagccgatgcatactctgttttcgagaacatctcctttgccaaatccgcttcaatcttaaccttgaatctgatacttgctctaaccaaatttggttgtcaacacacatttgttttcctttttaggaatcctaatcctattcggccaccgcccctctctcctgttcacgcgctccccgcctccccttggcccatccgagtcggtctcccctccctccccctgccgactctctcccctccggcccaacctcttttatcttcacccatatataagtcaccctacccctgtttttcctattttctttttgttggagttctagcctagctgccacctcaacatgccgccgtcgcccttgcactgtccacggctgccgtgtcacgcccagaaatttagcccgaaatttccagactattttgtgtattaaatccctgtctaggaccagctagggtacgcaaaatgacaagtaatatacagttccaaacgtaaataaagcgtaaaatacttacagaagaggcacttagtcctcacaccgaaaagaaagcagcggcagtggaaaaaaggcgatcctagtgtggcttcagctccactccacaggcaaaacttaactggggtctgagccttggtcctctaacttcgtcttcagctcaaaagcactacacttctaaaaagggggaaataatagcaaggctgagtacaaccaccgtactcagcaagccacaccaacgatgcagacgtgcaaggggaacacaaggacggtttgcggctatttgcataaaggcggttgtaaaacattttattgagcaaaacagtaaaactgttgagtgattatagtaatattaaatctccactgatcaatgctacaccacgttgaacaggcccaaccaacccacctgaactacagtgcattgggtcgatttattaagtgtgagactaatcacggtgaatctggtcgatcgcccataaccgcgggcgcggctactcgaatagttttactctggccagaggtgcacaactgtacccacaagacacaatccaccgacatgtcaccacgtcatcatgtacctatgatgaacacgtcaccacgtcgagtgattgtgacaagacccttcatataactcttccgtaaccatccacaccacgctaaggtttcacccccaccccctgccccggaggtgggcagtcccctcgtgtgccgtggtgaatccgacagctggacaaccggacaccccgcccaacccaactccatcatgccccccctcgccacctatgcctaggaaagggtctagctatacttcagatcaggcagttacccactcctgcttgtggtaagcactgtaagtcttccagggtttcccgtgaaccggtccttaattgccatgggtccgactcgcaaaactatgcacccatagcccaccattcagtcgcattttagttggataattatgaccatgaaacatggccagatgtctcaagcatgtagctcattttgatactaaaaaggtctaatactgcaattataccatcaactgagctagtggtaattaagcatggctaagcatatagttctagctaggtcacataagtaacatgatgtcacatcctgattttcgttttaggatttataaattatctaataaattattattagaatttatattaaatgttcattaatttacaagtgaagttaaatgtgggaaataaaatttcctaaatttaaagcatggatggatttaatttttattaaattctccatgattaattgcactctctgaaattttctcggatttttcagagctcaattcctaaatgatacaaagaacagttcagtaattatttgatcaataatgatctaattataattgttaagagtttttccttgtttaaaaaaatccttaaattataaattgttgtttaaaaggaattattagaaatgatcttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgcatttaatgaataatttaaattgaaaaaggtttttaaaagtctcttttggctttgggccgaaagtcggcctaaaacctctctctttctctctctcctccccgacccaagccggcccgcatccgaggcgcgccccttcctcctttttctcagtcgctgacaggtggaccccacctgtcagtcttgtcttcctcctcgcgccgccgccggccgaaccctagccgagccgcgccgccgccgctttccaattcgctcgcccctttcccgatccggtgaaatcaatagtggggaaatgatcatctcgatctcctcttccttttctcttttggaaacatcgcctaattcggtttggaaactcgtggattcgatctcgaatcggattcatctctctctccgaaccctaacctttccttctcgccgccggtcgccgtgggccttcgtcgccgctcgctagcccctttataagcacccccgagctctcctctatccgccgccacctttgccttagcccgccgtcgcgtctagcgccgcctccgcgtagccctagccgtcgccgttgttgccgtcggttcagccgcgccgcgccgccgttgcagcagccgtcgtcggtcgccgtcgccaacatcgggttcgcgaggtcgtcgccgtccccgtccaccgcttcgctgccgccgaagaccgccggagcaccgccgtcgtcgtcgacccgaagactgtcgccgcttcttcctcatcgccgccgccgtccgttgctcttccgccgtggttttggtcaccggtgagttcgccgcgtcgccctctacccgttggtgccctccgttcgcgtcctcgcgccgtcgttcgccggcgagcatgcgttgccgagccgccgtcggtgctgacgtcatcgctgacgtcatcgtcgctgtccccgtagacccgacgtgaaccgatcgatctcggctgtccgttttggatagggtcgatctctgtcgcgtctcaaaacgactctaaaatacatcctcgaaattatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagttctaaaaagtcctttttcccccctccccctcttgggccggctcggcccatctctttccctctctctcctcttccccgcagcccattcggcctcctccccgcgcgcgcgccgctgacgggcgggcccgcccgccaccctcgctgacgggtggggcccacccgtcatccccttcctccgccgctcccgccaccccggcagcgccctagcgccggcgccggcgccgggaatcccgcccgccccgtccggcccgcgtgcaatcaagaggggggaaatattccccgggatcccctccccctttccccccatttttccctctctctctccctcggattcgtttggaaactttccccctaacctcgccggcgccattaatggcggccgggactcccgcgcccgtttcccccctcctccggccaccccttccctctcttaaccctatataaatcctccccgtgcctccctccaccgtttccgccactcgccgctctctctccccaccggaatcgagctcgcgccgtcgctctctctctccgccgtcgccgccgagctccggtccgccgccgttgttgccccggaccacctctcccctcggcgccgcctccttcggcttcgccgcatcctcgccgacctcgtccacccctccgtttcgcacgccgaccgccggagcaccgtcgaccccgtccacccgagccgcgccgccgccttcctccgctccggtcgccgttcccgtcgtcgccatcgacccggggtgagccgtggaccgccgattcgattcccccttccctcccctctctcggccgccgctccgccgtacctatggccgccgccggcgaccataggggcgcgggcgcgccgcctcccgttggctgtgccggcgtggccgccttcgggcgcgccccgcggctgccgtgtggggcccggctgtcagccgcccgcgcccttaggtgcagcagacgcgtgggacccacggcgccggccggtgcgagcccgggtgcgcccggtccaccgtgggccgtggggctgccgcgtgggccccactcccgtggacccagtccgtgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatacggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcctagtttataaaattatgttgctttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatgataccactagtatgattttaggtagattcttcgctatttaattaggtaacattaggtggtttttcaactctatactttgggaatattcatatcacctggacactatggaatggtttgattattgtggaattggattcacacctccccctctattcaaaaccctcaaaatggttttaggctgggttcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggataaatgaaggctacacgagctgcggcccggtagtcgagatgtcatggcacagggccggtgtcctgttgctaggggctcagtcctgcctacctgtcccgggggttccggccgtaggtgggattgggtcggtactcttttctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttattggcaagccgagcaatgtacccaagttagtgttttaattcttaaaacctgcttaacaactaaaaggaggaatggttggcctgggttggcttgggacgagctgggacccaaggtcgggttgccggttcggtctgaatcatcgtaggccttgggttaaggcaggttcgtgtgggttcacggccttgataaataatattgtatagttctagaatcgtgtttacaaaatagctttgagcaactaagtgtcttttaatgctgtttactgcaaccctaaccctttatattataactcccttgtactcccttgcatttattatgcacttgtgggtgtgtcttgttgagtacggtggttgtactcagtcttgctcaatttttcccaaacccagaagaggagtttccggaagatgaagattttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttgaactctgagctgtatcaacttttggtgtaccttgcctcctgggacaaggaataatgcacgcacgtaaggaacgcccgttgggttatttccggttgtgacaagttggtatcagagcccccttgaccctaggacgagccttagatcccaagccttagcaatattttcaaaactaaaaatcctgtcttaattgtgaaaaccctctagtctctctctgtcctgctgcttcatttatcgccaaaatctgacttttaaatgttgcttttctttttgtttttgtttgtagatggccggcagcatcagccgtcgtggtctggacctgactggtttcgtcttggagctgcggggcatgtgcgttgtcctggggtatccgcatggagtggactaccagggcaggccgctcccggagcaggagggtgacgatgcagagccccacgctgcttgggaggttactgcagtgatcctcactggctcacccgagaggacttcgttggcagtcaccgcgggtggagattctttctccgccgcttgccagaacgccactctcctcgccatcggcactcttcaccagcgctacccggacgagttgcagcactcgcccttccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagctgcatcagctcaagatcgcccagggagaggtctgtcgccccaagcgtcgccgcgtctgccgcagccagaagatcaccgcccgcaagagcacctccaggcccaagcttgttcgtcagtccctggcgtggacttgcttcgttgagacccctcgtgccgagcccgcgcctgtggttcctcaggagggggaagcctccggcgttggtagcacggaggatgcgctgttgctcaccttccgtcctggcccgtcgcagcggtagacgagcagttagtaggcttgcgcgtgtgttctttctcgtttgtcctcttgttggagtcgtgtggggcatggttatgccggtgtgtggcataactgtgtcggagcctgtctttattttatttgcttaagcaacttgaactttaatgaaccaatttaatagcagtaataaattcaagaattatagtagtcgtggatggttagctttagggtaccgagctcga

SEQ ID NO: 61065 - DNA, 4709 bp, Oryza sativa
ccaccaccaccagacaccaacgccattctcacccaaaccctcgcccagcaggccaacatgatgactgctttcctccaccacctccaaaatccgccacaacagaatgctccaccaccacccccacaacactttaaactcgccgagttcctccgcatccgtccacctaccttctctagctccaacaaccccgtggatgcgttggattggttgcatgccgtggggaaaaagctagacaccgtgcagtgcagcgatgaggagaaagtcgtcttcgccgcccaccgactgcaggggcccgcatctctatggtgggaccatttccaggctacgcagccagaggggcagcctattacttgggcccgcttcaccgccgccttccggaggacccatgtgcccgccgaagtcatggcccttaagaaaagggaattccgagagttgaagcaaggcaaccgctccgtgatggagtatttgcatgagtttaacaacctggcccggtacgccccggaggatgtacgggaagatgaggaaaagcaggagaagttcttggcaggaatggaccctgagctgtccgtgcgtctagtctccggtgactatccggatttccaacgtctggtggacaagagcatccgcttggaagccaagcacaaggaactagagtcgcacaagcgccgcttggcgaatttccgcaatcaacagggtgctaaccaaagggtccgctacaccaatccctatccagggggatcgtcctcgcagcagcaacagcagcaacaacctcgctccgcgccccgacctcaattcgtggtgcgcgtcccacagccgcagcaacagcagagtcaacaagggactcgtgcgacccgtcctcctatgccagccgtgcagcctggtcaaggccgcagggacgttcaaggtccgcagcgtctgtgcttcaactgcttcgagcccgggcactttgcggataaatgcccgaagccgaggcgccagcaaggccaaccgcctccccgctccaacaacggtggtaaggatgtcattcgggatcgtgtgaaccacgtgacggccgaggacgtgctgacaactccagacgtcatcgttggtacgttcctcattcattccatccctgctaccattttgttcgactctggagcttcccactcgtttatatcggtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattcttctagacaccaagaacttggatgtgatccttgggatgaattggttggctcaattccaaggaatagtggattgtgcaagacgcactgtcactctgtaccgagggccggaacaaccggttgttttctttgcacccccaacctctatcagtagttcagaacttcatcagataggactgtcagaaatccccatcgtcagagagttcggagacgtgtttccggaagaactacccggtatgccgcccaagcgagagattgagttccggatagatctttctccaggaaccactcctctgtacaagcgaccctaccgtatggcagcaaatgaactggccaaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccacggtattctccaagattgatcttcgttccggatatcaccagttgcgcatccgtgaagaagatattccgaagaccgcattcaccacgcgatacggactgtatgaattcacggtgatgtcattcggtttaaccaatgctcctgccttcttcatgaacttaatgaagaaagtgttcatggaatacttggataagtttgttgtggttttcattgatgacattctggtatactcacaatcagaggaagaccataagcaccatctccgtctggtgttggggaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaaattcgcagtttcttaggtttggcaggatactaccggaggtttatcgagaacttctccaaaatcgctcgacccatgacacagttgttgaagaaagaagagaaatttgtgtggagcccgcaatgcgagaaggcgttccaaactctcaaagaaaagctggtttcctcgccagtgttaatcttgcaggatactcgcaaggacttcatggtgtattgtgacgcttcgcgccaaggattggggtgcgtgctcatgcatgacggtcatgtggtggcctatgcctcacgccagctacggcctcatgaaggcaactaccctacccatgatttggagttagccgcggtggttcatgctctaaaaatctggcggcactatctcattgggaatcactgtgaaatatatactgatcataagagtttgaaatacatcttcacccagtcggatctgaatcttcggcagaggagatggctagaactcatcaaggattatgatgtgggaattcactatcatcctggtaaggccaacgtggtcgccgacgctctaagtcgaaaaagccattgcaacactcttaacgtccgtggcattccacccgaacttaaccaacagatggaagccctgaatctaagcatagtgggtcgtggattcttggctgcgttggaagccaagcccaccttgctcgatcaaatccgcgaggcttagaagaacgacccggacatgcatggactcctcaagaatatgaaacagggtaaagccgctggtttcacagaggatgaacacggaaccctatggaacggaaatcgggtatgcgttccagataacagagaacttaaacaactgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaagcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacggatggacagaccgagcatctaaatcagatcctagaagatatgcttcgcgcatgtgtcctagatttcgggaagacctgggataagagtctcccctatgccgagttctcctacaataacagctaccaagccagtatacaaatggcaccttatgaagcgttgtatgggcgcaaatgccggacaccgctcttgtgggaccaagttggggaaagtcaagtgttcgggactgatatcctgagaaaagctgaagcgaaggtcagaaccattcgggataatctaaaggtggcacagtcccggcagaaaagttatgcagataaccgtcgccgtgacctggaatttgcagtggacgattttgtgtaccttcgggtcacgccattgcggggtgtacacaggtttcagacaaaagggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccaatggagcaaccacgccgaggaagaagctacctgggagcgtgaagacgagctgaaggcagcccatcccgatctcttcgctagttcttccgaatctcggggtcgagattccgtttaaggggggtaggtttgtcgcgtctcaaaacgactctaaaatacatcctcgaaattatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaagtcctttttcccccttcccctcttgggccggctc

SEQ ID NO: 61066 - DNA, 4831 bp, Oryza sativa
gtgtgggtccgggctttgataaataatattgtatagttctagaatcatgttacaaaatagctttgagcaattaagtgtctttaaatgcttgtttactgcaaccctaaccctttatattataactcccttgtactcccttgcatttattatgcacttgtgggtgtgtcttgttgagtacggtggttgtactcagtcttgctcaatttttcccaaacccagaagaggagtctccggaagatgaagattttggtgcctagctcgtgcctgccgtcaagcgcctgtggtcgtcgccctagtcttccgctgtttctcgtttgtctttgtgtgtgctgggccttcgctgcccatgtaataaattaactatttacgcttccgcttgttgaactctgaactgtatcaacttttggtgtaccttgcctcctgggacaaggaataatgcacgcacgtaaggaacgcccgttgggttatttccggtcgtgacaatctcggccgttcgtttccgtgagccactgccgtgcacccggtccaccgcaaaccctagccgctgacgcaataattcccttttccttttcaaaaataattcattattgcgtcataattcaattaaaatctatataagtgttttaatccgatttaatctttaaaaattcataactaattctttgtaactcagtttaatgtggttcaagttgcaaaaattatataaaataaagatgtacatattaaaattatccataaattgaattaaatttatttaattctttttaaatgggctttaaatagatttaatctcgtaaaattcataataaattcatttgaagtcagaatgaggccgttcaagtctcataattcatctaaaattatgatctacatgtttgtttactttatatgtattgtttatttgatttttattagtctttttcctcattttgcatgttagcttgtcgtttccgtcgttgcgaaggttcgcgagtgcgtcggaagtgttcaagaagattaattgaagaccgattattgcaaggcaagtcacacagatcctaaacacaattcctttgagcatgttgatcctatatttaaattctctatttatttcaactgtgcatttattttcgaatgtcaccgggtggtgtgaacttattcctttgttatggccaatttatattgattactttattccttgataccttgggttattataacttgactagttgagctttatatattggttcagctagatattagatatgattgcttagccatgcttagaaacattagcacactattgggataacttatgactcattattatttaatgatggcttaatgatagttcacgatggtcaatcgtgattggttaattaattacttgccaactaaaacctgataatggtgggttgtgagcacatggttttgagagtcgtgctcatggcaattaaggaccggttcgcgagctactgttgtgaaacattaaccgtgccaaccacaagccagcgtgggcaacggctttatcttttgtataacatgattcattgcggagcaccagactgagaagtggcggagataagcccacgggggtcgctggggagtccatgccttgttttataagggggtgattatgatccaggaatggtgcgctgtggtgagttgtgttgtgcagagggtattgtcacagcctctattcgggtactttccagtatcgcgacgcatggtagacatgatgttgaggctgtgtcttgtgggtacagtggtacacctctggccagagtaaaactatttgaatagccgtgcccgcggttatgggcgggttaagcaatgttttccgtgattagtctcacacctctcacaataattatggatgttattcctggtaataatttgcttagctcctggtttggagttagatctgtccacccgggtatggttattcaggatggttgggcctgtgcagcatgggtgtgttgctcagtgttgattaaaatttctgattaattactccactgttttacttctcttaaatgttttgctaaaggctacttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttattttccgctgcagttttcttcatgaagaggactaagtgcctcataagtaagtatttatcgttatagttaatttgatggatctgtatattaaattgtcagtttgtgtacctcggctgattcctggacgaggattttatgcacaaataagttcggaaattactagtgaatttccgggcgtgacacatgagctagtcgatttatcacccaaggttgacaaaggacagatatcaagtaaacatggcacaagcgagcagattggtaaaccctgatcccatgtaattagcaaaacatgcatatttatttgcaaacgggaaaacatttaaaaaataggctcaatatgctcaaggggaatgtgtgacttgccttgcttcttcactttgatcttccgaactcttttcctcgcgaccgcgatcttccgaaacgacagatactacacgctgccacgcaaaacgaggaaaaacactaataaaaaccaagcaaacagtacataaaaagtaaacaaacatgtagagctcaattttatatgaattttgcaagttgaatggctcaatttggagttcaaatgaattaaatgaatttcaagaattattaatgatttattgcacaattattaaatattttctcaaaggaaaagacaatcgctgacattagcaaggggcggccggtgccgacacgcgggaacggcagcgagcggcggctggaggcacggcggcgagcggcggagcatggggtcacgcggggagcacgagagagggcgcgaggagctcgggtaaatgggggaaacgagcgaggggaatgcggggaggagttttatagcgctcaggggcgacggggaggccgggcgagatggatttggggcggcaaccgctggcgacgtgggcgacattgtgggcgaagtggagctcgatcctggcgcgatttttgggggaaacgtcgggagagtgtagaggccgatttcactcggtttgggcgcgagggtgtgagcgggagaggcctgaatcgggggcgacgtgggcggcaacggccggccatggtggcttatgctctggagaccgaaggtagaggaagggcctgacaggtggggtcgccgggcccacctgtcggggagggagagagggaggagccccaaggggaggggttaagcagacttaggggtggaggggagccgagctgggccggcccaagagaaggaatggggcgcgctggccgcgggagagaaggaaggcttgggccgaaaaaggcccaaagagaggaaggaggattttatttgtttttctttttaattaattgattaaatgatctttgtgcttattaaaattatttctcgagctccgaaaattcacggaaaaatccggagagtgtattagggcacaaagaatattacaaaatattcttggccaatgatttttaaaggaaattttaattccctcaatatttcacttgattaaattgctttaacttttatttaactagtgagcgtgcacgtgcaaggcacgttattacataaaattgaagaaaatataattagtgtacatcattaaagaatcgtagtaggaaccaagtaaaaataatattattgtaagcgatacattggtaattcatgaactaaaccttaattgtttattcattacatgataaccaaatgcaaaaaaaagtaatatttgtttgtcattatcgatttcagttcacttccaaatcaatccctctcaggagatgaggtagtgccagcttcgctcggttctaggttgattgccctacatattaaggcaatcttcacctgatcatggaggacgatatcgtttattaggtcgtctcgaacatctggatatacatgtatataatatgatgcatttagtattatgttagtctgtacattgagcagaagaaatgaaatacgtgtatgtacctagaagaggaccgtacatcccattgtctggccagtttattttaggcattataaaaatccaaagagctaatgcaatagaggttaattgacgacaattgtaaaatgtaaaaaagatacttgtatgatgacgcactgtagaacttgtgctgaccaaaagtcgtagaatcaaaaaaaatatatataataagcaagaatcatctcttctaaaaaatctttgcatgtaattattcttcatgccatcgttacatcttatctaacattgtatcatatagctttccaaaggccattttgacctgggcttagataatagggacatactcacatacacatatgaattagctaccatgcctgatactatagttgacattgaagatagcgctgcattatccagttttcgacaagattgtaatagtcgaattagactcggttttctgagctagagaattggtccggaactcaaggaaagaagctgcaatcaaaattcattcccattttccttgactggaatttaacaatgggcacaaacacaagaatgcctatggacaataaagatataagctggaaggagataacttctgttgtctaaaccagaagctaacaatgcaaagtaccacgtatgaagttttgtatcatattttacacgagaaaactggtttcataaccgaaatcctttccttccaaa

SEQ ID NO: 61067 - DNA, 1034 bp, Oryza sativa
cccaaaagaattggagagagaaacacctatttaagtacaattctacccttcaatttttttcttttttctttattgttccttatcttttctctctctcattctttctctatttctatttgctccttattcaagcgagctcgaggatggcagtgcagcgaggtgcgggccggtgcggtgccttgactagggagacccagcgcggttgtgcgcgggggatggggcctacttggtgcggcggaggtggcgctagagtaggaggggaggtggtgccgacgcggttagcgttgtcggcctaatgctagggcagctgtggctgcgaggagagcagctttggcctagcgggcacagggcaactgcgatgaggagtccttccctgtcgaggaccctccccctgttggtggtgttgcagcagccggtggtgcccatgacggcgggtgtggcctggatggtgtgcacggaggagatcgcggtagcggacgccgtggtacgtctccctgtgctacatcttcctgtggcgcaggatgtgccgcgccgatttgctgaccagcgacgacgctgccgtggctagacatgacgtgccgtaagagctcctcggcggctacctctggccggccgccggcatcgccgcatcgcgccgcgctctcctagcgccgccgcactagtgccgatgcctggccgagctcttcctccgttcggccgcgcccccatcacaccggcgctgccaccgctcgttgcgcccctccggcctaccactctttcatcgtcaccatcctaatggagattttttttttggtgtgtggtgatgcgcaggggcaatcttggtattttgaaaaaaattctcaccactttaagcaaggaaataataaaataatacgtccagtgtcctacggcaaatttcacagtttttgtagtgccttgggcagtgtcacgttttcgcggtgtcgctcagctaattacacaatttttacgtgtcctgtagcaaattttgcgtatattgaaggtccatctatttggattgatttttaatatattct

SEQ ID NO: 61068 - DNA, 10281 bp, Oryza sativa
cgatgattggcgcactcgagggttcggcggaggtcgacattgtcgaaggtggagttgtcgccgcaagggggttcgcctgcgaagtcgccggagaactcgaggaaatcgccggagaagattggggaaagtttcggttggggcggtgaaaacggaagtgacgccgtgaaaatttcaaagcagtggttactatttaaaagaggcgcgataacggccgaaacggaaaggaaaccctagattcactcgtaaacgaaattaagcaaaatccgcaacattacgaatatagcagacttggggggcatttgttgacgaccaaatttggttagagcatgtatcagattcgaggttaagattgaagcggatttggcaaaggagttgttctcggaaacggagtatgaatcggctacgggggcgtcggctgaagactgcatcggctaatgatggatcggacggaagatagccgatctcgctaaggtggttatataatcatctcctggattgatcaacgtgctgcacaagcattgccacgattgagataagctcacggataggcaattgtatctattaattaggatattttgaataatttctttagagatatttatcggcaagagtctgcctaagagacttgttcgtatcttaatggttgtaatagttttagattctcgtccggcaaggatacattatgtactttgggtataaatatgacccgagaccatgtaaacatcaaatgacatttcaataacactttcggcgcattgccatcctttttttcattgtttcgacgagttcttacgttcgggttgagctgcatcggtttcaatctttaacaagaggtaaaaaacttgttatggcagcttgcattctcgagattagtgtttacatctttatgacactctaatcttggttatgtaaaccgttgagttatcatatatgctacataatctctatcggtattactcggaagcagcagatagagttagatatcgttattgatctagattatataacatatctaccatctcatatagattttcatcaactggcctagatcttgtgtttatcgttgtgcttaatgctacatcgtttaagttcgatctattaattagtatccataaatacaatatctaacctgttttatgattatcgattgggatagtatcggggttttacccgatcttacctgatttagctacattattccctacatgtttacttgatatgctaaacctgccctttatattaagatcttatcacattaaagtatattcggcttactatttagtatattttgcttgttttaatatcttgatatagagtggtaacagagtattagccaatgcatgttagagctgtttgatcagctatgctatgaacatatctatataatcttcatctcaaagtttttttgatgggaaacaacaggagagactcctactgtgctatattataataataaataatttacaggggtatgtacaaaatcttcatctcaaagtacttttaagcataagtgatttatactgtctcgactagctgttcgatctatcccaatcagttggtttaagtatatcttgagaagaaaattatatatcattgatatctacagccgatcgagcagatttaactttattttgttttactcttcattgctgatctaatgccaataacatcggctaagcggttaacgatatgtcatcggcctttagtcgatcggctatcgtttgtggattttactttgtttttcttgttttcctttcttgttgattgcaggatcaaatcaactagcatgcctttgaacccaaaagcaagatttagggcctgcactagagtgaagtagatctcccaggccagtgtgtgtttttcgcatcaacaatatggtgttgttttaggaaaagaatggaaacggtcttgcgaaagaaaatggacacggctcgctatgcaaaacaaaaccgcggatagagaggggagtgaattgggcacgattcatgatcaaaggtgtgagagaaaaaaattaattagttcaactctcgacaaattaatttaaaaacattaactccgatgctctgaaaattctgctttaagtcctgttagcgattttagagcaaagaaaatttgaaaaaaaattctccctgacaattcctattattaaatgcattgttaatttgggttttctcctaattaaccaaagtaatttctttaaaccaaagtaattgagccgcagaagtagaaaaataaaagaagtaattgattttgaatgtattgttttacctttgtccccctagcggtcacaatacctttggattttttccttcccttatcctctcccttccggcttccccctatcgtcatcttctctcaacggctagggaggtactccctccgtttcaagttataacaaattttaacttttagtcaaagtcaaactactacttcaagtttgactaagtttatagataaatataataatatttttattaccaaattagttttattaaattagtaattagatatattttttataataaatttatctttggtcgaagatattactattttttataaacttgtcaaacttgaagcggtttgattttgaccaaagccaaaacatcttataacctcagaacggagggagtagcagagaggagcgacgacggagaagtgagggttagaagcgacagcagcagcccgcccaagcgatggcggcggcaccgcactaggaggaagctacagcggcggctcagtgtggggtagaggcgatggtggtgacggctctgcgcgaggaggctgtgaggggaagaagcgatggcagcagcccagctaggcaatggcggcagcacagcagctccgcgcgaggaaacgacagcagcggctcggggtggaggcgatggcggcgacggctcggcgcgaggaggaggcgatggcggcggtggctcggtcaggggaaggagcggcggcgcggcggctctacgcgaggaggaagcgacagcggtgactcgttggggcgacggcggtggctcggtgctgaggcgatggctggcagcggctccgcacgaggatgggtcggaggtagcttgccacgggttggagatgacagtgacgagcgggccaagaggcgatgacggtaacaacacactaagggtacaaatgtcttttcgtcaaatgtttaacacctttagcctgtccatccaaagtagttgtaatatttagcttcgttttaaaaaagtaggggaaaaaataaaaaccctaaaatacaagggtaaaatcaatattaaatatgaaagtaggggtaagaacgaaattgcctcaaaaaatttcgaatcccggtcggtcaggaactcactgccatccaaaaaatttctactttgtaaatatttgtaacaatttgtaacccttatttatatattttaatatattgcattagaggctctcctcctgtttcccgtaaaaaaaaaagggaattcactgccatcgttattatttggacacaatcggcgtgaggaacaagccgcccacgagaaggtccaggaaattgctcagcgtagagcgtcctattaggtggataaaaatttgactgtacactactgtacgcatgcaagtatagcacagactagtttattggagaatgctgtgtttagttcacgctaaaattggaagtgtggttgaaattagaacgatgtgatgaaaaagtttgaagtttatgtgtgttggaaagttttgatgtgatagaaaaatttgaagtttgaagaaaaagttgggtgtccgcccgcctcttctagcgtgtactggtggtctgattggttcttctctactaatctgagtgcacgtctggtgcccgcccgcctcgcttcacctcttctagcgtgtactagttcattgcttattcacatatttttttcttctttcaatattttcctttagaataattatacaatttacgattcaattgcaccgtcatatttcttgaattaaatatttataacaagacctcacacgtttctatttcgatgaaaaaattgtttcacccgttaaaaaaaattatttcagttcacactataaaatgttttagagatatgcgacatttagaaaatactaaatgtcgcatatctctgaacgagtgagacattaaaaaaaagttgaaaaatacaatttatttgcaaatacttaacattattgtaatatttgtgtatcacatacttttcaaatattataaaacattaggtgaacaatgcaaacaacaacattgcaatatttacaaattaattagtagctaaaatactagttgaaacatttaaaaaaactatgtgcaacatttaaaaacactcactagtagctaaatttatttttcatcataatataatcatatgcggtcctgttataaaaatttatttataacagatttaatggtataatcggattgtaaattggatatgtaatttaagagaaaaaatagtttaaaattaccaaaaaggacttgaaccaacctaagcaaccctgctttattcttatactcagtgcatgcatgtagagtttttaactagcatgagtgttggttttgatgtgcacctgaccacctataccgacagaggcctgggtgtggtgctcgatccatagtagcttcgggatagagcgcccaataaaaatcagattgtacactacatgcatgcaagtataccatattttttctcctaaactacttattcaatctacgaaccgatcatcccgttgtatttgtcacaattaaatctttacaacaatatattatatgattatattctaataaaataaaaacatatgtttcaaatcattaaggctgtatttagatggtggaaaagttgggaagttgggagaaagttggtagtttggagaaaaagttggtagtttatgtctgtagaaaagttttcgatgtgatgtgatgtgatggaaagttgggaattagggggaactaaacacggcctaaaactcaatgtttcaatgtgttttattcggtgtgttctatgaaattcactgaactacctgccactactctctgtctcctctcttcactctatgcatgcattttagcgatttttaaaatgaattttctcccaaactatttatccaatctaagatccgatcaaaccgttgtattcgctgtaattaaatctttacaataaaatatcacatgactatattttggcgaaagaaaaacataagtttcaatcctttaacactcggtatttaatacatgatagtgatatatttcaacgtgtatcttcgtcatgtttcataaaatttgtaaatgtctcagttgctattttttttatttcaccatactttatgtttcatgtatttgtcaactgcaacatttgaccatccgatatttttttaaggaatcgggcgaccgatccgtagtttccttctttctagagaatgattgctaaccgaattcccagaaattaccatgaaactgcaggctatatatcataaatagcaaaagcttaaagcattatttatgtcataaatggcaaaagctaaaagcattatttacctatctcagctatccctggggaaattaaaaaaataaagagaagaaataaaagagtggccggtggtcttactatatatgcaaagatatggagtatataccaggaatcctgccgctcgggcgaccgacgcaaaaaatgtttcacctaggtactcacaatatttcactatgtatagatctagtgttacagtgaattaaaatattcttttgcaacaaattacccacatattttggaaaccctctattaacggaattcgtttcatttctagttccataaaaaatgtttcacttagtgtactcacaatgtttcagtatgtatagatctaatgttgcagtgaattaaaatattcttttacaacaaatcacctacatattttataaaccctctattaagggaattcgtttcaatttttattccaccaaaaatgtttcacctagcgtacttacaatgtttcagatgtatggatcaaatgttacagtgaactgaaacattctttcgctatttgctgaaacattattttatataaggtgaaacaacacccgatttaacgattgaaacgttttcaatctacttagtgaaacaattttgatatacttggtggaacatcgtgcaacatttaaaaataattcaataataagctacattttttttcattggaatataaccttgtgtgatcttgttttaaagattaagttgcaatgagtttaatggtgtaatcggatcatgatttggataaataatttaagagaaaaattgtttaaagtggttttgcacgcatgcgtcatgccctcaaatattttttaagaagaaaacgttcaaattatatgcttattaatatttgttgtttcaagatgtttacagtataaataatagtgagatatgcactagacacaagtatattcgaactttgattagatctaagatcgatcataaataaaaaaattgtgcaaagtataaaacaagcatagtaaattctataaattagtaacaataaaatgtgcaacttatgggtgatggaattaaaaattccgcatctgattaaaattttaatattgataatattttaacattatcatgactttaaatcgtattgataatttttttaaataaaaatggaattagaaatacggtgaactttttagtttcagtttctctatgttgtaataatcacaaagatgaatttgtgcccatctgactctctctctctctctctctcggggatcccatctgactctcagtttagtattttattgttctatttccaaaattcaaaattaacaatttggaattaatgaggactatttttttgaagtaggctagtattaaaacacccgtgaaatggaggggttggtgactagtataaattaatagtaagccctaacaataaacatcggacaacaaaatgagtgcgaaatacatagatgtaaataatgctgacttcctcggagttgtggtatggtactataggaatctggttatgaccctttgtttcaaaataagatcattttcccttctctttatccaagataaatttgttttttaagtagtctaacaaatatacgcattgatgttagtatgacgcatatatgttggcatgtatatcgttgtttcctgtggcccaatctccttatatctctcctggttctgtttctatagatcgattgagtagatttaggaaggttgtgtgcctatatgtactccgcatcggaatcaatatgattatcgcgttgagtcctatcatctcacatggtatcaaactcctcgatccaccgcttccgctcctaaaccctaaacttctcgccgcggccatgtcgaccgccagctcctctctctctcatgatgcgctcgtcgacaccatcaccacggcagtggccgatgccatccgcatctcctaccagtctcctcccggcctcacggtggacgacgcagttaccaagtccatcgccgactctgctgctgacaaggcctccgctgccgtgcgcgatgcactctccaaggatttgccatcgccaatagccgtatctgatctcccagcaacggaaaccgcttccgttgcgccccaggattccccgcccatcctcccagagatcgcggcgctactcgcccgtctctgtgtcggtcttccggctccaacttcagccaatggcaccactgccgacaacaccaacagcttgccgcctccgcaagtcttggacgccgaagttcgcaacgtccttcacacccaagctgttgctgtcctcaacgtgaaggcactcgtcccgctgacgctcaacctcgccgctgcaaaccattctcgatggcgcggcttgtttctcgtgattctcggcaaatatgccttgacggatcatgtcacctccgatgtgcctctccttgatcaagccgactggacgcagatgaagtgcgtggtgctcgcctggttgtacggaataatctcccaggacctgcttcaagaagtcatgtcgccgacggcctccgctcgcatggtgtggcgtgatctcgagttccaattcctcagcaaccgcgaactccatgccgtcaacctctccgccgagttccacacgttatagcaaggtgacctctctgtcacggagtattgccgccggctctgaaccatggtggacaacctcacggatctcgggcgaaccacagagcgactgcacgcttgttctcaccctcatcaatggattgagccctaagtatggaaatatgtaatctctcgttcccatgcaagtcccatttcctagttttctccaagctaggtcgcagcttctgctcgaagaaatcacgagaggacaccacccggtgtcagacacggcaatggcattcgttgcatccactgttagtgcttgcatcgtacccaacacctcctccaacacccaaggcggcggcggcaactccgacaacaactcccgcaatcgccgctgcggtcgcggtagcaatgaaggacaaggcggcggctcgtaggtaggacacgccacaggaggtgagcaggccggtcagcaagctgatgccactcgcccggcctagcagtggcccaccccattcaatccatgggctggcaccatccagatgttgccaggccacccggcctcccttcgcggggcctatcttcaacgggctccctctccaatacaatggtgggcagggccaatacagtgcgggtcagcccatcaacttccctccgcagactggactgccctctcttcaactgcctgggccggcggcatattctgccccccctccccttcggtggtccctccagcccatcttgcgcttccaacactgcaatggcccgatccgtctcagtggaacccacaatcgcttgcaagctccttaaacaccaccacactgactacaccgacttcaaatgagtggtacatggattcaggtgcatcttcccacatgagtgctcatcccggtattcttactgcatcccatcaaccatcccactcactgccctcccacattgttgtcggtaacggttctcttatacccatcacagccactggcaccgcttatttacattaccccaatcactcctttgagctcaacgatgtcctagtttctccacatatcattaaggatcttatctccgctcgccgttttgctcgtgatcattggtgtgctgttttgcttgacccttttggcctctctgtcaaggattaccaacccaggattgaaatcgccaggtgcaataactccagagacctttacccctctctgcggacaccctaccattggcaacctccgctcaagcatttgtcgccatgccctctaacaccgatctttggcattgctggctcggccaccttggtcacgaggccctcactcgcttatctcaggcttctgttatttctcctccgaagagcgccacctctctttgtcacggttgttagcttggccggcacgtccgccttccttttactatgagttttactggtgctagagcaaagtttaagcttattcattgtgatctgtggacctctcccattgttagtgtgtcaagttttaaatactatttggttatctctgatgacttctctcattatgtgtggaccttccctttaaaatttaaatccgacaccttttctaccttgtctcaattttttggatttgcgaaaacccagttctccaccaccatccaaagcatccagtgcgacaatggtcgtgagtttgacaactctagcgcccaaagtattttttctcaccaacggtgtctctctccgtttgttctgcccccacacctccccccaaaacggtatggttgagcgcatgctatgttccctcaataacatagttcgctccctcctgtttcaggctagcctcccaccgcccttttgggtggaagccctccacacagctacccatctcattaaccgccatcccaccaagactctccacacaccacacaccgtttttctccctttatggtgcacacccctcctatacacacctcagagttttcgactgcaagtgctatcccaacctatccgccaccacaccccacaagcttgccccccgctctatcatgtgagtatttttaggatatcctaaggatcacaaagggtacaggagttttggtccttcctccaataggatctacatttcgtgtcatgtggggtttgatgagcactcgtttccatatgctgagataattaataatgcagatgctactaaccttgattttctcgaggatatttctgcaacaataccaagtccgatcgggcgtcgccgcataactgcacaaccagggtca

SEQ ID NO: 61069 - DNA, 1501 bp, Oryza sativa
gatttttcggcacaagattcaggtggatggttctctcgaccgctgtaaggcacgatgcattctttgcagctgtactaagtgccccaacattgacatcgacgagaccatcagtccggttgtcaagccagccaccgtccgcacagttctgagcttggcagtttctcgggactggcctattcatcagcttgatgtcaagaatgccttcttacatgggactctacaggagacagtgttttgctctcagctagctgggttcgtcgatgccttcaaacctgacttagtgtaccatttgaacaagtcactttatggtttgaagcaagcaccccacgcttggtacaatcggttcgccaacttcctcctatcctttggatggtacagtcagttcgccaacttcctccaatccactggattcaaagaggctaagtccgacacctcgctgttcatctatcgtcacgggcccgctgtggtttatctttttctatatgttgatgatattgttctcactgcttccacttgcgatctcctctgcttcttggaaccctgcaccactttcttggagttcgtgtcagccgcattccgtctggactcgttctcagtcagcgtcagtatagtattgagattcttgagcgggctgggatggctaactgtaagccttgctccagccttgctccactccagttgacaccaacgccaaactgtcttcccctcatggcactcatgttgccgacccgactgattttcacagtcttgcaggtgctctctagtatctcaccttcactcgaccggacatttcatatgatgttcagcaggtctgtcttcacatgcatgacccacaggagccacaccttgctactctcaagcgcatcattcattatgttcatggaaccctggattacagtcttcatattcatcgctgtcccactattgacctggtgtcttaatctgatgtcaattgggccggttgtccagacccgcggtggtctacctcaggctatgcagtgttcttaggtgataacctcatctcctggtcctccgagcgttagaacacagtttcatgctccagtgcgaggctaagtacagggttgttgccaatgctgttgccgagacctgctggcttcgccaacttcttcatgagtttcacactcctcaaaggaaggctactcttgtctattgtgacaatgtcagcgttgtgtatctctctatcaacctggtatagcatcaacggaccaagcatgttgagatcgatctttacttcattcgtgatcgtgtcgccacagggctgttcgtgttcgacacgtacctaccacatcgcagtttgctgatattttcaccaagggtttgccctcgactgtgttttcggaattccgatccagtcttaacgtttggccagccgacgctaagactgctctcccggggggggggggcggttagcatgacgcatatatgttggcatgtagatcgtttgtttccttgtggcccaatctccttatatctctcttgg

SEQ ID NO: 61070 - DNA, 4627 bp, Oryza sativa
  unsure (1)..(4627): unsure at all n locations
nnnnnnnnnnnnnnnnnnnnnnnnnnnnnnnnnnnnnnnnnnnnnnnnnnnnnnnnnnnnnaattcagaggaaaagtaaacaggagcattaagggaaaccactacggcgtgtctgggtacacacattgaacattgaaggagtcgattgaaaaagccagacgttagctagctataccatgcagggatcagtatgtttggtgactgacatctcaaaaacggatttgaatccggtgcagtacctagtgtgactgcaacataagcagtcacgctaagaccttttgatgcaaatccaagggtccaaaatctacaaagtactgttcacatccgaaaaaaattatagaactactatagcatcaacactgtaccatcagatttagaccgttcattgaaaaaatggatggctgagataatgtgtagttcctaagttgcagtcacagttaggactgcactggatctcaattctgacattgtacagatcagtacgacggcgcaattaatggtttatttcgacaatcaaatgtgggtataagttttatttacactgtcatactctctttcttacactatctttaaataaaatcctctgtttcttggtgtactggcctcatcctcaatttcttggtttattggccgtagccaatatttgaatttgggtatatttaataaaaggtcatttgggggtcttaattgaagtctttttgccatccttggtttttaaacagttaagcctagtgatgtaaaagttttgtctatccgtggttgctttgtttatttctactgcctaccaaccgcagctcaataaaaattggcatgatttttataaaaagagcgctagccatataatagaatgttggaaaaactataagacttaaagaaatatgtaattcttaattataagcatttgtctagtgaaaatatacagtgaaaactaccaaataaataaaatcccgtgaaaagtcaaaaccttaactagcagagtcagagacaaattacttgcatgaaatgattaaaaattattttggaaacatatttggtttaggaacacatatttgattggttcttcaattttggttttatatgtgttttttgaagtgcctttttacgtgttgatggctggggtatgatcaatgtggtaagatatttatatccctttttgcagagaaatcccaaacttaagcatcttcctcatagcataaagatatccctacactgccagctctaagaccaaaattgccccaaaattgcatctccctcctgcttggagctgtgttcccaacctccctctctagtttactgtgcgtacgcttttcaaactgctaaacggtgcgtgttatgcaaaaattttatatagaaaagttgctttaaaaaaccatatcaatccatttttaatgttttttaagctattaattaattaattacgcattaatctattgctccgttttccgtgttgtatgggagttcccaaccctcacctaagaacattagtattgtctcgtgttgcagtattggaaggtgtttacacccaaatttggcacctaggttcaaattacgaaaaaattgccaaaatttggaagagcacccggtgtgttggacggtcagacctctacttgtaggccggtctgaccggcgttatgtggccggtcagaccggtagagtctgatcccgagtctgttttcgtcgggtcttgggatttcttattcggaagggtatgtttcgggtttccattggtttatatcccgagttggatgtggaggtcagtggcggacgcaggtttaaaatatagatggggcggcaaagctagccctaattaggtgatggcataatgcacacaaaccatagtcgctagttcacagcattggcgcaacagtgcacggcacaaacatcgagaaagttaacaacaaagattggtagtcgaacaaacgtatatgacttatatgtagagagatgaaaaaaaatgagaaatgttgttagacaataaggggaaccactttcaatagttcgggggtataaaacgagatgaaaaattatttaggggtttaagtgtgtcagggttatggataccacatacctaatagtagttgactaaatctcgggatgacccaccacataccatgtcctatacggaaacaacctgcgaatataggaggagttccggataaggaatgataaccagagttctatatggaaacgacaaggactactcggattgtgtccatattggtttccctagttctacttggacaaggggatacctattggtataaatacaagaccccctaggaggagaggggacacacccaccatagaagacacggcacaacagaagccacaacatacaagccaacatacgccaagacaagccgctggatatcaacattagagatatacccagatcgacccaatccagtaccttcagagaccggccgtagggatctagcgctttctctgatctggctgggcacggatttgaggaggaagactaccctgttgtcgactacgagtcagaccttcagaccgccatgtcgacaacagttagataggctaccctaaatattgtactggtgtgattatggtgaataagagcaataccggcttcggccaacagaatgtagggttattacctgacaatttaggggcccgaacctgtataaaaatccctgtctctatctcttttacctcaatatcgcatataccctagtaccaacgatccccatactatgcaaatactggaatcgcgacatcaaacgtcgacaaggtgcttccccaaaatagttcaagtgaataaaatggattttttataaatatatcaatttaactatttactgtagactgtattatatgctaaagaaatagaaagaaaattgaattttatgtatggccaaaattagaaacggtcaaaatggtactacttatacacgaattttcataaatgttttggtttctacttaaaatacttgatttatctgattattcaatagtagactgatgactaatgtgttagaaataggactaaaatgaggtttgaggggtgtggggcgacacgaaccgtagctggcccgatcgacccaccctgcccaatgggtgtgtccgccactagtggaggaggacacgaaggaggcaagaccaacccctatatgaggaaagaggccggtataattggaaataaaacaatctacacacaatccaatttatccaattgaatcgctttttcaatatttcacctagttctagcctagttcatccatctttgtcgatttgcactgtaaatcatctaccttccctgcgagtgtgcgaaatccctttgtaggtttgttttataaaccttctttttgcccatgagaccggtatttataacttgttctacctaaatcggctccgctagcatgtttaatccatcaaaacccatcctgatctagcttttgctagtttggagtggttagcgactctatatcaccgcaaggcgtttaggtttcctgatcatgattgtcttcttgtagcaagttccgtagatgaaaccattaacgctactttcaataataaacttgaacatgatatgggttcttattttgacaaaagaattgaatctttagtgagttccaaattaagctctcttacagccgatttgccacacaattctattacaagtactagccaagcccctattcaccacttatatagcaaaaccgatggagcgactacgcaatatgccaggagcaaagctaaccctagctctgaggctagtatgaccgcgcccctggttggtctgaccgactctccccacatcggtttggccagcccacacgctggtctgacaatcttgaccaacggtcccaccggccctcaagctggtctgaccacatcgacctatgatctgactagccatttggttggtccaaccgcaccactgaccaccagtcctactaggttctcgaccggtcagactagcacaaatctgcccatgcaggaagtagatccaatcaccaataattatattttgcaccattttcatgtacctaatcatctagtagctccggttaatcctcatattcctccatagatacctaatgcttataatgatcctaatgttgggtgcccttaagatgttagatatggccaatataacagtattgcaccacgacaaccttttaggccacggaattcaccaaggcctaaaaatatggaggaccatgtgaggaatatcattagggaagcttttggaattgtgccgatgaatcgtgctagggtttaccaaaagtcatatcctgattattttgatgatattccatatccttgtggttttagggttcccgaattcactaaattcaatggtgaggatagtagggaccacatgggaacatataggccaattcttagcataatgtggtgagctagtaacacgtatgctttcaaattgcgtttgttttctttatctttatccggtattgcatttatatggtttacttctttactggcaaattctattcatactttaggtgtccggattttgttgatttatttgagtgggtcatcatgactttgggaccgaagaatgccggcgcaacatatcaaaaagcaatgaatttgatttttcatgattttctggggattatcttagaaataaacattg

SEQ ID NO: 61071 - DNA, 3621 bp, Oryza sativa
atatttgagccgtcgtattttgaatgccgaaacgaggaatgactttatagaaagacttcgtttatgtctatactatgctttttcgacgtggcaacattacttgttatctactacttgcatagttgcttgtcaagccgatgttattaaacatatgttgcaaaggccaattttgagggggagaacatgatttggcttatgaacaattaaaatatatcaaaggccaaactgcagttgattttatagtagatcatcatgtggatgttgcttatgataatgaggtttacttgcttagtgtttgaccttggaaggtttagtttaatggttcttctggtaaggaaggacaaggtatagctgtagttttgttttcgctcagtggtttatgctttgagacatcggttcgtttagaatatttttgtacaaataatcaagccgaatatgatgttttttattcagcttataagtgttgcaagctatagtggctacagatgtagaagcttttggtgattcggaattagtgatacaacaagttgccgggtatataaatgttttgatgggtcactaaatagttatgatcaatgctcggatattattgccaattttgatgatattttcattcgacatattgctagggaggaaaaccttagagcaaatagtttagctcaacaaacatatggctataatgtgaagagaggagtattcttgattttggaaaagtcggtgtttgaattcaaaagtttggacaaaattggcaagattacagaccaggagtggtttgactggtgcattgcagccggtctgaccggtggtgaccgtctgtctaatcgcctcagcatggccggtctgaccggtggtgaccgtctgtctaattggtctgaccggctctgtatggctagtctgactggatattggaagaatgggacgatcgatttagaggccaaattgattgtaaattcgggcatttgtgcctaggagttagaggaaaactggagaatccctttgatatattatttgaaagatcctagtcttagggttgatcagaaaatttgatgacatgcatttaaatactttttcttgatggagagttgtatcgccgaaatgtagatggggtgctattgaaatgcttagataatgatcaatccaagatttccatgggagaggttcatgaagggatttgtggaaatcatcaatgggcccataagatgtattggtttcttaggagagtgggattttattggccgaaaatgattgtgattgtttcaagtattataggggacgcaaagcttagtcaacagttcggcaatgtccaatttaatcctatcatcaaaccatggttgttccgaggatgggctttggattacataggtcaaagttatccttcattctcaaaagggtatcgattcatgctagtaacgatagattatttcactaaatgggccgaagccatgtcactcaagaatatgactcataaggaggtaatttactttattttaaaacatattattcatagattcggcattccttaaacattaactacggatcaaggagcttcttttatgtctaaggaggtaagaagttttgccgaatcttatggtaatgaattgttgagttcatctccttactacgctcaggccaatggacaagccaagtcgagtagtaaaacattgttgaaattggtcaaagaaaagatcgaagaacatccaaagaggtgttatgaggtgctttcggaagcattgtgggctcataggatatctaaacatggtgttatcaaggttactctttttgagttggtttatggacaataagccattttaccggtggaggtgaatcttgtctctgttagatatataaagcaagatgatttatcggttgaggaatacaaagcattgatgggagacaatcttgatgatgcgaccgataaacgtttgaatgctttggaagagatagagaaggagaaaaagggagtagctaaaccttacaataaaagagtgaaagcgaaatcgtttcaagtaggagacttggtgtggaagacgattttccctttgataaaagagtgaaagcgaaatcgtttcaagtaggagacttggtgtggaaaacgattttccctttgggttctcgatctaaggagtccagtaagtggtcacctagtagagagggtcctattcgaatatgtggaatcgttcgaggaaatgcatattttctggccatactacaatgagaacgattttagagagcaattaatggaaaatatttgaagaaatacttcctaaatgtttggcaagatgcataggaggtcatatggccggtaattggatcatcgccttgagataacatgttctatgcttttaggttcacaatgttcaccaaaaagttaagggcatgtgtttacacccaaagttggtgccaaggttcaaattaggaaaatattgccgaaatttggaagagcactgggggccggtctgaccctcgtgtgttggccggtctgaccagtggtacgcgggttccttcccagggccagtctaaccgtcgtgtgttggccggtcagagctctgcttgtaggccggtatgaatggtggtatatggccggtcagactagcagagtccgatcccgagtctgtttacgttgggtctcgggattcttttttcgagagggtatgtttcgtgtttccattggtttctattccgagttggatatggagggggacctataagaggcaagaccaacccttgtatataggacaaggccggttcaattggaaaaaaaaacctatctacacattatccaatctagccaattgaatcgctttttcaatatttctcctagttctagcctagttcgtccatctttgtcgatttgccctgtaaatcatccaccttcgttgcgagagtgcgaaatcccttcgtaggtttgtcctgcgaaatgccttctgttagatatttatcgcttgttctacctaaatcggctccactagccggtttaatctatcaaacccctagcttttgctagagtgcggtggttggcgactctatatcaccgcaaggtgtttaggtgtcccgatcgtgattgtcttcttggaaaaaaaagttactaacagaaggcatgatgatgagacaccggtgctgatcttccgataaatacacataaggtaattatggagaactcattattgatgatccaaaagcctcctcacaataactggctaccactccgttggttaccaaccataccaaaacggattgacctctcattctaataagggtatctcctgtaatcgaatcaagagcagaaccaaaacaatagaatatgcaatctgaacataatacaaatataacatgaatctcacaaattgaggttccatcaactgaactactgatgaaactgtaaatggcagaataatctaagcaaaatctaactctaaatgatgatgcccactaatgatatactccctccgtcccataatataagggattttgagtttttgcttgcaacgtttgaccactcgtcttattcaaaattttttgaaattattaattattttatttgtgacttactttattatctacagtactttaagcacaacttttcgttttttatatttgcaaaaaaaatttaaataagacgag

SEQ ID NO: 61072 - DNA, 8143 bp, Oryza sativa
tttttttatttttaaacttttttatttttttcatattaattaatagacattttcaaaaagtatttctaaatctgaaccttttggtcacgctagcccgtctgacttggccaaataactttgtcacgccactgtgttatcctgtcacaccagcctcttgccatgccactgtggctggtggggtaaaacaacgctgtgtggtcaaaatgttcggttttcggaaatattttttggaaatatctattaataaaattaagaaataaaaaaaatctcctgcatatgataggcgatttgttccgatgattctggacaactcaacaaaaaaagttaatgtgagaccaaaccatctgaaagtatactccataacatttctaataagtactcatgagcctccataatcctggatcagcagctatgtccatttaaagtttggactatccaaaaagttttcggcagttttctaggtaaaaaaatattcaaatataactatagtataattctaatataattacactgtaacttgagtgtgactataatatatgtacaatatatagcttgagtgtaattatgcttttttccgtttgacaaatgttgtaggtagcgtactggtagtatgctctttgtgccaccatggcagatattggattcaaacttccaccgcgggattgcaaaagaaaaaaaaaagaattcctctcttccactagcatgaatcgtaaaccacattcttccactagcatgaatcgtaaaccacatgacatggctacattcttccactagcatgaatcgtaaaccacataacatggcttaaggaatgctatggcttgctctgcagtcgttgtcattattcatccacgcattccgtggacacacactccccattccttcacttatgcaagtacttttgcacatgacaataaaaaaaactcatggtatagtatttttttttgcttgaatctatagaatctatctatctatctatacctatactaattgggcactctaaagaagctaccacgttaatcagaaagatccgactattgattaagtgtgtcatatcacaatcaccgtagattttcattattgagaacctgcgttaaaatagattgtgccgcttctcagcccaaccaatgaaccatacgagcccatccaatgtatacgtacatgtatcgatcttttctcaggttacaattaactctgttaatttcagcaatccaatagatgggcacgcaaacatgtttgaggtcttcgctcgagagagacacaccgattccctgttcctcacatctgttcttggcatccttaattctcaatttttattgtcgaggtgaagagtgtggaacaagcctccagtcaccgagatcgatttattgttgtgatccacgttcctccggtgttgaatccatgatttgatttattttctcctccacggcacttgcattgttttttttatctagatatgattcgtaatataaattttgtttggttcgagtgtccatgcggcatcaacgctcgaattcgatcgatcccatcatcacgcatcatcatcatcaccagatctaatgtgccgtttcttttcaatgcccctgatccagcaccagatgcaatctgtaacttttttctattggtccacagtgatttttaatagatggtgcttggatcaagcggccacacagcatcaacaacttactgaaattcaatgccacgcatcttcaggttgccaaaataatcgctggaatcaaatttcaaactgatctaaatttagctcattagctatgtgggtaattaactgttgggatacgcgtaggctacgatagcataaatcaaaattttctatcgcgtaaaccagggaccatgcaagtattagatcatagatcgttaccactcgacgcgctgcgcactggaagaaggcgctaagaagtcgaaggaattctcgcgaagtagtgcgcgtcgatgtagaggaagtagtcgatcgcaccggctcgaccttctcctcctcgtgcgttctcctcgccgtattcccatgccgatcagcaccgcaaaccagtggtgcctctaccggtatccacacgtacagagacggaacgccacacgcagatgtgctagcactcgtgcgcagctagggttttgctcggggaggggagtgacggctagagtttctcacgtgatgcaatacctccgccggtcacacccctcacgaatatataggatccatcactcgggcctccaaggctcgtaggactcctattcggatccctatccgaattaagctcatattggatctccatccaatccccttattccggcccattaagcgtgcgaccctgtagtttcatgtacactcggctgtaacccgaaaactcattttcggtccacgcgtcaacagcagcccctagtagaacgtattgacctaccaggcatacataaagatcatatcggctgaacctctagtgtatacttgtatgaacccctttgcctcacgatatcgattaagctcaaggctagatatgtgccatcctctaatagctcaatcattcactcgaacctgttttgatagattatataacttgtgattgactcctgaatcacctttggcatagccatacacttccataatctacaacatcgaggggcctagagatatctctccataggaggggcaaatcccatcttgattattcctatctcactacatgtttcatagcatacccgaaaactatttttataactacccaattacggagtagtgtttagcagtccctaagtaagctactacacatgttgggaaccatgataatctcaggtctaaggattcaacaccaacactaaatgagattactgatgacacaacacatatgactcttgcaatggctcatgttgggtctatccaacaacatgttcactaacatgtgtctatattattaatttggtatctctataccatgatccatgagacatgatcattaattaatacatgtgctgatcatctaataatttttgttccacatataatatttgatcagggatcctttagaaatagcaacacacaatatacagagtctcgtgaaagaatcatatattcattaaccactatttcaaggagcaaagtcggataaatatgtaaacatactatgttatacaatcatctctatgattgcctctagtgcatatcactaacattaacatactcatgtcattttgttctctatgtattatataatagttagcagtcagagtaaaacaatggcatatatctgtgccagctaatcgagccatatgtttcacgtaaattccactcctaataacaatgttcagcgatataacttatgattttatctggcaatatattccatgtatctttaagttttttcctataggatatatggttattgccataatgcaattacgaaaatattaggtggattagtatggtctaatataattttcatgttctgcttatttcctcttatggatgcaaaattattggtcatgccttcactgcattatatattatgagctcaatctttagtccaaatcgatgtatctaaatttcattaataaatatgaagttgtatccatcttgaatatttcattttatttatttaataacgaaattcaaagttaccaattggtaacatatgattacatttttaaattttataatacaaagaaattgcataatttagtatttataatatataagtgatatatagcccgtgcaaggcacgggttggcggctagtgtaaatctaatataaaaagcatgcaccattagttgatcaagatagccataatcatatcccagctggtcctcatcacaaaaagataggtgctcaagggataaaacttcatagtttgtcgcacattttggataggtaagagtagtttaaaccatgagttttattttttttgcacatgacaataaaaaaaactaattgacataagagcagtttcaacgctttcttatatgacattcattgtacaaatcattagagacactggtcgagaacccctttttagccccagcttgcaaccacttaagtcccaggtagcaaaccggggctacgaatacaaaattaaagatctctatatttagtctcggttaaaataaccaagactaaagatagatctttagtcccggttggtgtctgttgatgtgaaaattaaagatgatggatcggctactcaatctccaaggacctcctctgggcatcattgaaaatatagagctagcaaggttcagtagcaaaaactttgacagatggtgggggtgaatggaagctacatctgttccaccaaccagcctcaatgtatatgacagatctttttcttgatgtcatacctcaggtaagccttaatcttattaattgtatttgaacaattgtcagccgattcataacttgactaatcttatcttctgttttgcagacaacagaatcttcccctccacatcaaagcaatagtggcagaaataccgaatatgccccaagtctgattcctaatggaggtggaccatctccccctatcatcggctatcatgcccccaggacttcaacccttctccaagggctcatcagagaaccagctcatcggctgtggacacatcagctccagacccaaagaaaaagaccaaattaaagaaacccaagccaaccgacgatctgcctgccctggacccaccatcgaacaagctctggatgaagaagagatcggagaggatgttgatcaagccgtagatgaagtatgtgatactgaaagaactccatcggcttcacccaaacaaactcctccgactccctctgctccagctcacttctccagggtaactatctctctctgtttcctttaataactatttatcctcaaccaatcactcattaattttgtctttgcagaaaaagagaattgttgtgaagaagaaatcggcagcaccaactctcaaaccggctccaccagtaagatgttcttaattctttcaccagttgacctcagccgatcttgtctaatacttgtctcttttcagcctcctcctccttctcctgtccagcaatcatcaagcgataaaactccatcagctgcagggagtcaccatgttgaagaagaagtacaaccagctactcctgctatcccagtaagtttcttttaaacaccaagtcttagatcggctatatttgtttgtcatctttgtcctttaaatttctcttttgttgccttagccgatctgttttcttttgatatcaaagattactttgatgagacagaagaagaaactacaagcaaggctctagcccctttggtcgacactgtcaagaaaacacttgaagacatatccctttggctagaatcttcgctggataatctggtagctgattgtggttcgatctgggcatgatttactgaaatccaagcttcaattccagacgatctagcaaacaccatcactccagccgtgtatcttgaacaacaccaatttaagctggagaaggctaagccatagatagccgatcggcaagaatggaaaaatattgaatctactatccaagccaatcggcagcttgtgcatgaagagaaagccaagttagatcaactctctgttgggccgattcagtcgaatatagatcggctcgaagctcgcaagatttatttaatagctcaactcgaagaatgcaacgccgagctggatctggaaaagcaaaagctagccgatcttccaaatgccgttgaagatcaaaagtccagattgagattggctatcaagaatgtggctgacatgaccaagtctctcaagatcatccctagaactgatgctcaagatgcccaagccattgaagaagtagaacaaattaggcaacgggctgtttcggctatccagtgttatttgtctcagtaacattctgtgtaatagaatctaggaatttttgtaattgtctaagaaactctgactctttatgtaactcatcttaataactcttatgccgattcaatgaaactccacattttgctcgaaaatttgcaatttttcataaaatttgcaatttttcagatatacgtgcccccctaattttacaatgtcaaaagctttgataaaattataaaaactactaagggcgatataatcatatcggccattgtacatcggcaaaccacaaccgattacaatatgaaaacaactaagggcgatataaccatatcagccattgtacatcgacaagccacaaccgattacaataggaaaacaactaagggcgatataaccatatcggccatctcaaggcgatgtaaatacatcggctatcatgtatcggcaatatcagccgatcatgcattaacccaaacacttgggtaatatttcttcaagtacttaccatttagtgctcgtccataaatttctccatcgagtccttgcaacatgtaagctcccttagacacaaccttatagatttggaacggtcctttccaattcggcgaccacttgctgaatttgttatcccaagtcccaatcagcaaaatcaacttccatacatgttcaccgtccgaaaaagtcttgggcaccactttcttattgtaatgtcgagcaactcgttccttatccttggtaacctttgcaagggctcttaatctagattgaaccaagtcttccctttcatcggccatgagattataatattcattggctgttaaatcattttgtaactccgttcttcttgagccgattctaacctcccatggtaacacagcctcatgtccataaacaagcttataaggagggacttggatcgacccatgacaagccatccgataagaccacaatgcttcatccaatcgagtatgccactgccgaggaaaatcagaaatctttctctaaatcaatttgatcaaactcttgttagatgcctcggcctgcccattagcttgtgcataatatggtgaagaattcaacaatttgatacccatgctatcggcaaactgaacaaactcattggacacgaagatttaaccctgatcggttgtaatggtttgaggaataccaaattgatggattataagctcttgaacaaaccgtatagcatcccccgaatcaactttcttcaaaggaattgcttccacccacttggtaaaataatcggtcgccaccaatataaacttatgccctttactcgatggtggattaatcataccgatcatatcaattccccaacctctaaacggccatggtttaatgataggattcatagtcgacaccggtgctctctgaattgctccaaatttctgacaattttgacatcccttgtaatatttgaaacaatcttccagcattgtcggccagaaataccccgcacgtcgaagtaaccacttcatcttatgagccgattgatgagcaccacaaattccttcgtgaacctcaccgattgcaaccttagcttgattggcactcaaacacttaagcaacaccccatcaatcgtccgataatagagctcatcattcaacaaagtataattcaacgctttgtaacgcaatttccgagaagccgattgagatggattctgtaaatattgatatacatcatatctccaatcatcggctattaatgcagcaaccttaaccttgatatctttgatcatcggcttatatcccgacgccccttgggccaaatcattagcttcaatattctgctatcgcgatacatgcttcaaagtaaccagctgaaattccttcattagctctcgacatttctcattataaaccattaatgtatcattcttgcactcatattctcctgccaattgactgatcactagccaagaatcccccattatctcaatagcatcggcttcaacatccttgagtaactgcaaccctttgagaactgcttcatactcagcctgattattagttgcataaggtttaatagtgtaagcaaactcaaaacttgccccccgaggggaaattataatcaagccgatgccacaaccatgagtgcatactgatccatcaaaaaactaaatccatggcacaacttcaaccgagccgattgaatcatcatgatgttcaacaataaaatcggctatagctttccctttgaccgccttcggtgactcataccgaagatcgatcaccgttaaggaaaatatccactttccaacccttc

SEQ ID NO: 61073 - DNA, 945 bp, Oryza sativa
gcacttagtcctcacaccgaaaagaaagcagcggcagtggaaaaaaggcgatcctagtgtggcttcagctccactccacaggcaaaacttaactggggtctgagccttggtcctctaacttcgtcttcagctcaaaagcactacacttctaaaaagggggaaataatagcaaggctgagtacaaccaccgtactcagcaagccacaccaacgatgcagacgtgcaaggggaacacaaggacggtttgcggctatttgcataaaggcggttgtaaaacattttattgagcaaaacagtaaaactgttgagtgattatagtaatattaaatctccactgatcaatgctacaccacgttgaacaggcccaaccaacccacctgaactacagtgcattgggtcgatttattaagtgtgagactaatcacggtgaatctggtcgatcgcccataaccgcgggcgcggctactcgaatagttttactctggccagaggtgcacaactgtacccacaagacacaatccaccgacatgtcaccacgtcatcatgtacctatgatgaacacgtcaccacgtcgagtgattgtgacaagacccttcatataactcttccgtaaccatccacaccacgctaaggtttcacccccacccctcaaaaggcagtgggcggtcccctcttgcgccgcggtgaatccggcagctggacaaccggacaccccggccgacccaactccatcacgcccaccctcgtcaccggtgcctaagaaatggtcgagctatacttcagatcaagcagttacccattcccgcttgtggcaagcgctgtaagtcttccaggggtgtcccgtgaaccggtccttaattgccatgggtgcgactcacaaaaccatgcacccacagcccaccattcagtcgcattttagttggataattacgaccataaaacatg

SEQ ID NO: 61074 - DNA, 735 bp, Oryza sativa
cgatgaatatccaatgccagtagctgatcagctggttgatgctgcctcagggcattagatattgagttttatggatggaaatgcggggtacaatcagatttttatggctgaagaagatatccataaaattgcctttaggtgtcctggtgcgatcggcttgtttgaatgggttgtaatgacttttggtttgaaaagtgttggagcaacatatcaaagagccatgaattatatctaccatgatttgatcggctggttggttgaggtctacattgatgatgtggttgttaagtctaaagagatagaggaccacatagccgatttgaggaaggtttttgagaaaaccaggaaatatggcctgaagatgaatccaacgaaatgtgctttcggtgtatcggctggccaatttttgggattttttgttcatgagagggggattgaagtaacccaaaggagtgttaatgcaatcaagaaaattcagcctccagagaacaaggcagagttacaggagatgatcggcaaaataaattttgttagaaaggttatttctaatttgtctggaagattagtacctttcacaccattgttaagattgaaagccgatcaaaagtttacttgggggcagagcaacagaaagctttggatagtactaaggaatatctcagctctccttcagttttgattcctccacagaaaggggtaccggttagattatatctatcggccggtgagaagtca

SEQ ID NO: 61075 - DNA, 3613 bp, Oryza sativa
  unsure (1)..(3613): unsure at all n locations
nnnnnnnnnnnnnnnnnnnnnnnnnnnnnnnnnnnnnnnnnnnnnnnnnnnnnnnnattcacaccgctccctctattcaaaatccccaaaatggttttaggctgggctcggggtgcatggttttgatagtagcatctcggccgtgtaaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtccgtataccgtggtggtatgtggcacgtggctacacgtgaggaagaggtgtcttgtgggtaaagatgtacacctctgatcagagtataatctattcgaatagccgcgccctcggttatgggcaagccgagcaatgtacccaagttagtgttttaattcttaaaatttgcttaacaactaaatgtggaatggttggcctgggttggcttgggacgagctgggacccaaggtcgggttgccagttcggtctgagtcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattattaccccttgtatccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttataccatgtttgtgtggtgtaccccggcttttcctgggacggggattaatacactagcgttcgggaaaatgtatttttctcggtcgcgacaagatggtatcagagccatctcgactgtaggataagccaagtggataaaacctaaggacatattttataaataaagctatttgcgaaagttccttttttctccttcccctaatgctatttgcaaaaggtttactcccttcttccttcttcggatttcaactagtactagatggtcaggtcagtgaagaaaaagacatcgtcagttgtttgccgaagctccggaagactgcaggatccgctagcgaagtggaggaagcagtgaagccagctgtgaaggagtgaagatcttcggaaccagtcgtagaacctaagccgtcctctaggatagtgttgttagtcgtgtgtttccttgcttgtgtgtgtagtgcgtggtttgcatcggtgggttgtgatgtgaccatgctaggttgtttgcttaatcaacttgcagaataagcaaaacaaacaacacatcaacaaaaagagttagttcctttaaggtctggtccctagttctggtctattctttcctggcttgtttcctctctcacctcaatccctgtcacagatgtttaacagagaaaaaggaaagaatgtcagcgggtatgcctcaagtaactcaagttttcaactcaatccaccactggcctcaagagagttaacaagggcacacccttggtccattccaagcatgctgcttagttcacagctaccattggttggaagtcaagaccaaaatcagtatgtgtttgatcgagcatttgccacccaggtcaatgagctttcaatgccagaagagcatgtccccttttgtcatgattgtagagagcaaggacactatgccctgaattgtccatgggtatatgccaaagaagccccttcctttggtttagccgggcagacatcgctaaaccagcctcctcgcaccaagtcaagcttgcaggctagtgtacaaagtagagaacccaatggagagaatccattgaatccaaggaaatgctttcctcctagcctttcgtaccacgtggggtcacgtactaagcaagccaaaggcaagaagagtaagaatcagaagagaaaagcgctgatgcgaactgaagaagaagtacgtaagatgactattaccagcaccgaatggcctccagcagggataactattcctagacgtcaaagaggaaataccttccgaggtgcacgacagttgacccagcacctcctaagccatggtggcagagtatctgatagtgaagggtcagatcaagtctcctcggatgatgaagatgagtctccccgacatcttggtgaggaagagatggaatcaaaggcatgcacccgttgtggagaaattggacacgttgctagcaggtgtctcacactctgccctcattgtgaagaagaccatccacccggggagtgtcccacccgcaaggtgacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctcctgctgcacctgaccctgcaataaatcatagcaataatatcttcagcaccaaccattctctacaccgacagcctcaacaaagaattgtcgtcgatggaagaagttgtgtctctccccgacctactccaggccgagcaaagggcaatcaacctcaggagggcgataccaagcaaaagaccgtcatccgcttcaaacagcaatcagaaggaagcttctcctgtgaatgatagcaatatgcagtcctatcacatcatcacagaaccaatcaaggatgcagtcactagaacaatgccagctatatctctccagaatcagaatgagtatccatgtttgtgattttcagttcgctacttatcactgtaatcgggagtttgcagcaatcatgtaataaataaatatattcatgttttttgctatgtttatggatgattcatgttgaggatgcaatgtaccgatgttaagcaccttccctttttgtttaaggtagggccttgtattcatgtaataagggagaaatgtgtaacaaaaacaagttctatgaggactctttcggaagatgctgatatgggattatgtgtataattgtttactgtcaaaggagacctagggtctcatttcagaggaaccatgttctaacctcgagttaataaccaacctgctgatggaaaagaaaatcaagcgagtaaccaaagagacatttgtttggactaagagtttcagatgtgtctttttcggatcaaaggcaacgatagttagtatagcttttggcgaaacacttcaaggtttcactgaa

SEQ ID NO: 61076 - DNA, 1069 bp, Oryza sativa
  unsure (1)..(1069): unsure at all n locations
gatatgggattatgtgtataattgtttactgtcaaaggagacctagggtctcatttcagaggaaccatgttctaacctcgagttaataaccaacctgctgatggaaaagaaaatcaagcgagtaaccaaagagacatttgtttggactaagagtttcagatgtgtctttttcggatcaaaggcaacgatagttagtatagcttttggcgaaacacttcaaggtttcactgaaaggcagcaagccaaaggacctcatcgtccccagaagcatccacaacccacattaaagagtaccacctgttagagataggccgaaagatgattgataaaagagattggcaaagatgttctctagcaggaaagaagtaggccgaaaggtgattgataaaggataaacagaaacatgctctgcatcgctcaaggaatacccctgatagtaattgccccgcaacagtcaccttgtcattgaggtaaaaaaaaatcatcatgagtaagcaagatgacctaggtaaaagtgttttcatgaaggcaaggagtgaaatattcaactcggtatcagatgctacacggagtgaaaagtgcaggcaccagttaccaggcaatgccatgtcttgggagatgatccaatgggaaggaactcatcaaggtcgaaggtgtaaaggaatacgttgaatgctaaatgatgacaacatgatgagaatagtggaaagtacactgaacataaagaaagtgaatccgagttgtttgttcgtgggagctattcccagttatgaaccaagtgatatgttcgaagatagtctacagaggtcagattaaaaacacatctaacaacgaagctttagatttggcaggatcacgatcagaccataacaagtctagcagtaaagtcatttggggagacgtcaaagcatgtcaagtgggataagttggttctgttgagaaacatagttcaaaggcaaagttaccgacccttgcatcgaatagcagaagtaactagcacccggagannnnnnnnnnnnnnnnnnnnnnnnnnnnnnnnnnnnnnnnnnnnnnnnnnnnnnnnnnnnnn

SEQ ID NO: 61077 - DNA, 964 bp, Oryza sativa
  unsure (1)..(964): unsure at all n locations
nnnnnnnnnnnnnnnnnnnnnnnnnnnnnnnnnnnnnntcctcatgcccaactagtaagtagtaaaaacaagttgatttataaagatcaaaattcatcccaaaataaaatctgtcttatgtagtgcacgtagtgaactgctcgaaatccctctaatatcaaaccactggttacaaaattaaagttatactcctattttacacgacttgtggtcttgtggatatgagaaaacacttgaaactgctcttatgtcagttttgcgtatgttggcatgactggtaaaaaatggaatcgctcgaaaccattctaatatctctcactactaaaaaatgactttcctagacgagctcttcaatatgttgagacggaccataagtgtcctcgtctacaaaaatcgacccatcattttcgtatacggctccttaagagacccatatgcaaaaatcaattttcgtaggcagccctcttaagcaaccgcacgggaaaataaggctatttgtcgggtcccagaactaattacttggatctgactagattaatgtatcaatccctagatcagtaaatattgatacatacaatatagctagttcttcattgcatacattaaagttttacaatactaaaggttttacaataatagttacttacatagttaatcctacgtagatctaatatacggcggaagtttctatacattctgactagggaggtataaaagcagtaataaacaatctggaagtgttatagcaagaatttataaaaatgtagactttaaatttctaaccagggtaccatatgagtcccggtactcaattccatgagtacggctattcgaatagtttcaaagatattctactgcagcagatgtacgctttacccgcagtccacgacttgctgataatcannnnnnnnnnnnnnnnnnnnnnnnnnnnnnnnnnnnnnnnnnnnnnnnnnnnnnnnnnnnn

SEQ ID NO: 61078 - DNA, 1622 bp, Oryza sativa
tcgggaagggggctaaaacgatagaacgaaggatggggatcccattttataggcgtggggagggagccgggccacgggaaggagcggggaacggtggcggaaaagccggccggcggccatggaaggtggccggagttggcacgtccgttcccggcgattgggggcgccattcaagggggaattaagggggaaagagagaggagggaaaggggattaattccccctaatcaattttggaattcccggtttgaatcacgtggattttggggaggtttggcgttaggtttccggggagagagagagcaggtcgtgcggaaggaggaagacgaccgcacgtgctgcgcgcgtgcgggaacggctcggtgtgggccaggtggctgggtggcgcggcttgggccgggcgggaaggagggaggggaggggcggcccagaaggaggaggagaggagggagtgggccgggaggggaagaggaggcccaagagaaggagagggagagaaagagagggaggagagagggacttcagccgggggccgagagggagaggggagaaaccttgggccagacttggcccaaagggaaggagagggttatttttaggtttttctttttaataaactctgataattgttgttgttgtttaataaatatttttggtgctctgaaaattcaagtaaaatttgagggctccttttagaccaaggagaatttaacaaaaattctccggaccacattcgaatttttctggcatgtattttagtgtttgtcaatttcttttcgaattttaattaattctattattccttttagaaaatgatttttattttgggatgaatttatcaggacgtgacaaatccaccccccttacaggaatctcgtccctgagattcgaggagcctagcaagaagataggttgggcggtcttctcttcttgcctgacttcttccgttccgtcttctataacaaacttgcctagcacaacttctccactctggactgcttggctcgatctcctgttgcagatggaatcttctcttcacctgacttgtccctggttgaacctttagctgactttgactgggttgcggcacttgaagatgggacttcagttccagaacttctcatagttcatatctttggcgtcaacctcatacaagttacccacttcatgttatgcgtcgatatcagcttgtcattactaggataccatgcttggagcttccttccagcttaccaccaaatgcttcagtctaagatatcccacttaccaaggataccctgtttgacgacttgccactaactgcatcatattagctttccaggtctccgggtgctagttacttctgctattcgatgcaagggtcggtaactttgcctttgaactatgtttctcaacagaaccaacttatcccacttgacatgctttgacgtctccccaaatgactttactgctagacttgttatggtctgatcgtgatcctgccaaatctaaagcttcgttgttagatgtgtttttaatctgacctctgtagactatcttcgaacatatcacttggttcataactgggaatagctaccacgaacaaacaacttggattcactttctttatgttcagtgtactt

SEQ ID NO: 61079 - DNA, 989 bp, Oryza sativa
cattgttgctctatatatatatatatcttttagcagagtgatgaagagaagcccttgttagtacgcttgcgtacttaacaagatgaccggagtgcggttccgttctaggtctcgttccccagtcgactacttgtggcatgtcaaccgggcccttgaattattttgtcttccgctgttgttctctgataattgttggcctacctggccctaatgtaagcacttaactttcttagcctaaattcattcgtgatatgttgtgattcggctatgtatgtgtgtaccaactactgatctagggattggtactgataaacacagaagatttccgattttcaaaattgggggtcgacaatttggttgctttttagcgacaggctaaacacaagagacatgttggacatgaaaaattgtgccccactaaatgctgacttaacctgtgttttgtgttcacttcagtgcagagaaactctatttcatatgttttttcaatgccccttcagtaaaagatgttggaggtggaatttcttggaatacatctttggagttctttcatatgcttgtcttggctagtgatgcggacatcactacctcggatagacacaacaatcctccaacggtcatttaaggacagataacaagagctcgtgcgcgacaattaaatttagaggtgagctcgttcctatgttcttctttgtatgaattcgagaatagattgctacctaatgattatattgtgattaggaacaatggaggggacaaggagacacttggagaaggacttagagccatggaggatcatcggggacgtccaagtcaaggtggaggcccaaaccaagtcgacgtcgggtgtaattcggagtccaggaccagtctgcactaaaacgggcgcccaggtcgcatacgtgctcggattggggcgttctttatatggatggaaagctaagaagataacctttccaatggttttagtcccatgtccaaatttcttt

SEQ ID NO: 61080 - DNA, 13134 bp, Oryza sativa
cccattgacataactatttatatacaatggtttaagatgccgattctctgtcccttccggcttctcgaagactgcttgttctggtgataaaatctacttagccgattcttcttcaacttcagtgacatcggcttgtttgaccccaaattcagcaagcaatgtgaaaaccatgttaaccgatgcagtcacaacacttttccctttagccaatctctttgcttcatcggttgtggcttcatcggctacaggagcttgattcttaacacgccactcctgcttcggcttcgtcttctttagccgatgattgatttcttgctcgaccttctaaaagcactccctgttcctcaacctctgaacccttatcttctgattctttataaaactaccagaaggacaccattgagtcttcctatctttattgtcttcttggtcacaatcttggttcactgggcccattctttgatgaacaggaactcttgcttgccttagccgattgcttctattatacgatcggcttgaacttcctgcaacattagtgcaccaaggacaatcctcaatagacggcagcctcataccttcattccaacaaaatctaaagaattcacatccccaatgaggatcaaaccgccatcatcttcttcataacacccctcctgctgtttgtcatacttcttctgataattattaataatcttggccgaattcacctaaaaacctcttgcacgacctccatcggctgttcggccaactatatgcaccatattgacaggaaaaggattgccatcaaccttcatcggcctcttagaatcatcaaatttgattttgcctccttcaatagttgcctggatctgctgcctgaagatcttgcaatcattggtagaatgagacacaaaattatgccacttgcaataccttctcttgcccaattcttcagccgatgggattgtatgaacagcaagaagttgaatatgtttctctcgaagtagcaaatcaaaaatcttatcagccttggtaatatcaaagtcatatctctcttcttttccagaactcttcacccattggcatggtataacctttttgcttctaacccattcggctgctgctatttcagagtcatcatcatcatccgatccatatatgtaaggacatacataattaacctttttaaagttcttcctggcttctgcaaacctctgttcatgcaaggttaccttctgtgcaagatatgacaaactatcaaagtcttgagacgagaacttctccctgatcagagctatcataccctgaaaagccaaatcggctagctgggcatcagccaaacttaagctgtttattcctcgtctctttgaacctctgaatgtactcatgcataggctcatcatgcctttgcttaatcgctgttaaatcgaacagtttcatctcatgaatcctactgtagaaatagctatgaaaatgcttctccaaatcggcccaactgttgattgatccacatggcaaagaagaaaaccaagtgaaagccgatccagacaaagacaatgcgaacaacctaacccttaaggcatccacagccgatgcttcactacactgagctaagaatcgactaacgtgttcataggttgaaacgctatctttccctgagaattttgaaaactctggaaccttgaatcaactaggcaaaggaactctctcaaaccacttggggtaaggatgccgatacaaatttccatcatcttttggcttaagcccaaactgttctatcatcacgtctgcaatcatatcggcccatggtcgttgctgaggtactccttgcgcttgttgtggcataggctcgaattgattgtattgaggaacaaactgggggtgagccagtccttcttgctgatattgaacttgtggcgatggaggctgatactgataattcaaattgcccgcctggtaattttgaaagtttggctgaatattgcgcaccaaatgtttgggaacaacttgaggtacgaccgtctgatctggttgcacatgatgaaccaaatgttctgggacaacttgattcgcagcgtgctgaccttgctgctgaatcggctgaacaacctgttgcctcaatggcatttgctgaatcgactgcacgacctgctgcctttgtggcgtctgttgaatcggctgcaccacctgctgccttggtggcgtatgctgaatcggttgcaaaacttgctgccttggtggtgtttgttgaatcggctgttgctggattgagtcaacagtaggttgaggtggtaagaacaaagctgcaacctgatcttgcgttagccgattcacattctgtcaactatgctgtggttgctctctcaccaacaaccgaggattaactaattgacctggtgccaatgatggtgcagcaggtgcaggagccgatactggtgccgttggttgagccgattgtgcattgggaggaattggctgaactgctggctgattatcagtgattaacggccgatagttcaggaaaacacctcgtggcaaataaaccggtcctgtagcttgatattcagctatcgagccatcaaccatcgacttcactatgtttgacaaagtgttgactaatatcccagattgattgatcaaagcatgttgcacggcatagtcaacctgatcctagaagttgttaaactttagctgtaccatgttgccatcttgattaagatttccaccttgaaatccctgagaaccatcaccttgaattccatgagaaccaacaccttggaccccttgagagccatcaccttgaaccccttgagaaccatctgcaacacttttatcacttggttgagctgcaccatctggagcttgttgcacttctcgatccttggaagaacctattccgggaacatcagcaattacttttactttatagttctgaacaactgtccccttgcgggtctgcatgaatgaattcaagaattggttccgttcttgctgcatcattgcttcaagatccttctgctgctcaggtatcaacttgtccggagtgatggtcacgatgttcaggtgtcaacctcagataaaccaagcttctggatcttagatttaaaagagccatctttaccagctgaagacggcaatgctggtggattctcatccatgaggaaacgtcgttgtgattctgacttctaatcggtcccgccaggcatgccaaaagcgtgttgatgtgaaaacacgaggcctgggagatcttcttaactctagtgcaagtccaaaactcgccttcgggtatgctagcgtgccagttgatttgatcctgcaatcatcaagaaacaaagacaaagaatccgtggttaaatccataaatgatagccgatcggctaggtgccgatgacgtatcatttatctttgagccggtgtcatatatgcatcgatcggcagtcataaataaataagaaagaaccaaatctacttgatcggctgtagatattaacgatatataatctctatgtcgatatatacttaaatcaagtgattgggatagatcggtcgccatgccgagacattataaatcacttagatcgaaatatatactaagaacaagattatatatgctcatagcatagccgatcacatagatttagcatgtatcggcaaatactgcaataccactctatattaagatattaaagcaaatagaatataccaaacaaagagcctaatatacttaaatacaacaagatcttaatatgaagggcagatttaacatgtcaacaaagcatataagataaatatggttaaatcaggtaagatcagctgaaaccccgatactaccctaatcggcaaccaagaagcaggctagagattgagattctaatcacgactcataagatcaaactcaactgatgtagctataagtatgaaaagaaggacaatatctagacaatcaagccattggaagtttcatagagtggtggatatcatatataatctaaatcaacatcggtatttaacctaatcggctgccttctagtagcagatgttagccgattgtaggttagatagcgatattgccagagattatgtaagatatatgataattcaacgaattacataaacaagattagagtatcataatgatgggatcactaatcccgagaacgcaagccgccataacaagttttacctcttgttgaagatcgaaaccgatgcagctcaacccgaaagcaagaactcgtcgaaacaaaacgaaagtaaaaagggtggcaatgcgccgagattgtattaaacgtgtgttagtttgattacatggggttcgggtctatttatacccgagaaatacaagatatgtccaaatcggacacgactcttatctctaacaaactctaagataccataagtccttgcggcaactttttgcccaaacatatctgtaagaaaatcacataaaatatcctaattaatagatataattgccttctcaggactttatccatgcgtggcaagcatcatgaagcacatcaacctaaaccgacaacgtatgctatgtcatattgtcgggttcggctcaatcggctaaccccgtccgacctgaactctgccaaccttagccgtagccgattcggacttcagctgatcctcactcgatttcttctcgatttcttcttcatctccgatccttggattactaaatttggtcgttaacagtgtcataccaactaggactaaggtttttttctttctttttcattgttcttttgctatttgcatattgcgcaaatcattacagatcgaatgaataaaataaacaacgaaatccatgtccatgaaaactaatttatagctacacttcttcacatctacaataacaaaatcatccatgttcttgaaaactaattcataggctacatttcttcacaactacaacaacaaaatcatccatgttcattacacttcttcacaactaaaacaacaaaatcatcttcttcacaattacatgcattcatcaaagaagaacaatgcattcatcagagaagaacaaacaaaaagagagcgccgaggggagaacgacgccggacgctggccgccgccgccacttcccccgacgaagccgccggcccccaccgccgccacctcccccgatgcaaccgcctgccgccagccgccgcctcccacccggcgccgacggccgctgcccacccgcagccccagtcaaggaagtgtagagggtggagtagaggggtagtggaggaggaggacgaggagaagaagggagaagagataaggagataaggatcgtggggtctgtgtcctgcgcgcgaggagataaggattgtggggtaatagatatttaccccggttggtattaccaaccgggattaaggatcattggtgccctgacaactattgaaccgggactaaaaataatattttgtcccgattggtaacaccaaccgtgactaaagattaataagtacagctaggctttttaaccgggactaagaatgtttttagtgccattttttttcatcaaccgggactattttggtttttgggcaacccatcaaagatggtttctctagtagtgagaggtttcgacttgttcgatatacgctctacaaatcattcccacatgcgcaccactcatccaaactatatgatttgcaaccaatggtgtgaaaacatccgcatatacagataggatacactagtggggtttcgagcagtttgatacacgtagtacaaatcattgtcacatgtgcaaaaccgacacaagagccattttaagcgctttcttatgcacggttagtcatgtaaaatataactattacaacaaatgatatcaaaatattcccatacacataaaattgacattaggaagctttcaagtgattccacacgcggactacaaatcattcccacatcggcatctacttgtgtaaaatataatttatctaacaattggaaccaaaacaaaagtcactagtacaaaaaagtgatttttgatttttgcagatggccaaaagaggttttcgcgtgcggtagaacaacccacatgcactagaggatctatgaaaattgctatcgttgcgtgcgccgggggggggggtcacccgcacgcaaaaatcgctactttcacgtgtgggtgcttatgttgtctacacgcaaaaataaaaatcacgaaaaaaaccctctgccgagcccgtccgctgcccgtcggccgaccgccttccacacacggaggagggactcacccgtcacttgcactccgccgccgcacgaacgctgtctgccgaactccgtcgcgtgcccatccgtgcgccgctgcctgcccaggactgagtttgtggaggaggggaggtgagatagagagagagagagagaggagagaagataagaatgacttgaaaattttaaagtgctaggagggaaaaagagaaggtaactcggtaactcagacttctgggggaatttttaagggggcttcctacgaaaatatattttcccatgcggtcccttaagaggcgtctggaaaaatagtgtaacatcctcaaattttaaactaaaatttgattgcatcatgctggcttttcattaatttagtgtgttctaaaaatttatttgattcttaaatggttcaagtattacttctttagaaccctactaatttccaaaccttagtgaatttgagcaaattctctcaaatttcaaactatagattatttccctagtttatcctaatattgttgagaattttatatacttcaaaccctagtgaacctttccaaattcatagtttaaattcaattttctctagaaaaaatattcaaaagtcctgaaaaacactgttcattgcactcaaggtgctcgatgaaatgcccagcccagctagaacagcccaacacccatccaaccttgcacaaagtttaggtttggaccttggggaccacatcccactcaaaaaccatggtttagttggccttctcctccccttctcgcgcgctgcctagcgtcctatcttgccgcgcgctgcgccgcagcgcgtaggcctcgagatcgcttgtgcgtgcccgactgccttcgcgcgccatcgcccgtccgacgccctcagaccgccgccgccgcaccaatcttgacgacgacaaagccaggacgacctctgccgcaagaaatcacagctcgacgccgtgcgctcccgtccaacgctgccgccgagtccgattttgattctacccgggatgaatcgcgccaattcttgccgcaaggttgaattgaagatagaaggtggtttcccctctcacaattcaaaccaatcacacccgagccggccgttttaaccctcgccgccgccacgcgtcacgcccggattggcgccaacacgtcgccagccatttctacccgcagtcaagccaatccttcacaggtaagtattcaaacatggcctcccgccactcaaattgatcttgcccgccccctcacagcctctgccacctttgccatatccaatccttgagctcatccatggcgatgatggtgtccgagctcatcctttacttttggccctataaataggaccccaatcccttccttgcccatcatcgatcatcaacaaccatagccccgcaactccgaagctctgcttcaccaatccattccatcaaccaccctcgcccgtcagtcgaacaccttgtgcgcgatcacctccacacccctccatccatcctccaccttaaataccccttaaaacacctatatcctaccatgttttagcatactagatcctaatcgaagctctacgtcaagttttacctcgccgcaccaagccgagcactgccgcccccacgctgctctgttcttcgccactgtaaagtttttccggccgcaacccatcgtttcaattgatctcggtgagttctttcgttttaaccatctatgtactccctagattctattttagcaattggtttgctctaccatgccaccctctaggctgccgacgtgagcacggccactgccaatggaggcgctcgtgggcaagtatattccgcaccttgccgaaggtcggcaagctacctaaacccttctaggtaccttgtagatgctctagaacccctccccaagccatgtctaactctctttaccctgatcaccttcatggtttaaccatgccaccgccgccctagccgctagcttagccacataccaaattaacccctccgccgccgctcgctgtcgccggagaaccctagctccctcccctcctcggctgcaacccctttccccctctagcgccgccacaatcccaaaccctagcgccgcctgccgaatttagggatcgactggaggtagaagaagagaagagagagagagactgacaggtgggacccgcacatagtgctatttcacatttaattgattttcaaactttagaagcccatatcttttaaaatatagatccaattccagtgaaacttggaccaatattcttctaaaatcattctctatcttttgagaccccttttgctatttttctattttattgtattttctctatttttcttatttttttagattttatttgaattccttttaaatttgaattttatatgcttaaccctaggtcttgaggattcttctgacacactagataatatcaatcaatctcaagacatcgagcaaggcaagttattatatatccttttgatcatttaagcctatattttacaaattatttatttatagcctttccattcaatattctattttattatgcataatttaatcatagaaacccagataatttagtattgcttatttcgctcacaatctggttaaaatatcttatacttagattgggacagtatgttagaattggatgatttccgtgtggctagaactgtctcgatcgatatagttattaccaggtacttatgtcgaacgaacgggtacgaccgcagcttctagaatggggacagacctagtaattatgttaattagcaatatggcacctctgtacagtggttcttatttttaagtcctcgcgcaggaggcaactatagccgcgaagggcaacttttaaccattaccatgtacaatggtttgtgatactcgagtataaattatatggtatatttgtaaaccctgatcgagatgacgtggtgtcatacgattagttccccttaaatacctcgggaacaccaaaactcctcttgctgctgttaacattacgttcagagcatatgaggatataagttcatggaacaggtgccacaattgttaataacttaatactgggccatgactaaagccgatgattatcagcaagtcgtggactgcgggtaaagcgtacatctgctgcagtagaatatctttgaaactattcgaatagccgtactcatggaattgagtaccgggactcatatggtaccctggttagaaatttaaagtctacatttttataaattcttgctataacacttccagattgtttattactgcttttatacctccctagtcagaatgtatagaaacttccgccgtatattagatctacgtaggattaactatgtaagtaactattattgtaaaacctttagtattgtaaaactttaatgtatgcaatgaagaactagctatattgtatgtatcaatatttactgatctagggattgatacattaatctagtcagatccaagtaattagttctgggacccgacaaatagccttattttcccgtgcggttgcttaagagggctgcctacgaaaattgatttttgcatatgggtctcttaaggagccgtatacgaaaatgatgggtcgatttttgtagacgaggacacttatggtccgtctcaacatattgaagagctcgtctaggaaagtcattttttagtagtgagagatattagaatggtttcgagcgattccattttttaccagtcatgccaacatacgcaaaactgacataagagcagtttcaagtgttttctcatatccacaagaccacaagtcgtgtaaaataggagtataactttaattttgtaaccagtggtttgatattagagggatttcgagcagttcactacgtgcactacataagacagattttattttgggatgaattttgatctttataaatcaacttgtttttactacttactagttgggcatgaggacagttagtaaagggaggctgcttatgagaaaattttccggtcgagatgatgtcgagaagctccaggatctagcttcttctttctcagttcttgcttatgttctttggttgtggttatagttatacagatcctaattaatgtgctaagactgtaatagctttaaacggaagtagagtacattagatttttttttctacacaacaaatggtacaaatgaaccacattagccttttactactacttttaagttaatactccctccatcctaaaataaattcatgtttcacccatcccgcatataccaaaacaaaaccaaggctctatcaaataaaaatgcatttatttcccgactttatttactcccaatgcaattattcaactgctagagaaagcatatttattcccgtttgcaaccccttttgtcccgggtatgcaaccgggatctcgaatccaggattaaagatgagtatctttagttacagttagtaacaccaaccggactaaaaataatttcgccaggtggctggcgctggcactgctatcttaggattctttttttcattgtttttagctgcttgcatattgatttcccgagttcctctctacatccccaaataagttgctccctacatccccaaatcaaagattcacacataacatcacaaagcacagataacataacagattcacgtcaccaattcttaacaaaaaaaacataaaaaaatctttaaaaaaatacatcacaaataataacatcctaaattcacatcacaaattctaaaaaaaaaagaatgaacataaaaaaaatccggctcgatctggcgctgccgcctaccgtgtcccctctagcagaggggagggcactgccatctcccgccacccgcttgagaggggagaggggaagggggaggagtggacgaggagggcgccgccacccggcgccgcccgctcgaaggggaagagtggaggagggcgcccactagagaggggggagggatagggaagggaaggagtggaggagaagataaaaaagatagaaagagaacaagagtagaagacaaagtataggagaagataaggaagagaaagagagagcggcgttcgagagatatatttagccccggttggtgatatcaaccgggattaaatatatgatctttagtcccggttggtgataccaaccgggactaaattttgttggggacctaacatctattgaacctagactcaaaatgatcttcagtcctggttggtaacaccaatcgggactaaagatcaaaatgtacccctgggctttaaaaccaggactatagatattttttactcccggttcttactcgaaccgtgactaatgtgattttagcctgagccagcaaagatcacttctccagtagtatctctactttcacaaacacaaatgcaatgattactaaacatgtacttattttaggataaattggatgagtaaacaatgattattatagaatgaagggagggagtattgtctccatccctaaaatgacctttcttctggtctcatagagacatagtagcattactttcatttttattgtagcaacaaaggttggttcgtaagtagtactagtacatgtcaaatctaatactccctacaccaaaatataagagattttaagtggatgaaaaatttcctagtactaagaatctgaacaacttaaccagattcttaggactaggatatttcttatcaatttaaaatttcttatatcttgggtcggagggagtatagactgttttcggtatggtaagttgggaactaatcattcggaacgaaaaacagagcaagtcattagcataaaattaattaagtattatcttagaaaaataaaaaaatgtattaatatggtttttttaaaatgacttttatgtagaattattttttacaaaaaaaaatacaccatttaacagtttgaaaagtgtgcgcgtgaaaaggagaggtacaagataggaaagggaggaaagaacatagcctagattgctaggccctccgtcccataaaaaattaggcaaattttaccacatgatatcgtgactttgcggttttagttgtaggacacctcgcgaagtgacttatgggggaagacactctcaaaagtgaaatttgctggtgaataccgcacccaccatgcacccatgatgaggaaggcggcgccggagtatgggtcttccatgatgccatcaggaggcgccgtggtgtcaggaagcagggcaaagaagagcagggcatgggggtgcggggttcggaggtcgtaagcggagacggaacctggagacgccacgaggaggcggcggcggcggttgtttatggtggtgtcgtctacagcggcggcgatcgtcttctgttgctgtcgcgtgctgcgccaccaccacgacggcctctactctgttttcacgtggccactgctccgacttcacgtcggccgccgctcctgcatgtgtgtgccaccgtgccgcgcaccgcgttgccggccgctcgcatcacaccacacagccaccgtgagccgcgtcgtcgctgggctcccgagccacattcagcgcgtcaagggagagagatgagggagagagaggaagagataaggaaataagataggaagacaaagagaaaaaaggggcaatttggtcaagccatgtaaaaaagtgggacacttctcgcctggtcagcacgaaaacaataatttaatgggtttggtgtcctctagcaaataaccatattttcagagtgtgtttccccaaaagtgactccgtgcggtgtcttaccgctaaaaccatgaaattcctatatcctgtagcaaaatttgcctaaaaactatggtcaattgctcagttgaccatgtttcgaattctaactaccagtctaatcctactttttctactttgctaatttgaccccgtttttcaaaatcaaacgtaccatttgaccctatttgcactacactcataggg

SEQ ID NO: 61081 - DNA, 12373 bp, Oryza sativa
  unsure (1)..(12373): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatctctcccacggcatgagcagtggcagcagcgctggcacgcggagagagggtgcagcttcacgtgtggagggagggggtggtggtggcaccggcgcccagtgggaggcggcagcaatggcacgcagaggaaggcagcactggtgctgcgtgcagacggagggaacggcgactccggcgtgcggaggaagggggcggtggcagcacaagcaccgcgtgtggagggtgttgacattataggcatataatgatttaatatatttcataaataaatcatgacattgcagatgtatactagtattaacgcatcattagatctacacatgtaagcttagtaaaacatgaacagataaaatatgcgcaacatactgagcatgtatcgaggttacgtaaaaatcggttgctcagcagggaatactcgcggttgcaggcgtcggcgaaggcgcgcagcacgcgagtgaacaggaagacgagccgtcacgaacgaacagggagcagtcgcgcgaagcgcttcccaaaaaccttattgccgccttctcccggtgcaggacgtcgaaggcataggttccggagacctgctctccctatcgctagtggatgccggcgagcgggatggagtagtctacgagtgatggcgcagtacatagtaggaggcaaaacctagattgatttcaagtgtgttgtgtgaagatggcggctcggtttatatagagaagggtcgcttgatcagggcgctcgcacgatctccactccgcgtaaccgaaccgtataagtcacatgtaacttatccggagtccacgccgttttcacgcacaggatttttcggaacgtttccaaaacaaaacaaatccgaatttccctcagcaaaacaaagctgtaaaaggaggttgcatctgcgcaaggtgaggaacgaattttggcggaccattcgacgcgtacatcatgcacgcgcgccgcctgtcctgccctgccaggcgaggcgaggcgagcgagcacgtgtgttccccctcttctctccaccacacatgcttcaagtggctaggtgggcatcctcccttttaaggaggtccccctctcctagaataaccaagatggtagtaaactccgcatgcatgccatcccatgaggtgggcttttatgattttccaaaaaaataatcttcgagtgggctaaggcccatccattaattccaacaatcacccaccaaatctcgaaatcccactgagatttgccttttccaatttactgtttatataccagcggttcgatggagaccgattaagattgaacagccatctagaactccaagtcttgtgtaagcaagtttcactcagagtcttatctggtactagaccgtctatagactacccctcggatggagcgtataagtcatactccttagtctttagtaagcttcctagaagattcacccaacatcttcatagactgcgaccaacagtcaagctcacaaaggtaagttctttcaagaatgctctgcaggacagcattttcgctaattaaagccaacaaaactcattaaggcatagccaacctgccttacagctcatgagagtacatgcatcttcacttagagagggcatagaattgtactctcctcaagttaactaatggcttgttcttcccaggttctaattcaaaggatctccgatcacatagactgggttaccaccatagtataactcacatgggtctcaaacccatctccttcgatgcattgtctatcacatttcgtgatagtcccttcgtgaagggatttgccagctttctagatgtttggaagtaatccaatgttataactccggagtttctcaatttcctgacagacttcaatcgtcttttcacatgtctagacgatttcatattatccttagaactgttcactttgacaattaccgtttgattgtcacagttcataagaatagccggcaccgatttttcaacaataggtaggtgcattaatagatcacgcacccattctgcctcaacagtagcagtatccagtgccgtcagctctgcttatatggttgacctcatcaaaatggtctgtttgcaagacctccatgaaacagcaccaccacctagtgtgaagacatatccactagtggctttgatctcatccatatcagagatccagttagaatcactatatccctccagtaccgcaggatacccagtatagtgaagccccaattccatagtacctttcagatagcgcattactcactcaagcgcatgccattgatcatctccccggttagaggtaaaccggctcaatttgctcacagcaaaggagatgtcaggcctagttgcactagccaggtacataagcgagccaatgatttgggagtattcaagttgattcgtagcaattctcttattcttgcaaagtatcaagctaggatcataaggtattggagaaggcttactgtcaatgtaaccaatgcgattcaagatcttctgcacataataggactacagaagtgtaattccattctcacctctaattagcttaatgtttaggataacatcagctactcccaaatccttcatatcgaaattttaagacaagaatgatttaaccttatttatcacctcaatgtttgtcccaaatatcagtatgttatcaacatacaagcaaattaaagaataactccctcacccccaccatagcgatagtacacacatttatctacctcattgattgcaaagcctgcagatgtcaatgttttatcaaatttctcatgccattgcttaggagcttgtttctgaccagacaaagacttcaacaatttacacaccttgccttcttgaccatcaactacaaactcatcgggctgatccatatatatctcctcatccagctctccattaagaaaagatctcttaacgtccatttaatgaacgagaagaccatgtgagattgctagggaaagtagcacacgaattgtagtctatctagcaataggtgagtaagtgtcaaagaaatcttcaccttctttctgagtatagcacttagcaacaagccgagccttgtacttttcaatagtaccgtcaggcctaagcttcttcttgaacacccacttgcacccaacaggtttacacccatagggtcgctctatcacctcccaagtcccgttagtgataatggaatccatttcgctacggacagcctccttccagtagtctgcatctggagatgcatatgcttttgaaattgacttagaagtgtcatccacgaggtacacaatgaaatcatcaccaaaagacttagccgtcctttgtctattactccttcgaggaccttcactgtcattctcctcagtgacatgttcatgtgtatgttcagtttgttctggtgatgtgattgaactgggaattatttcagagggttggctagaactactatgtgtatccttcattaggaaaaagttcacaaagaaggtagcatcacgagactccataattgtaccaacatgcatgtcaggtacctcagatttaactattaaaaatctataggcaatgctgtgatgagcatatcccaaaaagacacagtccacagtcttaggtccaagtttgcgcttcttcgttattggtacattgactttcgccaagcacccccatgtgcgcaaataagaaagtgatggttttctcccaatccatatctcatatggtgttttgtccttatttctattaggaactctatttaacacatgattcgaggtcaacaatgcctccccctaccatgccttaggtagtcccgcggtgtccaacatggtattcaacaagtcagtcagtgtgcggttcttcctttcggcaatcccattagattcgggagaataaggaggcgtcctctcatgtatgatgccatgttcctcacagaataagtcaaactcgtttgagaaaaactctccaccacgatcagacctaagtctttttatctttctgtcaagttgattttcaacttgtcttataaactttaaaatagtctagagcctcgtctttcattatcaacaaatacacatagcaaaatctagtagcatcatcaatcaacgtcattaaatatcgttttccacccttcatcaacaccccattcatttcacaaagatatgaatgtaggagttctagaggtaccaagtttctctcctcagcagccttgtgagacttgcgaggttgctttgattgcacacaactatggcacttagaacctttaaaaatggaaaacttacgaattaaacacatgctggaaaactgagacttcaagccaaaattaatatgacataaacgtgagtgccaaacattagcctcatcatctacactgccacaaatatggttcatgacttactgcagaaaatcagaaagggaaaagcggaacaggcctccgcactcataacatttaccaataaaatatccatgtttagacaggactattttattagactcaaaaaccaacttaaatccatctctagttagacgggagccactaacaagattcctgtcgatagtagggatatgctgcacgttctttagctgcacgatctttcctgaagtaaatttcagatctaccgtgccaacaccatgaacagaagcatgtgacccattccctattaggacggtggaaccccgtgcgacctgataagaagaaaacaatgagatgtcagcacaaacatgtacattggcccctatatcaatccaccaattagtagactgattaactgaaaaaccagaaggtaaattatcatacccgcttccgtctctagtgttgccaatggtcacattagcagacttagaagtctgccctgcaagtgccttcatccccttgcgttgtggacacttcctggccagatgaccaggtaggccacacacaaagcaagtcctctcatcctgattaggattgttgttcttcttcttcttcaagttggtggtctgctgagctttgtatttccccttgctcttgttctgggccttgtgcacaacattggcgctggattgcccaccatcgcccttagacgcagagtctttttcccgagttttctcctcaacatcaagagacgctatcaacccctcaacggagtattcctgtgtcttgtggttgagtgcagtaccaaaacctctccaagatggaggaagtttcgcaataatgcacccggccacaaattacatgggcctgctcgagtttcttagccatggtctgtattacatgggcctgctcaactacagaacggttatcagccatcttgtagtcatgaaacagctccatgatgtacagattattgctagcatcagtagcaccgaatttagcaatcagtgcatcccacaactccttagcgtcggtcatatgtatatacacctcgaccagacgatcgccaagaacgctaagaatgcatcccacgaagagagtagtggcctcgtcgaattctttctgctggtcagcattaagaacttccataggcttgccagtactcacccagaagcatttcatagctgtcagccacagagtgatcctgatctgccatctcttaaaatgcacaccggtgaatttatccggcctcagtgcattggcaaaccagccattgtaaaatcacagtgcctataataaggtttttggattgttgagattatagacatataatgatttaatatattccataaataaatcatgacattgcagatgtatactagcattaacgcatcattaaatctatacatgtaaactaagcagtaaaacatgaacaaatgaaatatgcgcaacatactgagcatgtaccgaggttgcgtaaagatcggttgctcagcagagattactcgcagttgctggcgtcggcgaaggcgcgcagcacgtgagcgaataggaagacgagccgttacggacgaacagagagcagtcgcgtgaagcgcttccaaaaaccttatcgccgccttctcccggtgcaggacgtcgaaggcagaggttccagagacctgctctcctgatcgccggtgcacgccggcgagcgggatggagtagtctacgagcgacgacgcagtacagagtacgaggcaaaccctagattgatttcgtgtgtgttgcgtgaagacggcggctcggtttatagagagaatggtcgcttgatcggggcgcccgcatgatctccactccacgtaacctaaatggataagtcgcgtgtaacttatccggactccatgtcgttttcacgcaccggatttttcggaacgtttccaaaacaaaacaaatccgaatttcccgcagcaaaacaaaactaaaaaaggaggctgcatctgcgcaaggtgaggaatcaatttcagcggaccattcgacgcgtacatcgtgcacaccggatttttggaacatttccaaaacaaaacaaatccgaatttcccacagcaaaacaaaactaaaaaatgaggctgcatctgcgaaggtgaggaactaattttagcggaccattcgacgcgtacatcatgcacgcgcggcacctgtcttgtcctgctaggcaaggcgaggcgagcgcgtgtgttccccctcttctctccaccacacatgcttcgagtggctaggaggccatccccttttaaggaggtacccctctctagaataagtaagatggtactaaactctccatgcataccatcccataaggtggtcttttgtgattttttaaagaattaatctgagtgggctaaggacccttcattaattccaacagaggaagggaacgacggcgccgacgagcggaggaagggcacagcagcggcactggtgcacagagagaggggtggcggtggcggcagtctgcggagggagcggtggcagaaccggtgcacgacggcagcggcgactgtcgcgcggcgtcagtggccgctgctgcggtaggaggccgtgaatttgtcgttggatattaatctctgttggatttgactaagatttgtgtttctgcttcatcgtgtgccatttgggatccataaaataggacaatatgccgtaaaaaaactgtaaaaatttatgtcaaattttttttacttcattttgttaaaaatctatcaaattagagtcaaatttgttaaattgattcaaatgtttagattgatttgaattttaaaaattcaagccaattttgtcaaaacatccaaatatatacacattttgatataacatgatcaagaagtaagggcaaaagagtattcgttcattagttaaccctgttaactcactttaacggaatagggtcaagcttcatcttcgattggtaattagacttccaaacagggttaaatatgcaattaccactaaaactaagctaatatcggatgtggcacattctattaccattaatttagatggatatatttttttctaggatatatcacatccgatactttgaatttttttagagcgggtatacgtcccactaacacgctttttaaactgctaaacattatgtttcgtgctaaaacattcaatataaaagttgctctaaaatattaaaattaatctatttttaagtttgtagtaattaaaactctattaatgatatattaatagtatcttgatttacgtaaaagactttatcttcgtattcatttaacagagaaaataacaccacctatatctcgcgatcgagtattgataagagaaattcatgcgtcactaggcctgccctacagtagagagccagtactgtccactgacgacaggactgatccacgcactcaccaaaccgaaaatcgcagcaagcatgatgaaatagtctaagtccattattatgcccatgagagttacatgatgaaaaaaacatactccctccataaaaaaagccaaaccccaaaccctaaattttcgtgtccaacatttgactgttcgtcctatatgaaatattttttataattggtattttcactgttgttagatgataaaacataattaatactttatgcgtgacttgtctttttaatttttttcataactttttttagattttttttagagggagggagtacatggatttgggagccagtaataggcactggtggagtgtcattgattcatcaaaaaacctgtggctggctgactggctggtagtactgaggatatgtcagtgatgatctttaaagtttaaactgacactgagaaaaaggcaggatgcatgcatgacctttttgagggataggtgaaagtgatcagacagaagaaacgcattaagtatttgaaaagcctgagcaaaccacagtacggcgccattgaggccatcattattgtcattgtgggaactactcctaggtaaagaaatggctgtctagtctaatggtaaaatcattccataatactccatgctcctcatatctcatgggtgtaatgtatgtatgtgttgcgaacagatattatataaagtgtcgtatagtatgtttgggcactaataaaaaactaatttacagaatccgtcagtaaaccgcgagacgaatttgttaagcctaattaatctgtcattagcaaatatttaccgcagcaccacattatcaaattatggagtaattaggtttaaaagattcgtctcgtaaattagtcgcaatctgtgtaattagttattttttttagctcatatttaatattttatgcaggtgttcaaacattcgatgttataggatgtaaaatttttaggtgggatgagaacatgccctcacttgaaacttttgcttgaaccttatgcatattcatggtgaatactccctgctcctcttttgtgccatcatttggccatcctacacagtcaaatcacaatcaacaaagatgtgtgcatgatgcatttctacacagtcaaaagtgcaggtttgggagtttggaatttggattttggcaaattcagtgggcccacaaggacataattttgacgattccaaaatttagggctaatttacaaaacactcccacacaaacgttgccaaaccaaaattttggtattgctaacaagctgtttttataggtcaattttgacataatccaaactaatatttttgatagtgttaaaatttgtccatccctttgcgctaccgaaaattctagtagcgtattaaaccaaaccagccttatacccagagagattcaaatatgcaattcaattttacgaataattaaattaatctctaatttttatattagtaagacattattggctagaattaggaattaatccctccattattaaatgtgcgatgcgagtgtactaatttatattatgcataaatattaacatatttggtactgtgaaaaccacatcaatagagtatttatggctagtaatctggttttcctttatggtgcggtagtgggctccataaaaatatctccgagaagacaacacctagtggaaaaagtaagtgtcagtgttaattaagggcaataattaaattgaggctacgcgtcaagcctaggtctatacgagatatgagaatctatagctgtgtttagttggtgtgccaaaatggacgtatatttgaaatattaaacgtagactaataataaaataaattagattctgccttgtaaactgtgagacaaatttattaaacataattaatccatcattaacaaatgtttattgtagtatcacattgtcaaatcatggtgtaattaggcttaaaagattcgtcttgtaatttacatacaaactgtacaattgatttttttcgtgtacatttaatgctgtatgtatgtgtataaacatttgatatgacggagtttttagaagtttaaagttaactaaacactgcctatgtatatctaccgttcctgtataattgtccccattagttgtgattttaggcagccaaatcaccttatttatttgaggcattagattgatgtcaaacttcaatagaaaccgttagatttatattatgtctacctgctgctgacttaattggcttcctcctgccactgctcgagaaacccacggtagttcggtttgtaaactctttagtcctgggttataaaccgagacctgaatccgagattaaataacaccaaccgggacaaaaatgatgatagtgccaagtggatgtagtcttgtgtcaccatgaaagcacttttttttactagaaactgccaataacaattcgcgtggctaatctcaattattctatcataaaactctcctgcaattcttatcctatcttactataaatataaagttatcccctactaactccttaagcttaatatgcaaagataccacatcatcatccactaacaagatgccacatcatcatccactaattaacaagatgacacatcatcatccactaacaattatcacatttaaacatcatgcaaacatactatatttttatagtttttataatttaagagcttttcaaatataaacttgttaaattatcatccaacataattcacacaatattttaatgtatatcctatatacttatatagttcatcctcacttactgcttaaatgattaatctatggtccaaattatctttctcctttttttctataattaagtcatatcacattaattgtttttagtctttagatgattaatctacagtccaaactatctccctaattttcttcttccataaagtcataccaccttactttttacgtttgaatcaccatttacatactatttaaatttaaattatcatagaccatattaatttacttaatctgatgttatctagctatcttacacgttattttttttgttatcatactaaattctcgcagcaatgcgcggggtttcacctagttatataattagaacggtcctcacacaccattgaaatcctctatcttatataagagctggcatatcgcctttgtcccttcccgatcgatgctaatcacaagtcggccttcggttcatttcatggaacacattaatttttttcaattatccgtagtctataggatactgtttctttttttttagggcagtactacatagtttcttagtcagaaaaagtatgaattacccctcgaactatcgtggtcgtccgaattaccccccaaaccacaaaaccgggcattcttcatcctcaactacacaaactggacaaattacccccctcgacccaatccgcggtggttttagtccacgtgacgtacgcgtggcagcccagtcagtcctctatttataaaaaaaaaagagtaaattgcatcttagggctactatttcttacgtgtgttgtaacttggactagtgtaaaataaaacttttcactttggaacaagtatgtttacagaaggttttaatttggactatcttcttgttcctccagctccctttcttcctctcttttctctgtacagctcacggtctctttctcgatcaggcgtagtgcatgagaagtcaagaaggaaaacccttcacagggcagccacccaccgaaattgagctcgagctcaaatgtaggcggcactgggaaggcggagcttgagcactgcaaaacttgctgaagtgcgagcggcacatgtggaaatttagcgcaggcgcgcaacacgtatagcactagcggaggtcgagcatgagctttagcgtggctgtctgctactccctccgtttcataatataatactttctaccactgcccacattcatatggatgttaatgaatttagacacgcatatatatctagattcattaacatccatttgaatgtgcgtaatgctacgaagtcttatattatgaaatggaggaagtacttggcttagttcttatagtcagttcagaaagtagcagcaactgtatgtcattgccggccagcttcttcatatgctacttgctaccagtaggaatacttgttgtgcaccctctgctttccttgaaattaagcaacaagcactagctagttgatgattgaaaatgcaaactaccctttgaattctttggaagactttacagattgaaggagagagaggaggaagagagttggaggaggaagaagggagtccaaattgaaacatcatgtaaagatatctggcccaaagtaaaaagtttggctttagtctagtccacattgtaacaatggtaatcaaaggtggctcaaggtgcaattcacataaaaaaaattt

SEQ ID NO: 61082 - DNA, 1251 bp, Oryza sativa
  unsure (1)..(1251): unsure at all n locations
cctccccggcgttccgccccgcccacccgccgccgcgtcctccttggcactccgcccccgcccgcacgcagccgctgcatcctccccggcgctccgccaccacccgcacgccgctgccgcgtcctcccccgcacgccgccgccgacccgtttgagagagagaggaagagtgagagagtgaagagagaggaagagatgatgaggagatgataggtgggtcctatttttttaaaaaaatggagtgctgactggattgccacgcgtacgccacgtggaccaaatccatagcggattgggtccaggggggtaatttgtccggtttgcatagttgagggtgaagaagaatacccggttttgtggttcgggggggggtaattcagacgaccgcgatagtttgcgggggtaattcgtacgttttcctttctagtcccatattctatacccaggtagcaaatttcaaatgcttccttggtccaattttctcaaattttcttactctgggccgacatatgtatatagaggaacaaattttactaatagcccactgaatcatcatgccaaactagacatagaatcattctatgggatagcaaacataatttttactatataattgtcttcctacggttccaatataataaatgctatgttggtaaaattaatttcaggttacatattacctactagctaataatagttttgcaatatctgtttgcttttataaacaaggctttcgcaactcattccactatacctaatttttgtaaggttattgttagacggatatctattttctatttgtacaaggggttttctacatatatacctatatatatttgggtctagtgcttcttagatgaatacaagtgctaattcttaagccagaactaggttagacttctcatctccctagaaacgatttttttcctctctccaataattacctgcttgaactttgtgtggaacactcctgcctcttcatctttgaagccatgaggttcctgttgatttagcaaaacatagttctcacccgtcttcgctccgagtatgagtcgatttgtgcacagttgcttgctcggcaccccccgtgttactctcatggaagctctcaaggagatttgttctgaggagattcatcttcgagaagcgggtattctagcacatccttcttcagtattagcttttcgnnnnnnnnnnnnnnnnnnnnnnnnnnnnnnnnnnnnnnnnnnnnnnnnnnnnnnnnnnnnnnnnn

SEQ ID NO: 61083 - DNA, 771 bp, Oryza sativa
ggcgaattcgagctcggtacccggcggtgaagtcgtagacgcccaacagcagcggcataataggccagccgggtaggcggaggcaccactcggcggcgacggaggcaggccggtggtgaagacgtagacgcccaacagcagcggcataataggccagccgtgtaggcggaggcaccagtcggcggcgacggaggcaggccggcggtgaagacgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccagtcggcggcgacggaggcaggccggtggtgaagacgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagttgtagacgcccaacagcggcggcataataggccagccgtgtaggcggaggcaccactcggtggcgacggaagcaggccggcggtgtaaatgacgatgcccatcaacggtggtgtgaccaaccgaccgtgtaggcggggacaccagtcggcgttgatggaggcaggccggcggtgtaaatgacaatgcccatcaacggtggtgtg

SEQ ID NO: 61084 - DNA, 1611 bp, Oryza sativa
  unsure (1)..(1611): unsure at all n locations
gccgctccggggctgggcgccgtactttctgccaaatgggtcgggcacccggccgcacagcgaggcggtgctcgatcacctccctaggaccccgggcatatctgacggcttccatgcgaagacgtcggagttcacccgcaggaaggagacgagcgtgcttttctatttggcgtccaaggtaccgtcaatcttggcggttttggacggatcatcgccaagggaaatatccttgacggggacctcgtcggccgaagcgaggcgcttcttcgaggcgcgggacgctgaggactccgagggctgcggctcggtggctgccaccaagttgtcggcgcgctgctccgcgcaggccagggcgaccttcacatcgtcaaagacagtgatggggtcactggggcccggcatcttcatctggaggtaggcggccatgaacttcaccaacgagggcctgcccaggaccgcattgtatggcagattgaggtccgccacgtcgaagtcgatccgctcggtgcggaagttggtggagtcaccaaaggtcaacgggagctcaacgtgacccagaggccacctatgtcccggggtcacgccaatgattggcaatgacggctggagcttcattcccggagccttgagagcgtcaaaggtagctggggagatgatgctgaggctggctccctcgtcgaccaggacacgcttcatcttgacgttgtggatggtgggggagaccacgagggccaacttccctccccgagtgagcactgtcggatggtcgctctggtcgaaggtgagtttcacctccgaccagcgcgccttccgtgccgcctcgtgagttgggacggcggccagaagctcacgcctcatggtcttgaagccgcggcgggaggtgtgagcgcaagcccccccgtcgagagtggcgacggttccctgatgtatctggaattccagatccttgctgtcatcgccgtcatcagcgggggccttcttcttggcctcccctcgccggtcattggcgggggtcgcgggggctttgccctcccatcgactctgccgcttctcctcatcggccttccggaaccgctcggccaagttcttgaccgagcggcagtcggcgaggctgtgccgataggtgttgtgcaccgagcaccacttgtctgccgaccgaccctcgccggagggagcagtggagctcggcttgtcgccggtggctttttccttgcgcgggagccgtgagggcccatcggccgcaaggacgtggccctcgtcatcggagcgggccggcttcctttttcccctcctatctcgtcgcttaggacgtggccctcgtcatcggtgctgggcgagtttcaggcccatgcctcctccttccgcgccaccttgtctgccagctcgaagagctcggcagtggtcatgggctccttggaggcaatcttctctagcatgcggttgtgccgcacgccattccgaaatgcataaacgaccgcgtgggccggaatgcatggaatagtgttgcggacctggcagaagcgttgtatgtacgagcggagggactcatcgtnnnnnnnnnnnnnnnnnnnnnnnnnnnnnnnnnnnnnnnnnnnnnnnnnnnnnnnnnnn

SEQ ID NO: 61085 - DNA, 986 bp, Oryza sativa
  unsure (1)..(986): unsure at all n locations
cgaaagaagaaggatttgcggcatggtcattcttctcagatagctgggggttcttcttcaaagagtactggctcttcttctcaaaagagtcctagcagtttagatacacaggagatccttacgttactacatcgcctcattacttctgatttgataggtttagttggttcggctgctttgacttctgcacaatctggctctgctatttatggttctcactcttccaatgagagattatcatctgcttcaggtattttttccatggattcttgattatggtgtttccttccataagatatcagataagtcttgcctttcgtctatttgttctccttcagttcctataactgtctgaaccaccgattgtacccctctttctgttgttgttctcctttcttcgtttagtgttcctatcatttcctatgttccaaatctgaccatacagctcatgttcgttggacaacttgctgattacggttgccatgttattcttgattttgactcgcgttgtgttcaggatcatagcacgggtctcctggttggtattggccctcgcttccattattcacagcatctttgggagcttgactgactgttttctttccttgcttctgctatagcatccttcactcagtggcatcattgttggggccatctttgtggctctcgtctgtcacctttagtttgtcaaagtttattagggtctatgactggagatatatccttaaatcaatgtcatggttgtaaacttggtaaacagatacaacttccctatcatcctagtgagtttgtgtacaagcatccttttgttcttggttattctgatgtttggggccctgctccctttacttcaatacggggtcatcactactatatctgtcggagatatgggcctgggggtatgcaaagtgaggggatgttaccttnnnnnnnnnnnnnnnnnnnnnnnnnnnnnnnnnnnnnnnnnnnnnnnnnnnnnnnnnnnn

SEQ ID NO: 61086 - DNA, 2639 bp, Oryza sativa
ctgtcacctttagtttgtcaaagtttattagggtctatgactggagatatatccttaaatcaatgtcatggttgtaaacttggtaaacagatacaacttccctatcatcctagtgagtttgtgtacaagcatccttttgttcttggttattctgatgtttggggccctgctccctttacttcaatacggggtcatcactactatatctgtcggagatatgggcctgggggtatgcaaagtgaggggatgttaccttcccatccagccacgtgactctatagcctggccctccccccgcgcctcgcgagtcgcagaagcagccggggggcctcggggtgccacgtcacgcccttcgggccctcgcgctgcctcgccccaaggccctcgcccaactgtcatgtggcggggggagcgtgcgggaaggagacctaggctgaaccgccatcaatgcgcgcggcgccccaactgtccctcaccgcgtttaatgctgtaagggcagacgtgtggtgccgtccgactaacccacgtcaatcgagtgtgaccagactgtgacaggcctgtcaccggtcacgtccgattggatgggtggtcgtgcccccacgttcgcctctgtcttcagcggagtggaggcaggtatgtcccgtcccatcggagcattatccggagttccctccacgtgaggaggaccgccacaagtcttcactcatttaagaaggaatgacagggttgtcccctgtgtcaggcggggggcggcgctaggtcccactcaaggacggactgctcttagcttccgggcgaaggcacggatcatggtccagtcaaggtaaagtgggtccccctcccgtcaaagagtaagtggaagcggcgcatgtggtatccccttgaattacaaaaggaggaccttgcccaccgagaaaagggacgacactcagtaggcctgagctctagaaggagaagatcaagagcgctctccggagttcaggaacctttgtaacactcaaccataaatcccacacacaggagtagggtattacgctccatagcgtcctgaacctatataatcttgtcgcccatacgcgatctagaaaccctcagggaggatacacgatctcgagaggcaaaccctttcccccggccgaactcacaaaaggctagagaggatcacttctcgacagctggcgcaccaggtggcgcttcaaagagaagtcgttttcttccgccccaagtattcctccggcctcgacgatcatggtcgaggtcttgaaggaagaagtggtggtgcacacccccactcccttcgggagtgaggatgctagcgggagccgcggcccccatcaccgtcgccgcaactctcggactccgccccgccgcgacccctcgcggagggaggatcccacccggtcgggtggctcagccctctccccgcctccgggcagggggaagccatggcgcatcggagcgcgacaccgcctgacatacggcgacagcggctcgccccgaggcgcgcttcggacagcgggagcccttctacggcatcctcccgtgaactcggagccggagacccccgtcaggcgatggttggacgacgtcgccaacctggtcaccactacccagcggtagctggctgtgggtggccgttccaccgccactggtatgtcacgcacccccccaccatttcctcatcggtgaaaaggagcgcccgtcggtcagccatgacctcgaggcggtccacggccccaacatcgtcgggggcctcgggaaatcagaggcatcacgatggcctctacggggagcaggacgctcggatcaacatcgagcgacgccaggacgagcgccgtgctgcccgcatgggagaaggcgcatcctcctccagagtgtagtgttcctccttgcgaggcggcccgccccccacgttcacccctggatggactggttgtaggggcttcgttgtgagtctccagaacgtccggtggcccccgaagtttcgtcccaacctcacggagaagtatgatggcagcattaatccctccgagttcctccagatctacaccacgatcatcacggcagtgggggggcgatgaacgggtcatggcgaattacttccccatggccttcaacggtcaggcgcgcggctggctgatgccccagccccccgactccatccactcctgggtggacctgtgccagcagttttcatcacgaacttccagggcacgtacccccgcctaggagaggaggcagagctgcatactgtgcaatggaaggacgatgagtccctccgctcgtacatacaacgcttctgccaggtccgcaacactattccatgcattccggcccacgcggtcgtttatgcatttcggaatggcgtgcggcacaaccgcatgctagagaagattgcctccaaggagcccatgaccactgccgagctcttcgagctggcagacaaggtggcgcggaaggaggaggcatgggcctgaaactcgcccagcaccgatgacgagggccacgtcctaagcgacgagataggaggggaaaaaggaagccggcccgctccgatgacgagggccacgtccttgcggccgatgggccctcacggctcccgcgcaaggaaaaagccaccggcgacaagccgagctcca

SEQ ID NO: 61087 - DNA, 1467 bp, Oryza sativa
taggtggcctctgggtcacgttgagctcccgttgacctttggtgactccaccaacttccgcaccgagcggatcgacttcgacgtggcggacctcaatctgccatacaatgcggtcctgggcaggccctcgttggtgaagttcatggccgcctacctccagatgaagatgccgggccccagtgaccccatcactgtctttgacgatgtgaaggtcgccctggcctgcgcggagcagcgcgccgacaacttggtggcagccaccgagccgcagccctcggagtcctcagcgtcccgcgcctcgaagaagcgcctcgcttcggccgacgaggtccccgtcaaggatatttcccttggcgatgatccgtccaaaaccgccaagattgacggtaccttggacgccaaatagaaaagcacgctcgtctccttcctgcgggtgaactccgacgtcttcgcatggaagccgtcagatatgcccggggtcctagggaggtgatcgagcaccgcctcgctgtgcggccgggtgcgcgacccatttggcagaaagtacggcgccaagccccggagcggcaagccttcatccgagaggaggtgacgcagctcctggaggccggcttcatccgagaagtcatccacccagagtggttggcaaacccggtggtcgtcccgaaggccaacggcaagctccgaatgtgcatcgactacacggacctcaacaaggcatgcccaaaggatccctgccctttaccacgcatagattagatagtcgactccactgcggggtgcgaccttttgtctttcttagatgcctactctgggtatcaccagatccgcatgaggaaaaaactgctttcattactcctgtaggcaccttttgttatacaactatgccttttggactcaagaatgtaggtcctacttttcagcgcatgactcgcattactttgagtaatcaaatagggcgcaatgtagaagcgtatgtcgatgacctggtggtaaagacgcaccaccaggacacattgttgcagtacttggccgagactttcgacagtcttaggtccacgcgcatgaaactgaaccccgaaaagtgtgtgttcggtgtgccggtgggcaaactcctcggttttctggtctcctcccaaggcatagaagctaatcccgagaaaatacgcgcgatagagagatgcgcccccccagcaagcttagggatgtgcagtgcgtcacgggatgcatggccgctctaagtcgattcatatcgaggctgggagagagggcgctgcccctaatcaagctcctcaaacgccctgggccgtttgtatggacggaggaagcggagcaagctctcaattagctgaaagcttacctcacttcccccccatcctggtagccctggggccagaggaaccgttgctgctctacttggctgcgacaccccacgcggtgagtgccgcccttgtagttgagcgcgac

SEQ ID NO: 61088 - DNA, 7095 bp, Oryza sativa
  unsure (1)..(7095): unsure at all n locations
agaaaatacgcgcgatagagaggatgcgcccccccagcaagcttagggatgtgcagtgcgtcacgggatgcatggccgctctaagtcgattcatatcgaggctgggagagagggcgctgcccctaatcaagctcctcaaacgccctgggccgtttgtatggacggaggaagcggagcaagctctcaattagctgaaagcttacctcacttcccccccatcctggtagccctggggccagaggaaccgttgctgctctacttggctgcgacaccccacgcggtgagtgccgcccttgtagttgagcgcgacgaaggcaacacgcgtcgcgagcccggccatcagaagggaccaggggccccctttactggcgatggcccctcgtcccccgacgacattccgagacgcgaaaacccgatacccacaggcccagtagatgctttacgcagtcttaatagcctcaaggaaattgcgccactacttccaagcgcatcgggttttcgtcgtgacgtcttaccctctcggcctaatcttgcacaaccaagagggtactggtcgggtcgtaaagtgggccatcgagctcgcttaggttgacctgcacttcgaaccacagcatgcgatcaaaagctaggttatggctgacttcatcgcggagtggacctcggcggacgaccctgttccgtccaaagttccctccctccttggagatggaggagacccaaacgccgacatttgcgcggtgcactaggttatgcactttgacggctccctcaaccttcaaggtgcaggggccggagtcacgctgacttcgccgagcggggatgtcctcaagtacgtcgttcggctcgatttccgagccacgaacaatatggtggaatatgaaggactcctagtgggattaagggcggtggccagagtgggcatccgccgcctcatagtcctaggcgattcccagctggtcgtaaatcaagtctccaaggagtaccagtgcaccgacccgcaaatggacgcttacgtccgcgaagtgcgacgcatggaacgccactttgacggactcgagctccggcacataccccgacgcgacaannnnnnnnnnnnnnnnnnnnnnnnnnnnnnnnnnnnnnnnnnnnnnnnnnnnnnnngaccttcgaggaaagactcgcacagccatcggcgcgggttggaccacccaagggacccccgcaccacggtttccgccccgacccctgacgacccacgggtctcggggcttgagggggtcgaccctgacccccctcgtcaggtcgtttggatgactgacattcgggcgtatcctcttcttgaggatggcacagaagatgagaagctcgcgcatatctctaagcggtatgtgctcgtagaagagaccctctaccggtgtgccgccaatgggatactcttgaagtgtatttctcgagagcaaggcatagagctcattgccgatgctcatcagggtgagtgcagggcccattcggcctcacgcacattggtttgtaaagccttccgacaaggtttttactggccgactgcattgcaagatgcccaagaatgggaccggcgatgcaaggcatgccaattccatgccaagcaaacccaccagccggcccaagccttgcaggtcatcccgctctcttggcctttcgcggtctgggggctggacatcctaggacccttcaaagcggcccgaggcgggtatcagcacctgtacgtcgctattgacaagtttaccaagtggcccgaggcttacccggtcgtcaagatagatgagcattccgccctcaagttcatcaggggcatcatgtcccggttcgaagtgcccaaccgcttcattatagataacaacacccagttcaccagtgagctgtttggcgactattcctgtcccggcgcatggagatgcctacccagcgcaccgcgcgctccagccgtttgatggcatcggagagttggccaggcccaaactcgtcgcgaggtggcggagggtcacaatctccccagcttggtcctacaccaggcgcccaggtcggcgagagtgtcttgagccgcggcaagctggctgaccaattccgccccgccgggctgcccgcctgccgccaactccttctcccgggcctccagctcggaagtcctcaccgccatcgccgcgcgctcaacacgggcgctctccagatgctgggcctcgtgcccagcaatggcctcctcacgcttggttagttgctcgcccagtcggcacgccgccacctcctcatgcctcggcctcgcgttcggcaagcgcggcctcccgttcctggcatgcgtcctctcgaagccgcagctcctccgcacggcgagccaccaaagcctctgcggtgagggtggtcaggttgcgcttggctgcggcctcctcacggaggcgaagggaggattccgcctcggccaccactctctcgtgggcggccaaggtggtctcgccatggtctagcatgcgcgctcgctcctccagcgcccgggcatgctcctctagcgcccgagcatgctcctccagctcccgggctcgctgcgcctgttcccggccgcgctcatcctgttcgcgctggttacggtcgaggagctcgatcagtcgacggatcgtggcctcgaactcctgcatggagcgggcatgctcgtctaaggccttgcactcggcctcgagcgccgccatccgagcccgcagcgaggcgtcgacctccgatgcccgctgctcttgggcggcagccgcgtcgaggtctccacatgcgtcttcgaccctcttcgccagatcctcggcgtgggcctcgtactgcaaggggatctcgcccagcgcctcttgcaggacgcttgaagcgatgatcgccgcctgccgctcctcctccgtctcccgtatgaccgagtgcagcatctgctcgcgcgactggatctctgccagttgggcttggcgcattttgcgccccacctccaccatgtcgtccatggcgtggcgcccctcgtcaacccgcgcgcagtccgccgcgagctgcgcccactccgcctccagggccgcccgctcgtccgtcagggcttgaacttgggcgttgacccctcccggacggtggaataggcggcggcgagcacctgcaggagtggctccatacccacgggagttggagaagaaaaagtcgcggtccgcccccgggacggcggagtgctgctggacccccgcgagactgggagctgttgtcacgtcctgataaaatcatcccaaaataaaaatcattttctaaaaggaataatagaattaattaaaattcgaaaagaaattgacaaacactaaaatacatgccagaaaaattcgaatgtggtccggagaatttttgttaaattctccttggtctaaaaggagccctcaaattttacttgaattttcagagcaccaaaaatatttattaaacaacaacaacaattatcaaagtttattaaaaagaaaaacctaaaaataaccctctccttccctttgggccaagtctggcccaaggtttctcccctctccctctcggcccgcggccgaagtccctctctcctccctctctttctctccctctccttatcttgggcctcctcttccccttccggcccactgcctcctctccacctcctcctgggctgcctctcccctccctccttcccgcccggcccaagccacgccacccagccacctggcccacgccgagccgctccccgcacgcgctgcgcgcgtgccgtcgtcttcctcctcccgcacggcctgctctctctctccccggaaacctagcgccaaacctccccaaaatccacgtgattcaaaccgggaattccaaaattgattagggggaattaatcccctttccctcctctctctttcccccttaattcccccttgaatggcgcccccaatcgccgggaacggacgtgccaactctggccaccttccatggccgccggccggcttttccgccaccgttccccgctcctcccgtggccggctccctccccacgcctataaaatggaatccccatccttcgttttatcgttttagccccttcccgagcttccccgtggtcgtatcacctctccccgccttctccttctctctctccggcgccggccagcctccagccgcctctccctcctcgcccgagcgccatccggtcgcgccgtcgctgccctcggcctcacagccgcctcctctcccccggtcagccctccgtttcgcggggaaatcaccggagacgtgtcctcgccggcaaaacagtggcgttgccgccactgtactgcctccagctgcccctgccgcgccactcaggtgcgggccggctgcgccgtctcctccctcggcgtcgccgcgtcgacctccaccccggcctgccctcggtttcaccggaacgccatcgcccgcgtcggtctcgccctccgcctcgccggagttcctccggcagccccgtccgccgtgccagtgcgccggccgatgtcgccgtctccacctccggcatcgcagcggcaaggtcgccctcggcctcgcctcccctccatccgaaccccgccggtgttcgttatcgtcgtctccgttcgtcctcgttgacgactcctccggtcggtcgttcctcctcgccggctcgtcgtctcgctgcgccgcctccgttgtcggattcgcagcggcgtgttccacgccgtcctcgtctccgtgcagctgctgctagctgtccctcgttgcctcctcgccggccccggtcgtcgtcgtcgtcctcctcccgtcgttcccggtcatcgtggcgttcgtccttccgtcaagccgttctcgtccgtcgtccgcatccgtcaagtgtgccgctgcagccccgtcgttgtcttcgtcctcgcctccgcgtcgtcaagccttgtgctggccgcgtctcgccttcatccaaggatcaccgccgaagtcgtcccctcgcctttcgtctccgtcgttcccggccgtctccgccgcgcccgttcgtcgttgtcgttccctcgcctcgtcgcgtagtggtaaggatccgtcctctcgctgccccgtccttgtcctttcgttgtcgccccgtacccgttgtgcggttgtcgaccccggtacccgtgtaccggtgtcggtagtcgttcacgtgtgcgggtggtgaccgtgtagtgtccgtgttagtgtgcccgcttggtagccgcgttgtttccacgtgtgcagcccgcgtggtgtttagtggagtccgtttgtcggccactcgcctcggttgacacatggggtccgcttccgtcgacccgtggaccgtctctgtgtactcggtctaccgtggtcctttaggttgacatgtggggtccgcatgtcaacagcgcagccttcctgtcttttccaggctagcgcttccacatgttttatagttgaaaaacctaattataataatccgcaaatctccatataacagcactaaacttcggatgatcatatcttggtcatacgaactctgaatcaacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgcggtcgtcgccaaaggttcggaaggccgttctctttgagcaaggcaagtcacatcatccttgagcatattgaatcccagtttataaaattattttgatttaaattaatgcattaccgctttatttaaattcccgcgttatcgctgttttatttagccatgcctatttacctttgttaagacattattattgctattgttattattatcttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctatttttcggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggctcggtagtcgagatgtcatggcacagggctggtgtcgtgatgctaggggctcaatcctgcctgcctgtcccaggggttccggccgttggtggggttgggtcggtactcttgtttatagctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccaaggtcgggttgccagttcggtctgagtcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattattaccccttgtatccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatggagccgtaggcccgctagtccgctgctgtttatctttgattgtcaggc

SEQ ID NO: 61089 - DNA, 4166 bp, Oryza sativa
tttggacacctttcgcttccctggcgggtcgccggccgagtctccccccggcccacggctcggaccgggtgccctagagccgccgcccccaacggagccgccggtccgactgccgcctgcggtcgcgccgctgctacctgggccgtcccgccaccactggcgccgccccggcgggacagacccctgctagcaccgactgccgacatcacagccaggatactctaccggtcgcgggcgctgcagatgaggaggatcctgtcacgaatcagcgtttcctcttcaccccagtcccagcgctcacccacgtgggtgcgcatgggatcgttgtgcccgacatactcccacgcgccgcgggaccgctcctggagaggcgcgatgcgacgtcggaagtagtcgccgaacaccatcgcccccgttaagccctggcttcgcaggcccctgaggtggtcccgcactgcgtcgtactcctcgcccatcttttctagaataagtgaccactttaaagtattacttatcttattaatttaccactcatttaatttttttggtcttgcctcaattatacttctatgcaaacacctattatttaatagggtaaattcgatccatgctattgtaattttgccatattaaaaaaataattattacctccctcataatttagacaaaaatttctccttgatcggagctatcagaccctaaaaagctaaatcggctagctgagaatcggtcagagccaaactgtagcacctattcctcatctctctgaatctctgaatgtaatccagcacagattcatcatgcctttgtctgattgctgtcaggtcagataatttcatctcacggatcccactgtaaaaataactgtgaagctgtttctccaaatcggcccaactattgacagagttgtatggcaaagaagaaaaccaagtgaatgccgatccggataaggacaaaggaaacaatctaacccttaaagcatcaacagccgatgcctcaccacattgtcttgtcctgagaattttgaaaaacctggaacttcgtatcggttaggtaatggaaccctctcaaaccactcagggtacggatgccgatacaagtttccagtatccttcggcttaagcccaaactgctccctcatcacatctgcaatcataacggcccattgtctctgctgaggcaccccttgcgcttgttgttgtatcggctcaaactggttgaacctaggagcatactgaggctgaggcgatcccccctgttgatagtgaacatgaggtgaagggggctggtattgataattcaagttactcccttggtagttctggacattcggctgaatattacgcactaactgctcagggataacttgggcagcaaccgattgtccggttgtacaacgtgtaccagatgctcagggatgacttgagtcacattctgacgcgactgccgattatcaggcgtcctcaacccagtcggcatctactggaccgtcttttgctggatcggctgagttgtctgctgttgaatcggctgacctatctgctgccttggtggcgtgtgctgaatggatccaccagtcggctgagttggcaaaaacattgaagcaatttgctcttgagaccgccgattgatattctgaccagcatgttgcggttgttctctagacaagaggcaaggattactaattatttgccttggtgccaatgacggtgcagctggtgctggagtcgaagctgatgccatcggctggattgatggtgcattggtagcagactgttggttaccagttaccaattttctgtaatttgggaaaacgtctcctggaagataaactggccctataacttggtgctcagctattgtaccatcaaccacatactttaccatttttgtgaaggtattgaccaggactcctgattggttgatcaaagcatgttgcactgcgtagtcaatccgatcttggaagttgttaaattgcggttgcacttcgttgttatcttcaccaagatcctcaaccactccatcttgaaggccgtcacctttcttgcctgagccatcggcaatgcctttatcgccttgggatgagcttgatccaacttcgtcggcagtaactacttttactttgtacttttggtaaactttcccacgggtttctacgaacgacttcatgaattgctcctgagcgctcttcatcattaattcaaaatccttcctttgttctggtgacagcttatctatagtgactggaacaatgttcccttcattaacgtcggacccaatcggttttggaatcttgatttgagggtctgatgacatgcccgtcgatgatagaggtggcttttctgctgacatgtttgtcgtgtcccaccaggcttgccaaaagcgtgttgatgcgaaaaacacacactggcctggaagatcagcttaacttcagtgcaggtacaaaaatcttgcctttaggttcatgagcgtgccaattgatttgatcctgcaatcaacaagaaataaagacaggaaaatagtggttaaatctataaacgatagccgatcggccagtcgccgatgacgtatcatttatcttttagccaatgtcatatttgagtcgatcgacagttgtaaataggcaagaaagaactaaatatattcgatcggctaaagatattaatagtatataatacttccgtcgatatatacttaactcaagtgattgggatagatcggtcgccatgccgagacagtataaatcacttagattgaaatatatattaacaagaagattataaccattcatagcatagccgatcagatagatccagcatgtatcgactaatactccgatactactccatattgatatatctaaatgcgacaagatcttaacataaagggcggatttaacatgtcaatgaagcatataagatatagagtagttaaatcggctgaaaccccgatgaaaccttattcggcaaccaaaagcaggctagagattgagattctaatcacgacttataaggtcaaactcaactaatgcagctataagtatgaaaagaaggacaatatctagacaatcaagcagttggatgtttcataggatggtggataccctatataatctaagtcaatattggtatttaacctaatcggctgcctttcaatgatagatgttagccgattgaaggttaaataacgatattgtcagatattagataggatatatgataactcgacgaattacataaacaagattagagtatcataaagatggaaacagtaatcccgagaacgcatgccgccataacaagttttacctctagttgaagatcgaaaccgatgcagctcaacccgaaagcaagaactcgtcaaaagtaaacgaaagtaaaagggtggcgatgcgccaagattgttattgaacgtgtgttgtttgattacatgggttcgggtcatatttatacccgagatacaaaatacgtccttgtcggacacgactattatctctaacaaactccaagataccataagtctttgcggcagacttttgcccaaacttatctctaaggaaattacataaatatcctaatttgtagatacaattgccttttcaggactcaatccgtgcgtggcaatccctatgaagcatattaactcaacccgacaacgtgtaccgagtcacattgtcggaatcggctcaatcagctacctagttcgactcgaactctgctgatcctgatcgtagccgatttagactttagccgattcttgctctatttccggaacaatctctatcttggattctacttcgattttatctccatctccgatacctaaattaccatatttggtcgttaacacccctcttcggctaccatctccccttcgcttccaccttccttccgcttgaaaactctctccttgacgatcttcttcggtggcatctgtggtttcgctcggagctccccacggtcagcgctagctgttgtcgaatggacaactgtgtcacatcgaaaggcgtggttatctcaacagtggttggaaaagaaagacaattgtattacttagtaaaattttttggatccccctattacatggccttagggggctatttataatcctattacaggctcccccctttagggttttggttttacgggggaatttacatggttacc

SEQ ID NO: 61090 - DNA, 1151 bp, Oryza sativa
aaaattaagttaaaacatgtacatatacatatacaatggtcccaagtctaaattcaaaacataaacatatatacatcgttatgtgagaggtagtgactcaagtcgtgaaactcgctaatttgttaagctcatgaagttgctaagtcgttaagcacgtgaaacacgctaagtcgttaagctcgtgaagtcgctaagtcgttaagcaactcatgtaaatcgttcattcgcgtccgtgaaactcgctaagtcattaaactcatgaaactccttcgttcgttaattcattcgttaaactcgctaagccgttaaactcgttgaagttgctaactcgtgaaacttgtttgttcatttgcctgcgttcgaccgttcgttcgcgtgcgttcgttcattcgcttacgttcatttgttcatttgttgttctaacactcatgtacgttcgtggttcgttcgttcatgttcatgcgttcatttgcattcggtcgttcattgttcgtagtcccggcagttgcagccctcggcgtcggccgtggtggcgacagtggcggcaacatcaatagcagcggcgtcagcggcgtcagcatcagtagtgcagaggcagtggttgcccgcgtgcccgcacaagtgacgtcggcgtcggcagcaactgcggtggaaggccgcgggggcaacgggagattgcgacaacgatgatgatgaccgcggcgcttgtggttattgtggccgtcgtccgggcgagaaaaagagagaggaaggaaagagagagtgggacaccgggatccggtggcgcccacaccttgagggaggcgacaatggtgagagcggcgtaggtcagctgctgcaacaatgacgatggcagcggtggcagcggctcgggcggcagtgtactcggcggagatggcgcgcaaccgagattgagatcgagaaactgctaagtgttgtgcacggggaagccgatggacccatatttatagtccgggatctttagtcccggttcgtggttctaactgggactaaagatataaaccgggacaaaacatattttctcgctattccgaaattttatctttagtcccagctaaggttaataaccgggactaatatttgaacatttgtacattttagtgcttacaaacttaaacgggccaaattaa

SEQ ID NO: 61091 - DNA, 1920 bp, Oryza sativa
  unsure (1)..(1920): unsure at all n locations
tgccacgacccatccgctttcttcaccagcagcaccggcgaggagaatgccgacgtgctccggcggattaagccgttctcctccatcacacggcattggcgctccaactcatccttgtggcgagccgggtaacagtatgggtgtattgccactagcgccgacccgggtagtaactggatgcggtgtgtgcggtcccggaccggtgaaaggcccgtgggctcggcgaaaacgtccgtgaactcctctagcagcgagtccaagtgcgccgagggaccgcacgctagggcgcgtggccgctggtgccccggcagtccgtggagggtgacgcagtggtcgcggtgccagaacgacattgtcagtgccgtgaagtcccaaaggatcgggcccagtgtcgcgagccactgtgttcccagtaccagatcatagccgcccagagttaggacgtacacgtccgtggcgaattcctcgccggcgatctggaacggcatgtcggggaagacgccggggcacgccaccttgtcgccgttcgccaccgtgacgttgaggcccgaacgaggttgaggatcccggccgacacgcgccgccgcatcctgagacaggaacgtaggcgtggaaccggagtcgatgagggcatagaggtcagtgtcgccgaggtggaccatgatgtgcatcgcgtcggacacgcgaactccggtcgccacatgcagagaaatccggagggttgcgggtgcggccgccgggtcatcggtggagtcagtgtcggcgtcgtcctcccccatctcaaggaagaagaggcggcggcacacgcggttgtgaccgcgggagtacggctcgtcgcaattgaaacacaggccttggcggcgggcgctcgtccatctccaacggcgatagacggcggatggcgcggttaaccgccgggggcgtgcctgctggtttgacagcgacggccggctctgaagccggtgccggcgggttggccgctggtggcagcggcaagaggccgcggccggcgtgccgcggtgggcgaggtgnacgcgcagcgtggtcgcggcgttcgaacgagcgggcgaggctcattgccgcttccaatgtcgtcggattttgcatctgcacatctaaactcattggctcttgtaatccaatcgtaaacagttgtacctgctgatcttcggagaggtagcccgcgcgagccagcaggtcgaggaagtggtcggtgtagtcgtccaccgtagacgtgcgccggtaggccgcgagctcgcccagcggtgctgaacggagtagggggccgtagcgcatgttgaggagctccgaaaaacggtgccacgagggcggcccatggtcacgctccagacacgtataccactgctgcgctccgtcgagcaagtggtaggaggccagccacaccttgtcatcttccggcgtgcgttgtccccagattaattgctcacaccggttgagaaaaggaagtggatcgtcgcggccgtcgtacttggggaagtcgagcttgtggtagcgtgggggtcgctcgccatcaccatcatagcggtgaccgaatcgaccgtggaagccgctccgaccgccgtccgggccaaagccatcaccgccgcgagcaaagggatcgccgcggccgaagtagttgccgccacggcctccgccgaggccgccaccgccacttacgtcgtcgaaatgaggggactgtgcgcgagccccacgctccagacgattgatgaccatgttctgatcgcgctgctgctgatcgagatcagtgatttggccgctgagcgcgtcgaggcgttccaggacttcctcgaaacgccggcgccaaacgtcgtcgttgttggcaccgtctgccatcggagccgcagaaacgcgaaggatcgaaaggaatctgataccgagcacatgggtagccgagccatg

SEQ ID NO: 61092 - DNA, 737 bp, Oryza sativa
tcatccgaaaaccaccctaaatgtcaaaaccgcgatgaggacccacctgtcagccaccctgccaaagccggaggcctgctgggccggcccaggttcggccgaaccctagcggcgtccagtcaggtcagccctccacgtggacgtctaggattgcttctcaatgacagttgtgaggataaaatggacatttcgcatgatagtaaccatcataccgaccctataaaaggaggagctcattcactctcttaacacactcaagcaagctcaaattcctcttcatactttagtactagtatcttagtgctaagtggagtagaatagaatagtattcggagtcctcggagtcttcggaagagtttcggtatggctctagcagctcttgtattctcttatgtaatactttcgatattaatgaaatactcttctctatatatctttggtactttgtttagtctgagtccttatcttaatttatatatgtgtcgtaccgattgtgtgggtagcctaccagtgaggtgcaatggtgcgggtttaatgtccgaattatcggttgctctatgtcatgtgcacatgtgtagattagtatttagtaatgtaagcgtggtgcttagattataagatatcattaattgggtatatatgttgggggataatagaggtgggccgctcatggtgatagctcaatacgggtattcctccacattagtatatatccctaagacaaattcctggggagg

SEQ ID NO: 61093 - DNA, 6183 bp, Oryza sativa
  unsure (1)..(6183): unsure at all n locations
nnnnnnnnnnnnnnnnnnnnnnnnnnnnnnnnnnnnnnnccacattagtatatatggctaagacaatttcctggggagggtactcctccgtatttagcctcagttggacggccacgacaagttgtcgtaaggaacttggcaacccaaggtggtatctcgaagtaccagaagggcactgttagggggtattggccacacgattgtatactagcagatgtaaactaggatttgagtgtatgttagaagtataggaattgagtgctttctaaatattcttccacttagttagaattactttattatgaggatttgattagctttgcttcgtgtcactctacacttatattaaacttaacccctgcttagactttgacaattacaagtaatatatgcataaagtgcattagtaaagttcactcttattatcttcccttgggattaaaaatacgataccttgaaatacttccgggtgaaatgctacaatggtatatccgtgcacttgcgaattacttctgtaaccataaatataccaggactatttctagcgccattgctaggaaagaatatttctagtaatgtcgttaagaaataccaacaagcatttttggcgccgttgccggggaagattaataatgagatgactaagttaataactttatatatatagtacctctatatgagtccctgtcctttgcaggctaaccttgattgttttcacttgtgtcgtgaaaacaaggtagtgtattactggtttcaatttaccaaaatacattaacgagaatccagaggccttattctgcagcgtcaaacctcgtgtcatccctccatagaagagactctccgaaaagaaaccatccatccaagcgtcaccaagttttaggaacatggccgagaagacccttcgcgaattcgctgccccgtctgctgacaatgtgactgttggcccggctgtcaacatcggagacactattttggaccttaaatgcagcctggtaactatggcgcaggcaagcccattttgcggcaagccgaatgaggacgcaagcactcatctgcagcaattcttggagatctgtagcacttacacggtagaaggtgtcattccggacgccgtgaggctatgtctgttccctttctcactcttgggaaaggcaaagcagtggttctacgcgaactaggcgacagttaacacttgggatagatgctccaccgcgttcctctccaaattcttcccgatggacaagaccaatgcccttcgcgggagaatatcaagttttcagcagaccagggatgagatgattcccgaagcatgggaacatctcaggagtatgtagccgcctgtccttatcatgggatggatgactggctcatcctgcagagtttctacaatgaactcactccctcgtccagggatcacctggatgctactactaggggtgccttcttcttaaagacggtccgtgcggccattgatcttattgagaagatggtatccaacatgggctggagcgaagaacgactccagacccatcatcgtggcatgcacaccattaaggagatgcttgccgctaaactggatctcctgatgaagaaactagacgatcaagagagggccaagccgtaggccaccgtcaaagcattggattcgcacatcacatgcaaggtatgcggaagaacaagtcactcggggaacgattgcccggagtcccgtgaggaagccatgttcatggggaacaatggctaccggcaacaaggaggccacgggtggaaccagccctggccattataccaaggaggcaacaacggcaataacaataacggtaatttgaactagccctccttaatggacttagtttttgcacaagctaaaacaactgatgctacaaacaaaaaacatgccattaatgataaagtccttgagaacataaatgttaagtgagaaggcttcgcttccactttccaaaaccagctgagctgcaacaaaaggatagagactcagctggcgcagctagccgctttagtacctgctaaggagacgggaaggattccgatgcaacccgaaccttccctagaaaatgttaaggcgatcaccacgaggggaggaaaatccactcgggatccgccatattctaacattgcagggaccaggcaagctggcaaggaggcacggtctgctagcacaactgaactcgaggaaaatgaggaggtgcagccggacaagatcccgccgcaggaatactgcgacacgacgctactgccattccctcaacgccagaggaagccttctgtggatgagcaatccgctcggttcatggatgtcacccaaaagatccacatcaacatcccatttgtggatgcaatgcgggtaccaacatacgcccgctacctcaaggacatcctgaacaacaagagggcgttgcctaccacggagatggtcaaccttacggaggagtgtagcaatgctatactccatcggctccgggaaaagaagaaagatccggggtgtcccacaatatcatgcttaattgggatccaacacttcgaccatgccttatgcgatcttggggccagtgtcagcgagatgcgaaaggatgtcttcgacaagctgaactatacggtgttaatcccaacaccaatgaggctccaactggctgattcctctgtttactacccagcgggcatcgccgaggacgtgccagtaaaagtccgggacttcttcttcccggtggatttcgtggtacttgagatgaagtcagataaggagacgcctttgattctggggcatccattcctgagtactgccaaagccagtattgatgtgggggcttgaaacatccggttccacatcaatggaagggaggagaagttcgacttcaaaccaagagcagaacaatgcttaggtcaagatcaggtacgggccaaacccaccgcaaatccaagaagtcgaagtgcagctaccagagatggacagcctcatagtcttcatgaagaaattcctgcagattgaaacaaccaggaagaggccctatccaaggaagacactggcaaaaactggtgcacgagccaagaagcctttggctccggctcccaggaaaccaccgcccacaccaaggaacaaaaaggtgtgcgggtaaaacagacgacgtccgctccttcacctccagagacggacaaaaaatcttcgcactaaaattgctggaggtacggtcttgctcgttggacctaaaatcgacgtcaccctcgccaataggtaaagttggtatgtatctcatgtttattttcatcaatttgattcttgcattcatagcatatttgaatttcctgaaaacattgcattaggaatttaaaatttgagacaaatttggacaatgaattttctgagcacaaagaaataaattttgcagcatttatcaacgtggctcctacacgtgtagccgttggagtccaacggccgaatgtggggccagttgggcccaccaatggttcggccgaatcggccgaagcaacggtcaggttatccctttttgtgccagtggctagtgggtcccacctcacagttatagccattggtagatcattataaaaagggtatggccggtagaaggagttcatcccattctcaaaccatcttcactccttctcaaagtttctttttgctctcaagctcattccaagctagttcaagctttgcctcacattttagagttctacatttgcatttgcatatacaacttactttggtgcaaggctaaccggcacgtagattgtcttgtgttagcttagcccccgctcgagttttgccttgtgctcttgctcttattgcattcatgaagaaacgacactctcgcttgttcaaggggtacggctctcaatccagccgtcaacaacacgagtcaagtgatcggtcatccgccgatgtgccgatggaggatacgggtgctgaaccgctactcctaaccgacgccgatcttgatcttgttagtggacgggaacctcaagcctacgagacgctgatggaccgagtgttagctcacacccgagcgtacgtttcgggattgctccagaaaacagagtcgattttcagaaggcaacttccggttttgagaaaaacagattttgggaagatatttttggtgcaccgatttgtaagaaacctagaaccaatgacatccataatccaactcttaggctcatgcataaatggatttccatgactttgtttcctagtggagatcttagacttgttcatgataatgagttatccttaagcttgcttaaggatgagttttcctcatttcttctccattttatttgcttaatccctagaaacaaataatactacaagtacaagtggaagtagattattctaaaataaatatgcattgcaagcatagctaaatctcctttattttagttatatttatggtcgtcattggtatataacgaccatcaacaccgtttcaagaggacgtgttgcaatgccttatcaactttgagatgacctttctactgtcattcttcaatgtaatgacgtatcttctatgtcaccttgtgaaagagatcgatattctcggtcctgtgtacctacacaacatgtttcctttagagaggtacatggctgttctaaagaagtacgtttgtaaccgttctcgtccagaagcaagcatcgccaaagggtatggaacaaaggaggtcattgagttctgtgttgagtttattgaagaccttcgtcgaatcggggtaccataatcaatccatgaggggagagtacggggaaaggacactcttggcaggaaagcaataatgaatgtagacaatgatttattccgtaaagcacatttcacggttttgcaataatctttgttggtagctccttacgtcgaggagcaccgggtgattgttcactcaaaaaacatcagcatgtccgatgcctggattacacgccatcacatttatactttccccacttggctgcaacaacatctcgtgggtaacgggatgattgaccgacaactagccttctcggcgaggggaccatcttgctcgatctcgacatttcaaggatatgaaatcaatgggtatatatttttcacaagagcccaagacagaaagagcatgaaccagaagagtgttcgtatcgatgccatgagatacgatggtacaactagcacgtattacagtgtcatcgataacatatgggaactagattatggtcccctgaagatccctctgtttcggttccaatgggttaggctgactggtggaggcgtaacgattgatgacaatgggatgacaacggttgaccttaacaaggtaggacactcagatgaaccattcgtcctagccaatgatgtaacgtatgttttctacgtgaaggacatgtctagcaaagcaaagaaggggaaagggctcgacgagccaagacgccgtgtggttctcccaggaaaaaggaaaatcgtcggagtcaaggataagactgaacaaaaattactatcagtttgaggggcaacctctgttcacagtcacggttgacccgggcatcctcctatcaaaggaggacaccccttactcaagcaacgatcatagcgaaggaacattagcaaggagaaagtatgtgaggaagacagtgaccaagcttgttgtatggatgatgtaaattatttgtaatatattgaaggtaaaatttgctacaggacacgcaaaaattatgtaagtgtaattagctgagggacaccgtgaaaacgcgaatttgctaaggacacaacaaaaaaccgataattagatgctggacacccgtcgaattattttattatacccaaaagaattggagagagaaacacctatttaagtacaattctacccttcaatttttttcttttttctttattggtccttatcttttctctctctcattctttctctatttctatttgctccttattcaagcgagctcgaggatggcagtgcaacgaggtgcgggccggtgcggtgccttgactagggagacccagcgcggttgtgcgcgggggatggggcctacttggtgcggcggaggtggcgctagagtaggaggggaggtggtgccgacgcggttagcgttgtcggcctaatgctaaggcaactgtggcttcgaggagagcagctttggccttacgggcacagggccaactgcgatgaggagtc

SEQ ID NO: 61094 - DNA, 1943 bp, Oryza sativa
  unsure (1)..(1943): unsure at all n locations
tccgttcggccgcgcccccatcacaccggcgctgccaccgctcgttgcgcccctccggcctaccactctttcatcgtcaccatcctaatggagattttttttttggtgtgtggtgatgcgcaggggcaatcttggtattttgaaaaaaattctcaccactttaagcaaggaaataataaaataatacgtccagtgtcctacggcaaatttcacagtttttgtagtgccttgggcagtgtcacgttttcgcggtgtcgctcagctaattacacaatttttacgtgtcctgtagcaaattttgcgtatattgaaggtccatctatttggattgatttttaatatattctccttagtttcatgattattgaaaagtgttgggaattttaaactatttaaataggtcatatgttaattatatgtggttattgaaatacattaggtattttaaactatttaaaataggtcatatgtttattatatgtgattcttgaaatgtaatcggaattttaaactatttaaacaggtcatatgttaaatatatgtgataggaattttaaaatatttattttctttaaatgaatactactaggcttttgcccagtagtgtaattttataaatagaagaaagttatttacaaaaaggaaaacaaaaaattataagaggatcaaacccccaaagcaatcagaaatgttgtatccagtaagaaacatgttgcctaagttcaccattcattctgcacatatgaagaagaatatcattcctaaaagcataccaccaactatcaaaagcaggattgacgttctgaaaaatctttccattgcgctgtttccagatatgccagcaagctatgaaacaaatctccaagaaacccttccctcttaatctcagtctggctgatgtgcgctagggttcccaatcttccgaaaagttctgataaacaacgatttgggtggagtcgcgacacaaatcgatccggcttcttgaacacgcacgctcttgggccccgcaatcgcagcaccacgtctcctctggttatcacccgtgtcaaaacgcggatgacctcgccgagaaggcaaatccctgtttgccaatcgaagaacacaaacaagaacgagatagaaaaacaaccaaaattgcagatgaatgattaagctcacgagttacaaaccgatctaacggcgaaactgttctcgacagattaatcgaagtaaaacccaaaaacctaaagatggcggcaggtactgatatatagagtttagggtcgtgcaaacccctctcgacgcaaccctaatgggttccaacacgatacacgggccaaaggcccaaatacggtgacgcagcaccgagacagattctggacgtcaaattgttcggtcaattcctgttgactcggaaagaatttggacatgggactaaaaccattggaaaggttatcttcttagctttccatccatataaagaacgccccaatccgagcacgtatgcgacctgggcgcccgttttagtgcagactggtcctggactccgaattacacccgacgtcgacttggtttgggcctccaccttgacttggacgtccccgatgatcctccatggctctaagtccttctccaagtgtctccttgtcccctccattgttcctaatcacaatataatcattaggtagcaatctattctcgaattcatacaaagaagaacataggaacgagctcacctctaaatttaattgtcgcgcacgagctcttgttatctgtccttaaatgaccgttggaggattgttgtgtctatccgaggtagtgatgtccgcatcactagccaagacaagcatatgaaagaactccaaagatgtattccaagaaattccacctccaacatcttttannnnnnnnnnnnnnnnnnnnnnnnnnnnnnnnnnnnnnnnnnnnnnnnnnnnnnnnnnnnn

SEQ ID NO: 61095 - DNA, 20561 bp, Oryza sativa
  unsure (1)..(20561): unsure at all n locations
nnnnnnnnnnnnnnnnnnnnnnnnnnnnnnnnnnnnnnnnnnnnnnnnnnnnnnnnnnnnnagatcagtagttggtacacacatacatagccgaatcacaacatatcacgaatgaatttaggctaagaaagttaagtgcttacattagggccaggtaggccaacaattatcagagaacaacagcggaagacaaaataattcaagggcccggttgacatgccacaagtagtcgactggggaacgagacctagaacggaaccgcactccggtcatcttgttaagtacgcaagcgtactaacaagggcttctcttcatcactctgctaaaagatatatatatatatagagcaacaatgagtacaaaagtactcaacaagccaccccacaaaatgcaataatgtacaggataatacaagacatggctatgcttactttgcgtaaagctgagttttcaaataccatttcataaacttaagacctagcataaactgatcaagttttaactccattgttcattaaacagcgacggttctgtccaccatccattgtgttcccaaggatagcttcccgccattggtcgtcatggttttctggggtctacctcttcccgcctctcgagaagttgatcaaccagtacaaaatcatcatgcatcatcccacccaatcaatttaagaatttagactctagccaagtgtaatacatgtcccagtgctcaataaccgcgagcacggctattcgaatagatttggtttactcacactgcagtggatgtacactttacccgtactccgcgacttgcccaacacatgagcctacgtcccaacgaatgagacttgccacggcaaagcctttcaacaacctcacattgacagtacccgctccatgaacttgagtcctcatgcactctagacgtcataagtttctagtagtgataggagttctagcactcccgaggggaaaactcatgcaagcctaacattgtatcctgttgttgaacccaatccatgctttcctcttttgggtatctctttgtagtcttgtagtcctgacaagtcagtctctggccatccgtatcgggtatcagccagcagactgcttgttcgtccacacacctaagtgaaaccactatgcaggggtactgcctccgctctgctatctactccgctaggtctatacccattcgagaagtacggctgtactagggtcgtttcatgcttaacttcatggatcggtccttaactgaccagggatggcattagcctttaccggacaccacccaaatccaccagccgccccagtcgaaaacatttgtttagttttaactttctttcacaaatcatctcatcaatgtcatggcaatgtggcgctcatgtctccacattccatatctcaactaccttccccaaagtagtttcccaagcatatagcattcgataaatataagaatgcatgaatctaaagaagcattactaagcatttatcataattgactagggactcatacgtaattatgggtacaagagaataatgagataagcaataatcaaaggcatggcataataacaagtaggatattcatcactgtatgcaattttatttgtaaacaaaacaatgtcaattgggatcaacatgcacaagggatggggtgatgacttgcctgctcgggatagttcttattcttgatattatcttgatcaatcttcaccttttggaagctacatacgctgcctcacgactaaccgatatacaatttctataatacgcgagaaaaaccaatattcaaacaacaagcaaatatgcatgagcaaaattaattgttggggtcgaacatagggctgttcatactactcgtgtttgctaatggattgtaaggtgctacgaagtttaaactatggggtgctcacatatagaactcaatactcaggactatatgtctatggctcaattatctatcaactatggctatggggaggattatggctacacatgcatctatctaaataaaatggtttctgtcgttggatggatcaatttaggatcaaacaagcaatcagagggaatcatttatattattattttaccaatggggcattattttaattatgatcatattttacttgtcattataaattataaatgggttaataattatccatgcagtatatgctagatctgtgaggttataggtgcagattatttgtctgtgtggtctcataacgatcaattacagaaggtcaagatttataattagtatttatctaatatatgtgcttatcatgtacccggtagtttaatgtatgcaaaagctaggttattgtccatcgtataatttaaatggaatgtacagtaattgcgagtgcaaaaatatactaatattagatcatttactgagcatgagctatttactctaagctatacagtatatatgatgtaggtggatttggtgagttggtactgtttaccaacttaagattcactactaactaaaaatatactattccatgggacatgacattaagtaattagttccgtataggtgatttaatcacactagctctgtcattattcctcataaacaagtcaaagacttatctatgtgtattcatattttatttacataatcacaagggtaaacttgatttaaataacctataagtcatgggtttaatcatatggccatcgaatattaaataagtactagcattttcctatacatccattcatttgagacattacctatacttagtttacatggttgttattgtgacaaaacatgctagaaacaaatattagcatatttttaagttgaccataatctaatcatttgatattaattatttaataattataaatatattttattaaatagtgagttatataccattggaaaggttatgaaattagatgaatttaggttcaagtttcactcaaatcggagttaaaatgagcaagttatgttagtttaaatattcaaatttgaattagtccaagaaattgtaaaaaggcactatttataattcatttatttttaatccgaaacatatccacaaccctagtgaccgacaggtgggacctggagttccttttttttccaccggattaatttttgctaggggaaaaatgggagtgggcccggcctgtcagcgacttggccaggagtcgtcttctaccttcgtcttcttcttcctcccgaccaagcgggagcagcatgggaacacggcgcgcacggcaaggccggccgagggtgacccgatggctgccaggggaggcgcggagcagctctggcgatctcccgccggtgaccacggcgcgtggcgacgcggaggcgagcggcgtggcatggctaccattgccgagctcgggctgcaagtggctagggcaaaagggagagtttctgattgaattggtggtcgtgggagtatctacggggtatggggatttcgtttttcttgctagatggagaggggagctcccgggatagtctacccacggggagcttgccggcggcggaacggcggtcgggccggcacagccataggcattaatcgtacaaactggagccggtgctagctattagaggtatagagtacaaactggagccggcacagccataggcattaatcgtacccagggatggagagtgctcgaggtgacctacccacggcgagcccgccgatggcgaagcggcggccgggatgggacgccgaagggcgctaatcgccaaaattggtgggggatttagcttctacatgactaggaggaaatataggagcgaggttttactgagagacggcgggatgacgaagttcggcggtgcgctgctcagtgttgacgaaacagggggggctagcagtcggcgacgcttgcaggtgttcgatgcgtggttcccgacgtccagcggtcctcgactccctcaatggcaatggcggcagcacagctcttcctccactccctccaactgttagtgatatgccctagaggcaattatagagatgattgtatcacatacaatgtttacatatttatccgatgttgttccttgaaatagataactccttattggttaatgaatatgtgattctttcatgagactctttatgttgtttgttactatttctaaaggatccctgatcaaatatcatatgtggaacaaatatgtttatatgatcagtacatgtattaattgatgatcatgtctcatggatcatggtatagagataccaaattaataatgtggacatatgttggtgaacatgttgttggatagacccaacatgagacactgcaagagccatatgtgttgtgtcatcagtgatctcattgagtgttagtgttgaatccttagacctgagattatcatggttctcaacatgtgtagtagcttacttagggactgctaaacgctactccgtaattgggtagttataaaagtagttttcgggtatgctatgaaacatgtagtgggatatgaataatcaaaatgggatttgcccctcctatggagagatatctctgggcctctcgatgttgtagattatgaaagtgcatggccatgccaaaggtgattgaggagtcaatcacaagttatataatctatcaataggttcgagtgaatgattgagctattagaggatggcacatttctagccttgagcttaatcgatatcgtgaggcaaaggggttcatacaagtatacactagaggttcagccgatatgatctttatgtatgcccggtgggtcaatacgttctgctaggggcctctgttgacgcgttgaccgaaaaggagttttcgggttacagccgagtatatatgaacctacagggtcgcacgcttaatgggccagaataaggggattggatagagatccaatatgagcttaattcggatagggatccgaataggagtcctactggccttggaggcccgagtgatggatcctatatattcgtgaggggtgtgaccggcggaggcattgcatcacatgagaaaccctagccgtcacttccctccccgagcaaaaccctagccgcgcgcgggtgctagaggcgccgctgtacgtgtggataccggtagaggcgccgctgttttgcggtgctgatcggtgtggcagtacggcgaggagaacgcacgaggaggacaaggtcgagccggtgcgattgactacttcctctacatcgacgcgcgctacttcgcgagagttccttcgacttctcagcgtcttcttttgctgcaccgcgcgtcgagtggtaacaatctatgatctaatacttgcatggttcctggtttacgcgatagaaaattttgatttatgctatcgtagcctacccgtatcccaacatgtccggccggggagcctcgcaatggtgatctctagcggtggtgagaaagtgatcgcaaggtgttcgatgaaatgcattcgagggaaaaaggcagagagggatggggtatttatgggggcttggcttggggataagccaggatggcgtggaggataagatcggcggctggcgcactcgatggctgtctacggcctaggttagggaggttgacgcggctaagtttcctcctctctcactaactcggggatttggggatccatggagtaatggtggcgctagggttgcaggcctcacagctagatggcttgaggagaagccgtttatccgatgggcacgacgagggacgatgtgacacgaggagatgggtgagaggacaatggtgacgaagaggcaacgtggtggccgttatccgtcgtggcgacgcgacggcgacgggatggcgatggcgcagctccgtgtttcctggagggaatctgggagatcggttggaggtgcggcacgggcgtggctggcgctggcggatgcggcgcatgggcatggtagcggtgagacgcgatttagggaatggcgcggcgcagagggatggatgcggcgcggtcggtttggggccagacccaaatcgagcatatggtgggcaatgaatagttctagctagaaaaagagagaaaagagagaaaaaggaaaaaggagggggaggggctaatatgcaaaagtggctgagattggaattgaattgagatgtaacattatacattttttatttgaatatttcatttaaatatttattcatttatttgattatttgttacaccccaactgaatttacttcgcccaaaattatcctatataccatggatgctttgatatttataggaatcactgcacattggttgaatttatttgtatagcaatgtattttacatggacatgtttaatctattattccataaaagtaaattgagacttggtaccatattgatctaaatgtttagttaaacactcacataaatgtattttatatataaagctcaattcatttacatgatcaattattttatgcgagtcaattttattccatgagagactcgatgaatgttataaatattaatttaattattctagtggaacactcctatatatacagagtcattgtagtggcgactatttcatggttacttagatgtcatgacacttgtcacatggttccaatatttaatatttaacctataaattaaattagtaattaaccttctctttgtattgctttgttgtgtgtaaatatttaataataaatatcttaattttataagtattacttagttgtacagctttagctaaattttcaattgtgacaatttatagtttggcaagcaataacaaccataacatccagcatgatgcaaaagttttaaaaagttcaaaattttagtgatttttattgtcgtgaattttcaggatgttacacaaatgaacaccttaatcttcatgacacactttgtcttctagatccatctaaaaggccttgagggttgcatggcagcaaagttcaacttgtaaaaacttttagaagtatagcatgctttattctagatgaagctccaaattatccccaaattgtccagacaaagtcaaggcatcaagctcctctctgagttctaagaattccccataagaatcataagttaaaggcaacttaaaacaatcctcaaaaagcttggcaaagataactgcaactgattcattcctatcaaaaacatgagcacaaatatgagtatgggaaacacttctcactcggccattccaaagatcatcccaatatagaacagatgttccagaaactagatcacatttagcaattcctctgaagaagtcagagagagcaattatatccctccaccaaaaagagcccttattaaagatctgatgaggagtttttgactgataataagaccttcatattaacttcacccatggaagattaaactatttaattaggtcatatgttaattatatatgattattaaatgtaataggaattttaaactatttaaataggtcatatgttaatatgtgattattgaaatgtattaggaattttaaactatttaaaatacgacatatgttaattatatgtgattattgaaatgtattaggaattttaaactatttaaattgttttctcataaaatttgtggttttattacatgtttaatggattacttattattgttttaaatctatatttaatgaaattaatttggcccgtttaagtttgtaagcactaaaatgtacaaatgttcaaatattagtcccggttattaaccttagctgggactaaagataaaatttcggaatagcgagaaaatatgttttgtcccggtttatatctttagtcccagttagaaccacgaaccgggactaaagatcccggactataaatatgggtccatcggcttccccgtgcacaacacttagcagtttctcgatctcaatctcggttgcgcgccatctccgccgagtacactgccgcccgagccgctgccaccgctgccatcgtcattgttgcagcagctgacctacgccgctctcaccatcgtcgcctccctcaaggtgtgggcgccaccggatcccgctgtcccactctctctctccctccctctctctctttctcggcccggacgacggccacaataaccacaagcgccgccgtcatcatcatcgttgtcgccatctcccgctgcccccgccgcgctccaccgccgctgctgccgacgccgacgtcactggtgccgccacgcgggcaaccactgcctctgcactactgatgctgacgccgctgacgccgctgctattgatgttgccgccactgtcgccaccacggccgacgccgagggctgcaactgccgggactacgaacaatgaacgaccgaatgcaaatgaacgcatgaacatgaacgaacgaaccacgaacgtacatgagtgttagaacaacaaatgaacaaatgaacgtaagcgaatgaacgaacgcacgcgaacgaacggtcgaacgcaggcaaatgaacaaacaagtttcacgagttagcaacttcaacgagtttaacggcttagcgagtttaacgaatgaattaacgaacgaaggagtttcatgagtttaatgacttagcgagtttcacggacgcgaatgaacgatttacatgagttgcttaacgacttagcgacttcacgagcttaacgacttagcgtgtttcacgtgcttaacgacttagcaacttcatgagcttaacaaattagcgagtttcacgacttgagtcactacctctcacataacgatgtatatatgtttatgttttgaatttagacttgggaccattgtatatgtatatgtacatgttttaacttaatttttttcctactcataattacgtggtccagctgctggccgccgccatcgctcaagcataagtggtcccaagacctccaagcaaaataaaggcaaatttacatgaattccctgaatttaatatgtacatgtaggtgtcatatttcttaattagatagctaggtgaaattccattagttgtggttcgtagttctccgtagttgatgtgtactacttacactacaccacgacatacatatgttgtctcagaatctgtcggcaaaacacccatgtgctgacaaactatctgtcagtataggttttcccgacagagaaggtctgtcaggacaactgctgccgggaaaagtatttcccgacagataatcttttcccaacagaccgattgatggtactacaaaagaattaccgacagacactttttagcgacagatgacccttttccgacagttaatggaatgccgacagataagtttttacaaagagattgttgaatacactcataaggttcttatatttcctaccgacaacaagtacaatttttgaagacacgctcgatagctccattgaaaacagaggaaccttgctgaaatcatgtcattcatgttccctattattgcatcctgtaattacagttgatgtctttgcatttatattatcagtgtcatactgtaatacgtttctctaagttcgatcaaaagctacttctaacttctaagttcatagctacggttaacttttgcattccaattatgacatgaacctagaatagtgagtcagaatggtctaaaaaatagcacgagggtaccatttgattttttttatgcaaaaaataatgcaataacatgctagaatagtgagtcacgttgttggctagctggttgtaaaaaatgatgttgcatattaactttgtacagtttacctcaggagtagcaagatagaactattagattaaattgtcaataggatatggctgcaattagttttcaatcatgcctctttagctctattgcagtccacacagttcgcatttagtgtttgtaagaaaaaaatcaagagccaacctcaatttgtacattctctcagccattcatgcacgacagatgaaaacagtaggtacgaaaaataaaatactgaaacatcgcaaaagcatcaccattcaacagggcagctaacctgtataggcttcactgatccagaagatctttttacctgacaattatatgctagctcaagttgttcagaaacatcttcacgcaaggggatccaatcaagccctcctttgcgagcaaaccagtggcccctcaagacacgcctgttcttcccattccagtacacagggaagcaatgacgtctcattaaatcaacctgcaatagtgtatgttcttataacaaagacatattcaatatctagcatcagctgcaactaaggaaccttttggcccttcgctgcatttagcgtactctctccaccagtatgcaagcatagcttcctccctctacaaaccagtaaaccagtattgtgatctcgaagacaagtggtttaaaaagactgagatgacattatccccttgtattgtagagggactagcacaactctcttggaactagattgtctagtaatatcgcttttcaagtggattgtttttatcactgttagaacagtccagttttcacataaatgagtatacacttaaggcggcattggtgttaaaaaagataacctccaagaacgacgcctccaatgcaagagaatctctcatgctgaaccggaagtagtcccctttttcccattatctctgtctgtggaactgaagcagagagcatcacgtcaacagcgaaccgcacaaaacataagatcagtaatacgtttaccacacacttcataattttaaagtccaaaccgatgatcaatttaattgagcacagcagttctgaagtatgaagacatgccacggtcaaatatgaatctaatgtaaatgggcgttgcttcgagttgcaagttcaatcagcgaattcattagcgcacgcatgtgaacgcctctctaaatcacagtaccctatcaattagtatattcaaatcagcaacagtctcacatgaaacctacattctagctaccacaagtgactgaagcggtcggttaaactggtggtactggatgtagcattctgaagcaggagagcccgagggccaacacacggtgagcggatgcagaaggcggggggggggggggggggtgccccttgcaagaagtaccagcggacatcctcaccgtcgaaggggctcttggtgcgggcaaggtacttgcggcgcgcggcgcagtgctcgatggcgtcctccagcctggcgatgttggagggcgtgttccgcaacgagtccggcgacgcgccgcatccgcgcctccgggggccacctggcttgtaacttttgcattcgatcagaccaaccactacccgtaccggcaacaccttggaagccatgaacctagggtttggagttggggatttacctcgtagaggctcttgctctctgcggcggccggcgcgggctcctcctcgccgccgccgccgccgtcgccgtcgcgggaaaccctagccctcctcttgcagcccatctggtggaagcggtagtggaggcggcgtgaggtggtggatttggcggagaagtgatggcgtgaggtggtagatttggcggagaagtggcggcatgccgcggcggaggaggaggagaaggaggccgcgcgccgcggcgatggatttggcggagaagtggcggcgcgccgcggtggaggagaaggaggcgtgcggtggaaagcgaagaagtggcggcgcgcggaggaaaggggacgaagtggaacagcgcctagggttttttttggcgtggattttcttttcagagtgattttttttggcggttctttttttatttttccgcccgagccggccgagcgatcacctcgctttatccgaaccgtgggatcaagatccgacggacgaaacattgctgacagatggattattgataagttttccccacatataattggtttctactcttaatattgctgacagttattttgacccaataaatatttggaattgctgacatataatatgtcttattatgtagtattgccgacatataatttgccaaaagcctttaccaacaaatagtctatcaattattgtttatctttaccgacagatgtctgttggtaacatagtgtcatggtgtagtgttaataggacattttttttggtacttctagaattatcgtattccttcagctcgaataccaacagaaataaaaatatgaagttaaaaaaacacatttcccgtaaagtaaaataaaggattttgcttacttatattttcgtgatacgaacaactggcagatcgcgatgacgaatagatcctcaatgactagatcgcagagggcagaggtcagtattggatggataaggaggggaacgaggaccccaacgaagagggcaaccaggatggcaacatggagggaaacgaggagggaactgacaggcaacgaggtgctgcgaggaagctggagggcagacacattattgctgatgttgccccaaacggcgaaccagtagccccggctggtatactaaggaagtttgtgggactcagtggttgggtcgtgagggatcacgtgcccatcagcatagtgtactggcgtcaaacaaggtcatgtggagatgaccaaagttttctcccagatacggagaaagagatgctgtggaccaccatgctctagactttcatgatccctgaggcagattaggccagagtgaaagaatggactatgaagaaaatggccaaatagttccagagctacaagtcatatatgtacaagacatacatcgtgaagggcataacacctgatttcgacgagtttacgaagctaatggatcattgggatgcgtttgtcgcatacaggacaggagagcgtggaagtgcagatagaaaagaataaagccagtgcaccagctagggttagggggttataagaagacaatccccaaataggaaaaaatggaagccggattgatagaaaaagatatcgtgccggccacaactaactggcttgaatgatgaaagaattggtactatgcacatggtggatcgctcattcccgttgatggctccctgatatacgcaatgagattcgcgaatcaacaagccgacttatagatgcagtggatggctatgctcggggaatagggaacattccggcccaacagagagaaggacgagcttatgctcgcaatacataatcctgagcatccaggacgaacgcgaggcaaatgcatggttccttggaaataaggatttcaagaggacatccgcacgtacaagagtcacataaggagcatgagagataccgaggctaagattatagatcttgagtatagagcctcgaactacgatgcaaggattacagagaaggtgtcaagacaagtggaccaactcctggccgaacagcggggacttgatacacaactgtctattatgcccgtcatggtgagcacctcaggcaatcgcagtagcagctacgcctcaacggggcaagtaggatcatagagcatggaagcagtgcaagcacatgatgaacccccctgccccattgatgaaatcacgcagcggataccatgtgagatgcatattcccatcaagaatttgtcaatcaaggtatgctcgtagttttacgatatgaattgtacattccgaaacttggtgcataggttgattactaattaacaaccttgattcttgtgaaggtgacgtctgtcatggccataccaacggacccttcagggacataccatcgcaggctaattccacctggatacacaagggttgaaattgagctagtggaatgcaccttcgaggatctcgagttggacatccccggaggagacagggagacgaaactagtagacacaacccacgagatgtgacttcctatctggccggatctagattccgcttcccccaaccacagtgggattcttcttgccaggctggggcttcagttggtacaggtagcagaagaaggcaaaatgcgggtagataccataatacccctcgcacatgtaattgaatatggcaatctgaagaatggagttgggattgagatgatggacattgatgccatggaagtgtagcagaccttggaagaaattgccggtcggtagcccaagtctgaactggaagaaggggaggaagactacaatctcattggtgtttggagtggggaaatcttcctcgacgtcctcccaccagttgatgagcgcttgcaggggaggtatccctccgccaccaccttctccagattccccgccattactgtaaacggagcccaggcaacagtttggttgaggattggcacgaattccgctgttgactgggacatggcagaggaggaagacggagaatggctggaggagcggagaatcaaggggctattttgttggatttaccctgagagcaaaaccctaaatcgccggaagcaaagagcagttggggatgagcgaggaagacgaaggggcgtgccaaatatcaagggaagtgggcaacggcgctcccgccgggggtatttatatctcttggtttcctaacaagctggcccatggagttaccctaatttggaaaatcgagtctggttttcatccctgtccaataagacgatggataccggaaaactttactcaggtccggatgagtgcctctatctgcatgctttggaaagagtacttggccagattcgactccgtcacttgacaagtctcgcttcatattcttcatcaagcaaagtactcgggggtactatggatattaccgtacctaggtggtacatggaaggcctttgggtcataactcgggggtaggtcatgggcctgggcccacgggttagtaatgtaaatggcagggataggaaataaggaaacctatcctgcctgatctactcagatggcaggtaccccgattataagggataccgcatcatacttgccactgatcaccctgtcatcatataaagggcatcagcaggaaccctaagggtcaatcactcctcgcattccgataccggacatagatccaatcacatacaattggactagggtattaccttgccttgaggacctgaaccagtataaacatatgtgtcaccacttctttctttgaccttgcgcaccctaaaaatttcatttccgatcttagaaatcgacacttgttgatttgtgaatcaacatctgaatatcaaaaatttacatggttagattatgtatgctgagtcgctcagtgactcgtaaagggcgtagttgcaaacgaaaagcttgcatgtaaaaagaattgaattagaaattagatgttcaaatcaaataacaattaaatagtactaccttctttcatattataagactttcgagcattacccacattcatataaatgttaatgaatctagactgtctaaattcattaacatctatatgaatatgggcaatgctagaaagtcttataaccttaaacggaggaagtagcaattagagctcacgtgttgttgtgtcgttcatcactgtcacgaccggaaataacccaacgggcgttccttacgtgcgtgcattattccttgtcccaggaggcaaggtacaccaaaagttgatacaattcagagtttaacaagcggaagcgtaaatagttaatttattacatgggcagcgaaggcccagcacacacaaagacaaacgggaaacagcggaagactagggcgacgaccacaggcacttgacggcaggcacgagctagacaccaaagccttcatcttccaggggctcctcttctgggtttgggaaaaattgagcaagactgagtacaaccaccgtactcaacaagacacacccacaagtgcagaataattgctcaaagccattttgtaagtatggtcctagagctatacaatattattaaacaaggccgtgaacccacacgaacctgccttaacccaaggcctacgatgattcagatcgaactggcaacccgaccctgggtcccagctcgtcccaagccaacccaggccaaccatttcacattttagttgttaaacaggttttaagaattaaaacactaacttgggtacattgctcggcttgcccataaccgagggcgcggctattcgaatagattatactctgatcagaggtgtacatctttacccacaagacacctcttcctcacgtgtagccacgtgccacataccaccacggtatacggacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttacacggccgagatgctactatcaaaaccatgcaccccgagcccagcctaaaaccattttggggattttgaatagagggagcggtgtgaatccaattccacaataattaaaccattccatagtgtccaggtgatgagaaaattccaaagtctagagttgtaaaaccacctaatgttgcctaattaatcagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttcctaagctgcagcgtctacacgaccaatgaaaaaagaaaagccttttactctaataaactccatataacaagtaggaacaaagcacaaaaatgggttcttgacttcgtaaggaaaaattagagacttgaacggtccaattccgagttcaaatggccaagatatggccatttgaagtttatatgctctttaaatgaatatttgcaaatttcttcatttaaattttaattaaaaaaaaaggtttattgtgtcagccgaggggaggggcgctcggaccgggtccacgggagtggggcccccgcggcagcctcacggtccacggtggaccgggcgcacccgggctcacacctgccggcgccgtgggtcccacgcatcagccgcaccccaggacgcgggcggccgacggccgggccccacgcggcagccgcacggtacacccgaaagcggccacgccggcgcagcggcgggaggcggcgcgcccgcgcccctatggtcgccggcggcggccataggcacggcggagcggcggccgagagaggggagggaaagggggaaatgaagcggtggtccacggctcaccctgggtcgacagcgacggcggaaacggcgaccggagcggaaaaaggcggcggcgcggctcgggtggacgggggcgacggtgctccggcggtcagcgaccgaaacggagagtggacgaggtcggcgaggatgcgccgaagccgaaggaggcggcgccgaggtgggaggtggtccggggcgacgacggcggcggaccggagctcggcggcgacggcggagagagagagcgacggcgcgagctcgattccggcgaggagacggtgcggcaagggcggaaacgggcgagggaggcgcggggagggtttatatagggttgggagtgagagagggcggccggaagaggggggacgggcgcgggagacccggccgccattaatggcgccggcaaggttaggggaggggtttccaaacgaatccgagggagagagggagggaaaaatggggggaaagggggaggggatcccggggaataattcccccctattgattgcgcgcggggacggcgggaggcggcgggattcgcggcggcggcggcgctagggcgcgggcgaggcggcgggagcggcgggaggaaggggatgacgggtgggccccacccgtcagcgagggtggcgggcgagcccgcccgtcagcggcgcgcgcgcggggagggggccgaatgggccgcggggagaggaaagggagggggaaggagatgggccgagccggcccaagagggagagggagggaaaagggactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaatcacgatgcgagcgacgtcgtttctgttatctggctcacaggatcacagtggaaatagcaaatactcaacgtgaagacacagtggaagcagaggatttggtgctgcgaaaacttgctgcagcttttctgaactttgttcaaaatataaagaacagacgcggccgggcttctcgccacgaacctcaacaagtgcgccacgatcagtttgcaacatgtgccatcccacacgtccttttcgctacacacgacgcgcacgaacactcaaccacgcagggaggtgccggctcagatcctaaaaaccagctaacaagctaactgaaaaaaacagaaacgctgaagaaacgaaaacagctagacacgctacaggatacagagtaactgatttcatgaaaaagcttcaggattatccaacgatgccaacattgctcctcctaatcctgatgtttgggtttttacctcaacgactccacttgtgtcacgcagttcttggaacactgcacgacccagcggcttcgtgagaacgtccgccagctgatcaccggtggggaagaaatccacttcaattcggccatcctcgatgcagtcacggatgaaatgatacttagtatcaatatgtttacttccctcatgcagcattgggttcttgcacagagagattgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgagacaactagatcgtcagatctataatacacccggcggattcaattccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgagtttcctatcaacgagcacgatggaatcaatttcatgagtcgccgacttcgctttcgctttgggagttttcacttcctttccgtcgaccacttcttcaagctcctcttctctgacttgatccaaatcagtcggggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggtctattatgccgccgctgttgagcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctacacggtcggttggtcacaccaccgttgatgggcatcgtcatctacaccgccggcctgcctccgtcgccaccgagtggtgcctccgcctacacggctggcctattatgccgccgctgttgggcgtctacaacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgcccctgctgtggggcgtctacgtcttcaccaccggcctgcctccgtcgccgccgactggtgcc

SEQ ID NO: 61096 - DNA, 1329 bp, Oryza sativa
  unsure (1)..(1329): unsure at all n locations
tccgcctacacggctggcctattatgccacggttgttgggggtctacgacttcaccgccggcctgcctcagtcgccgccgactggtgtcctcgcctatacggttggttggtcacaccaccgttcatgggcgtctacgacttcaccgccggcctgcctccgtcgccgccgactggtgtcctcgcctatacggttggttggtcacaccaccgttcatgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgcctccgcctacacggctggcctattatgccgccgctgttattatgccgccgttgttggatgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccgttgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagannnnnnnnnnnnnnnnnnnnnnnnnnnnnnnnnnnnnnnnnnnnnnnnnnnnn

SEQ ID NO: 61097 - DNA, 798 bp, Oryza sativa
attaatgttctagtggtactagttttattgtgaggtttaaacggatgagggttgtagctgagtcaatgacatgtcagccacggcaaattcaaatggacgtggctttgcatacaatattttttacgaacgcaaaaaatttgcacgttaatatattataagaagatggcataatttagttacacaacacaaacggtcagaaagccgttgtcaggggccaagaaaaaaaagaaacaaaaaacaaatacataaacggttagctacagaaaaagaaaactcctaccacgagggagggatgggtatggaaacccactacactccggcctgcatctaggcagggagctggagaagagcgaagatagggcgatgacgttgtaagccgcaaccgtctcgatttacacaggaccctccgcctcgatttacacaggaccctgcttagacaccaacccaagcttgcatatcagattgtgctgcgcacacgagaccgtatgactcgggccgtcgagcgcgagtttggccgcaatcctctcgctgtggctcggcacttccccatggccgcgatggcaggcgacggaggcgggtccagtgggagcaacgcagggggcaggccggcagaggcctagagcagctggcaagaaaggcgcgtagagcaacgttcaagtccgccatcggccgaccctcaagatcgagaacgaccatctttgcatgccaatactcgtattagcggattgtcctgcctgaaatcgttggaattttcagtcacctttgaatttactggatgtgcaatatagaccaatattc

SEQ ID NO: 61098 - DNA, 1566 bp, Oryza sativa
gagggcatgcacacgtagaggacgacgaggcgaacccaacggtactcaccacaacgacaatcgacgtccgacgacggccggcgacgagaggaggcggcggcggcttggaccttaccgacgacggcgagctacggcggccggcggcgaagaaggacgggcggccgggcttctccaccccttggcgcacctcttggcgacggcggcaagcggcggcgacggcagaagcggcgcggcggcgcggctgcactcggccggcggcggcgacgaactaaacgcgcgcggcgacgaggctacgaggcactagagagctcgggagagggggcaaacgaaagaggaggactagggggtcctatttatagccttggaagctcgggtccgggcccaaaacgacgggaaaaactcgggaaagtttatcttcgccggaaaaaggaaaggatttgatccgcgaaattggaaaggatttccatataaaattttggggatttcttggggaaaaggaagaggagaataagaggaatatttcccctcaactaatttggaaggaggagcaatgaggaggtccggatttggtggaagaaggcggcactgtgcacaggctcggctggctcgggatctgtccagagctgtaagatgaacagtgccagggaggcaaactagacttttttcggttggatgagaacagaacagagcacttgaattggagtaggcttgggctgtacagtatgcgcgcaagggagagagaagaggaaggaatgggctgaaaatggcccaagtggaggaggaggatttttattaatttcccgattaaaataatcagttaaatgatctttgaattattaaaaatacttccaatgctcaaataatttcaagaagaatcatgaaaatacttggacactcaaagtacttaacaaaattacaattagaccatttaatgattaatttaatatgtggttaattactgaaatgctcttgtatgattaaaaattaggaattgagctccgaaaaatccgagaaaactccagagagtataattaaccatggagaatttaataaaaattaaatccatccatgctttatatttaggaaattttatttcccacatttaacttcactagtaaattaatgaacgtttaatataaattctattaataatttattaaataatttataaatcctgaaacgaaaatcaggatgtgacaaatctaccccccttacaaagaatctcatcccgagattcggaacggctagaaagaaaaaggcataggtaaactacagtctatcttttattccacaactccaataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgc

SEQ ID NO: 61099 - DNA, 3349 bp, Oryza sativa
gggattagtttaaaccaggctgctggtgaagaacaagaggtagcagtggagaaaaccactaagaaactagaggatattcctatagtcagagagtatccagaggtttttccggatgatctgacaacaatgccaccaaaaagggatatcgagttccggatagacttgtaactggaactgcaccgatccacaagaggccttacagaatgggagccagcgagttggcggaagtcaagaagcaagtcgatgaacagttacagaagggatacatccgtccgagcacgtcgccttggggtgctccggttatctttgtggagaagaaagacaaaaccaagaggatgtgcgttgactaccgcgcactcaatgaggtcactattaagaacaagtaccctttgccaaggattgatgatctgttcgatcagctgaaaggagctactgtgttctctaagatagacctgcgatcaggttatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgttgtggttttcatcgatgacatacttatctactccaagtccgaggaagaacatgagcagcatcttcggctggtacttgaaagttaaaagagcaccagctatatgccaagttcagcaagtgcgacttctggcttaagaaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtccccatgaaggcaactacccgacgcacgatctggaattggccgcagtcgttcatgctttaaagatttggcggcactatctcatcagtaaccgttgtgaggtatatacagatcacaaaagtctaaagtacatcttcacccaacctgatctgaatccccgacagcgaagatggttggagctaattaaagattatgatatgggaatacactatcatcccggcaaggctaatgtggtagcagatgccttgagcaggaagagttactgcaacgtcgcatgggtagaggaactatgctgtgaggtacaacgtgatttggaacatttgaaccttggtatagttgagcacggattcgtggctgccctagaggcacagcccacactggtggagcaagttcgcatagctcaagcaagtgatcctgaaatagcagagctcaaaaagaacatgagagttggaaaagcccgaggttttgttgaggatgaacaacgaacaatctggatgggagaaagattgtgtgtacccgaaaacaaggaattaaaagacctgatactaacccgaggctcatcaaactcaatattccattcatcccggcagtaccaagatgtaccaagaactcaaagaaaagttctggtgggtcagcatgagaagggaaaatagctgaattcgtagcactctgtgacgtctgtcaacgagtaaaggcagaacaccaaggccagcaggattgctacagccacttcagattccagaatggaagtgggaagaaatcggaatggatttcatcaccggtttgcacaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattaggaacccggttgaatttcagcactgcttaccatccacaaacagatggccagactgagcgagtcaatcaaatactagaggatatgttgagagcatgtgcgcttgactttggtggagcatgggacaaaagcttaccgtatgctgagttctcgtacaacaacagttaccaagctagtctgcagatggcaccatttgaagcactgtatggacgaaggtgtcgtactccgctcttctgggatcagacaggggaacgccagttgtttggtacagaagttttaaatgaggcagaagagaaagtcagagctgtcagggaaagattgagaatcgcgcagtctcggcagaaaagctatgcagacaaccgccgaagggagctcgctttcgaaacaggggattatgtgtatcttcgtgtcactccgctcagaggagtacaccgtttccaaaccaaagggaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaatttccggatcaaatcataatccaggaagacttgacgtatatggagaagccgactcgtatcctcgaaaccagcgagagaaggaccagaaacaaagtaataagattctgcaaggttcagtggagccaccactcagaggaagaggccacttgggaaagagaagatgagttgaaggcccccacccgcacctcttcgccagctcttccgaatctcggggtcgagattccgtttaaggggggtaggtttgtcacgccctgaagttttcccccctttgcttgctttaaaaattggttaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttgtttttccttattcctcctttttcctcttcttgggccgtcggcccagtccacccgtcgcccgcgct

SEQ ID NO: 61100 - DNA, 793 bp, Oryza sativa
  unsure (1)..(793): unsure at all n locations
attattctaggcatcatttaaaggatatattttagagtcgttttgggacgtgacaaagcaacacccacgggggaaatcaaggccgacaacaccatcaaattcattaaagggatattttgcagatatgaattgcctcaccgcatcataacagataacggttcccagttcatcagcgccgatttccaggattactgcactggactgggactcaagatctgcttcgcctcggtttctcaccctcagagcaacggacaagtcgagagagcaaacggcatagtactacacgggatcaagacccgtgtctacgacaagctcatgtcacatgacaagaagtgggtcgaagaactcccctcggtactctgggccgtgcgcaccacaccgataacgtccaacaaggagacacccttctttcttgtgtacggctcagaagccatgctccctaccgagctacaacaccagagtacacgagtacagaagtactccggcgaggatcagaaggaacagcaaaacgacgacgtgaacctactcgaggaacctcgagaacgagttgccgtcagggcagctagttaccaacaagcccttcgccggtatcacgagaagcgcatccgagcacgcatactttcgatcggcgactacgtcctccggcgagttcaaagccaagcagggcgaaacaactctcacccaaatgggaaggaccgtacacgatcacacaagtcttgtggccaggcgcattcaagattgcagacggtgatggnnnnnnnnnnnnnnnnnnnnnnnnnnnnnnnnnnnnnnn

SEQ ID NO: 61101 - DNA, 859 bp, Oryza sativa
  unsure (1)..(859): unsure at all n locations
aggaatgccaggagactcacgatcctagcgaagtagagatcggctagttgttccctccacaggtggtcttcacaggaataaacggagctaccttggttagtcggtccacaactacccatatagaatcatatccgccttgggttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctctttcaagtctaagtacatcttcgtactgccagggtggatggaataagggctttcatgagcttcctgaagtatcaactgtttaagttctctgtcgtctggaacgcatacccgatttccgttccatagggttccgtgttcatcctctgtgaaaccagcggctttaccttgtttcatattcttgaggagtccacgtatatccggatcattcttctgagcctcgcggatttgatcgagcaaggtaggcttggcttccagtgtagccaagaatccacgaccaactatgcttaggttcagggcttccatctgttgattaagttcaggtggaatgccacggacgccaagagtgttgcaatggctttttcgacttagagcgtcggcgaccacgttggccttaccaggatgatagtggattcccacatcataatccttgatgagttctaaccatcttctctgccgaagattcagatccgattgagtgaagannnnnnnnnnnnnnnnnnnnnnnnnnnnnnnnnnnnnnnnnnnnnnnnnnnnnnnnnnn

SEQ ID NO: 61102 - DNA, 731 bp, Oryza sativa
aatgcaagtatatacagagacgatctacctaggactttactgtaaagaatttaattgtattacaaagaatatttacaaaaatcaaatgtttgtcgcatatgcattgcaaatgttctgccatttcgagacgagctaactaggacttcactctaaacatccctttcggtgacaagatatcatctagtatgaattgtgctatctcctctctaatgatttcgaagttgatttccggaatacttgaaataaattcctgcatgttcggtgccaagttagtctacatacttgtaaatttgttgtcctatgtgtgtataaacaattgaaatacacacctcagggtcgagcaatgtcaccttttctgcgaagctcctcatgttatggcagacatggaacccgcactggtcgccaacttgttgatgtattgggaagtctttcttgtgaccaagtttcggatgcccatccttatgcctcccgcctcttgccacgtattggtcccatgcctcgttcaaggcagattcgatggccgaccaatcgtatatttctggcttgatattggagttaaggtagtgtacccggctccacttcggcgttattaccagaagaatccaatgtcgcttgcgaaattattaaattgccagttacatactacagttgtacgcgtctagtatttgagtataagtacggtacacggggactgttgattgtaggcacacataatgaagtccttgtcttga

SEQ ID NO: 61103 - DNA, 2719 bp, Oryza sativa
  unsure (1)..(2719): unsure at all n locations
nnnnnnnnnnnnnnnnnnnnnnnnnnnnnnnnnnnnnnnnnnnnnnnnnnnnnnnnnnnnnnnnttaccagaagaatccaatgtcgcttgcgaaattattaaattgccagttacatactacagttgtacgcgtctagtatttgagtataagtacggtacacgcttactgttgattgtaggcacacataatgaagtccttgtcttgacgggcaaataagcagtccttgatataacccatcatgtttgctcgatcgtttttcagcgttgtctcattgacgacagctggatcgagtaaggcaacatggggtgctttacgatggacatgcttccaggttaacctacaagcaagacaatagtcagggtaagcttaatttgtggacagtcactaccatatcgcgtaccaagaaatacttacaaggagtagcacttaaggaggttggtgtcgatcgctcgcaccctgtggaggtcccatagatctttgaagtctacggcgatgaaggcagtaggcctaaggaacggctgaccatcgtgctggcccaacatggaggtctctctattcttcctccttgcgttggacttctccatgtagtacacgtgcaactccttgcatgcagggcccatcttgaataaggcatcgtttccaaccaatggcattttagggtttagggtttagggtttagaggctttggaggagctactagcgccttaccaagatcaagcttctttggggctaatggcacatttatttttcctctccccgttccagcaggcttttctgcgtgtgtcaagcttgggtggagaagatttcgccctcttgctccttttggcaggaggggggaggtgcggcttgctgtcaacctccataccgtcgtccccaaaattagtatcatactgtaattggagatcttcatctctttgttcaacggcaggagggagagatacaacagtttgatggggatgcgtcggcggcggacgagaacttggcgctagccttggagttatattgatctcaatgctgtgcttgggccatcgaataaaggtcccacatgcagccccaagggtcaaaatctcatcattaggtgggtgtgggatagtgtagccaacccaatcgggcttcactaagtccacctgaactttggcattgccggcttgcagctgcgccccatgcactcgagtctccgaggtaggcttgaatacttgaccctctgcggcaggaattgcaaatcctggtgtcaccctaacgactagggtacacgatgtgggttccggcgatagattcattagtgtccttagtatatgttgcaatgtattgtggtgctaatacaatatatgcgttattaagttgtttttaccgttatgtggtccaccgcggcggggccttcaggctgttctgccggagcctcagttgatgcgcagctgctacgcctctacgtggggctcacttgtactatgggaccgggagtggcatcggtcgacctatccctgatgcgtgcctctatccaagcctccatacctaacagctcggcagtgagctcttctgtaagctcttctttaagctcctcccgaagttgggccttaatgcatgcagctttctacgccttggaaagcttgtgcttcttgtactgccatgcgtattggggaaacccaaacttccatggaacattggagccaatgccccttgtttgtccacggtgttcttcgtttcccaacgctttcgtgaggatgtcatcctcgcgtttttgtgagccgacctcttgggaggcctgtctctcagcattcagttcgacctggggtacagttaggacatgttagacgaagaatacaatacaacataatgaaacctattctatgtgttcaacttacaattttctggtacaccacttgatcttcgggatttaggaacgaaagaattccgtcactattcttcttcacccttgcccttgcccaattccttgcctgctggaccgggatatcagcaagcacttgcggggtgttagattccgctgcagcttcatcctccttgtcccattctgcctgtttccccgcgtagcctccggtgccaagccggtgcgggtgaaggttccttgcctgcagatcacggtaggcctggctttttgcccgagactctttcgttgatttggcggcatggaactcatcccacatgggttgggtgatgaatggatatttcccaaatggttctggctgggcggggttgagaacgtactccgtgaccagcattgtcttgaaattttttcaacaattccccatcttgcggatagcctgccgcttgagtcctgcctcggcctctgtagggtatcggaagctttccttgaactgcctccaagcctcttctttttcttcttgagggaccagatcgatgtggtcctatagaatagtgaagattcgcctccctagggctctgcatatcgtagggaactttttgacagctttcgtcggagccgtcggatatccaacatcgtccacctctgttatggtgtaaacttccttaggaaccttattctgggtcctaggagtccggctcgatgtagtctcagtagtggtcgtcgacatcggttcgcgttgctgcgacatgtcctatggcactgttgtatggggagaaagtactttttaaacacaaaattgcatctacacacattctctgattgtttgatatacctctatctcatacctgcgttcgcctcgtcgacggaaccatagc

SEQ ID NO: 61104 - DNA, 1050 bp, Oryza sativa
gtaatcgatacaaaactcaatgccttcctcggtcgtgtaaccttcaatgatgctcccctctggttttgctctgttccgaacgtaggacttcagaattcccatgtacctctcgaatggccacatttctctcataaaagttggcccacatatttttgtgtgcttcactaggtgaacagtgagatgaaccatgatatcaaagaaagccagtggaaaatacatctccaagtgacacaggctactgacaatatcggcctgcaacccatctaggtcttctggatctataatcttctgaccgattgcattgaagaaggcacaaagccgttggatcgtgtgacggacttgtggtggtagaatgccacttatagcaactggcaagatctgtgtgattaccacgtggcaatcgtgagacttcattccaaccagcttaagatcctccaatttaacgtacttacttattctcgcgcaatagcccgaaggaactttaatatctgccagacatgatagcattgcgatcttctcatccttcgacaatgtgtggcaagctggtgggaggtacgctcttcctgtcttctcatctgtaacaggctgaagttcactgcgaatgttcatctcctgtagatcgagacgcgcattcaacctgtcctttgtcttgccaggcatattcaacaatagccccagcaagctatcgcacacattcttctctacgtgcatcagatcaatgcaatgacggacctcaagatcttcccaataaggtagccgccaaaatatggattttttcttccacatcctcttcttgtcctccttgctacgttttcttttcttcccaaactcattagtaatgtccttcaccatgttgtgtacctgatctccggacaaatccgcaggggcagacccaagttctttcttaccattgaaaattttcttctttcttctaaaggcgtgccgtagggggagccatctcctatgacccatgtaaaccatctttcttgatttcttcagccacctactgcgtgtatgttccatacagtcagagcatgccttctttccttt

SEQ ID NO: 61105 - DNA, 3369 bp, Oryza sativa
  unsure (1)..(3369): unsure at all n locations
ccttgcacttgttcctgaaatattattgacgtggctgatgaatgctgtgtgttattggagtctgatttgttgtggggcttcattaaaggattttcatgagtagagctgggagaatagccttggctgacgggatgatgagggtgaagtgtgcctcgtcgctgtgttgacagaatgagggagggagattttggaccttttggtattttatgctcgctttactcatatttagccaaagtccatatataggagaggcccacaaccaaaggtcctaaatttatgggaacatactaatgaaggaaataaagcaacaaaataaagaaatagctaattaggaaacatttctctaaaacttgtaggcgtattgtggtggctggcagtagagccagcaattttaccctgtggggtccattatcattgcttgatattttagtggggccatttatgcaaaattcagtggatttacatggaaaaattagtacccataagggtgttagtgaaaaagctgtggggtcagctgatcccacagtttgtacatggctccgccactggctggtgcacttgtagccctgtgttggtgggctgtaggtgcgcctccacatgatatatcccctctctgaaagcagcttgtcctcatactgaattggggaagcacttgatgaagttgttttgagatccttgacgtattggcagctagagagttcagccaatggacaaagggctcgagaggatcacgggcatgacggggctttgagcaatttgatgagggtatctggcaaacttgttgacactccagtgggagtgagggaattgcagccttctctccatggaagggtttcagtacccacgtgaaagatatgtctaggactctcttgtgtacttcaatataattgggccttgaacttcctatatactacctctgtcctaaaatatacttcctccgtttcacaatgtaagtcattctagcatttcccacattcatattgatgttaatgaatctagatagatatatgtctagatctattaacataaatatgaatgtggaaaatgctagaatgacttacattgtagaacggatgatgtagtagattttgcccatgcaactacatgggcaaaatcccttatagtttggaattgaggcagtagtactttcttgctttattaatctttagctaagtctgtatataggagaggcccacaagcagaggaaatatatgaataaaatcaggaaatttttaatcaggacatttcctatacttggggccttacttataccatagaaagttgactatatttgaaaattgttccaaattattttttccagtcagaaatatagatcaaaagttcctgaaaaaactaggttaaactagactggaattaacctatgaagctttaaagaactttcttgaactacttgaacgaaaaccctcaatatgaaaccatagattaaagctagaactgagcaaacacaaggaacatcgagaaaaaaaaaaaacgtgttgcattaggcgactaattctcaatgttttttttctatacatatttgggggaaaaaatacttcaaatccaactcaagattctccaaatgtagtttaatttggatgttgtctagttgtactaaacaaaatcaggtgtggactttttttttaatgcataagtgggacttagcaaaaccaggttatggactaaccttggcataattgtggctgtagccacctctgaacaagctttgatcctatccgctttagctggtcattatatatgatttagaaggttaactgacatgcacttgagctttttctgttttatgactctgtacatgtttgtcatattatgatttgtcctttattaagttaccctgttgaagaacatttaagttcgggatggctctttttggacaggtttacagctgttttgaaatgatatttatctaaagttttaactatttagtcatcaggtccatttggtgctattgatatctccctttatctctggcaatctatctaaactgattacttgccgcttatctacttctttttaactttgtaggagttactacaaatgcacgtaccaaggatgtgatgtgaagaagcatattgagagatcctcacaagacccaaaggctgtgataactacatatgaaggcaagcacagccatgacgtgccagcagccaggaacagtagccattcttccgctaatgccaacgtatcgtcttccagcaatttacctcacaaggacagggggcaacggtcgtcgtgcagagatggtttgcggaatgcatcttcagtttcttccttacagttaaaagaagagagtggatagcatgaaattttggtagtgtttagctgggtaaattgttctgttcttcagtccaatctgggtgtgctgcttccaagcgccgctgagcagcgtgtattggctttgtaggttggttcttgcattggtttagttagggcttaggggctcgtttggtatgcgggaatatgctcatattcctctggaaatcgaaccgtttcatgtgaaactaaaattcatgccttccaaacagggccttagcaagaggaaacccagcatagcatccttccaatatctcgcacgttgtgcttccaatggctgtaaatgatataggtcctgcccgatagagaattatgggcgacagaggtttctttggcgcaactgtaaatgcttggcatgtaagtctcatctgatggctgctgactccacctccaagttcttgcggcttatttcatcatccttggcccgaagacggcttttaaaaccgtcaaaacgggcccgcacggttcgctccgtcgaacagtgagccgcaagaatctagatgaaagataggagcgggcgaaaagagcaaaaggttaattgcgaaacgtaaaaaaaagggaagaggaaaatgaagaaggaagaaaaggcatacccgaaccgccaaacttttaatggtggaacacccctcgtcgaactcattaagttcggtgaatatgctcggggtgccggtgggcaagacaagattgcttactccctccacaaagggaataaggtccgcccgggtctcgaagtcaccaggggcgaagtggggcgtcgcaagggaatactccgaggtagatgcttcggtggccgcacacttccccttcgtcttgaccagcggcgaaattgctggctcgcacgcagggctcccgaaaaccctcgccgcagccgacacgatccgatcgacggaggcggaagccccggtggcggcgctaccgcctgccccagcaaccccgagcggagcaaggggagcagtcgaaaagtccaaactacggccannnnnnnnnnnnnnnnnnnnnnnnnnnnnnnnnnnnnnnnnnnnnnnnnnnnnnnnn

SEQ ID NO: 61106 - DNA, 3568 bp, Oryza sativa
tccgaggtagatgcttcggtggccgcacacttccccttcgtcttgaccagcggcgaaattgctggctcgcacgcagggctcccgaaaaccctcgccgcagccgacacgatccgatcgacggaggcggaagccccggtggcggcgctaccgcctgccccagcaaccccgagcggagcaaggggagcagtcgaaaagtccaaactacggccagcaggtgaagtcggagtctcgtcagaagactcgtcgtcgctaaaaacgcgagcgatgtcgacgagtcccttcttttttgagatcttcttgaccagacctcctttcgccgccttgcccgacgagaacgcaactagggccttcgccccttccaaatcctttcgtcgaaggggggagctgttcgactccaccccggtctcgttgtgacgtggacttggggtaggagtgtagccgggggtgtcgacgcggtcttcgatcacctcgttcgcagccttatcagccacagcctccacctcctcttcttcctctccttcgtccttgccgtcacgttcttcggcatcatcctcgtcgtcggcgtcggagtccaacgaagcaggaacccttcgcttcctgggggcaagcttcacttatccacgcatcgctttcgcgaaggtcctgcatcgtcgtcggctttttggggattcgcccggggaggcagttcgccgttgtaaacccggttcgcccgcccagccgcttgtcgtgttagcagctggctatactcgacgaccgaaacgtcaccgatcatcctgcgggcttcggcttcagcctggtcgagggtcgatactgcaaaagtaaagggtgtagctgcgttaaaggtcagacaaggcaaaataacaaagcacaggagtgtatagcaaaaggcggtcttactgttcgtcccctcaggaagaaccaagttcggcaaaccgtcagcctcttcgcattgctcgactgtgacttgccatgactgggagaggggaaagatgcgaagcaaacagaactcctccaccaagtcagggcttttgccgagtcagaaccacctgcgaaggggatggtgtgatagaaccacctcgccatccaatggcggtcccacttcgacatggcagcgttcaccggccagagatcggaccgctcgaggcgaacgttaaagttcatgctcccgaacactgtcttcttcgttccagccggggtaatcaccatcttcgagttcacggtggcgaaaaatatggcaccgaagagctcagcgctgggctcaaacccggaagtccggcatgcccagtcaaagatggagatccgaactagcggcgatgggctcaactgcggaagctccacctggaaaaggcgaaggatatccggcaacaacacgttgcacggaaaccgtagccccacctcaaaaaagacggcaaacaccaccgtccgattgtcgacaggcttcggcaccacggctttccccggggcgaaagcctgccccttaaccaacgccccagagctgaccaacttcgccagttcgacgtcgtccatgagagaaacccccaaaaaggcggtgctgtcatcatcaacccgaccgggatccggtccttttgccgaagctaggtttggcttgcgaggggccatggcgaacggcgtgtatgcggtggcgaaggaagagaatgggcgaaacacctaaggggtcaagaaatgctgtggaagagaggaacggaagaagagagcgcacgcggtaaaaatggcaagtgtaccggtgaaaaggaaagaggggtgggaatatatagctcacccaggcgaccgttcgtctactcaccagtaataaagcgccacgtgtcgcaagggtaggcgaaacggtaaattcccaccgtctgagcggcacagtaaaaagcctacgatgggaaggcccaatactgttccgttcggcccaggaaaataaaatatataaccaccaatcgcacgaggcgaagcgcggcaaaataataccagccgcacaagtaacaaacttcattcgcaggaataatgtaggtttcggcaggagcatcggtcgaaagggggcgccgcataccagaccacatggtttgcatggtctcggccgaagctccaatctcacccgtgcccatgaggggcttgttggcggatggcatgaggcccttcgaccaagtctgcccaaacccgtggcgaaggctatggagcaagaacgacgtgaggcgaagagtagtacgagtgccttgccgggccagaggcgtctcaggcgaagggtgcaaggcgaagactatccgccgaaggaagacgacttcgccatgacaagttcgctcccgcgagggccgaagaagcctttccggcccatcaagcctaggggctatagggccggcgatcgcctgacggcccatcaggggcctatgagcccctataacattatgtacccctgtaaatgtccctttcgtaagggtaatcatgtaaattcccctgtacaacctaaaccctagtagtaggatcctgtaatggggctataaatagtcccctagggccatgtaatggggggatcgaaaagaaaagaatttagaaatttaatacacttcgtttccttccaaccactgttgagtaaccacgtctttcgacgtacgcagttgtcatttcgacaacataggtcatcacaagatctgatcccccctcacaagtgtcgaaacggcaaaagaagatgtagcttcaggccgtgcacaacattgtctcagcaggtgatagcgttccaagatacttgtcacagccaatatcttttggaccagaacatgccgaaggagttctattcctgcaccaggacccgttggtcgtttcagcagaaatagccggttttgaagtccggcgcatcctgatcgatggaggaagttcggctgatgttatgtttgctggaacatatgccaagatgggtttgccaaccctggcactgtctcaagcaccgacttcactcagtggtttcagcggcgaagcagtgcaagttctgggacaagccctcatcaaggttgctttcggctcacaagaaaacagaagagaagaagagatactgtaacaccctgaaaattcgaccgacaaaatcaaaactctaaaaatacggattttcaaaaactttttaaattaaatgcatcatgccgatcttattcgcctattttatttggatttaatttcgaagttcattaatcgtgagtaaagaatagttaattaggaataaaccctaaaaacaaattgataaaataaatataatttaaaataaagattaggtgtggatagaaataaaatattatcgcgaccatatttggatcaattgaatttaaatgcgatggaataagaattaaccctaattaaaaattcaaataaattatataaataaaatatgagtaatattaatctagagtaaatccattggttggaatgacacaaatattgagtaaacttcatttatacaagatttaggatttatagaatcaaatttaaataataaataggctaaaatcgggttaaataagaaaagtcactattcattgccccctaggtgttcgatcgcgccctagcccctcctctgcca

SEQ ID NO: 61107 - DNA, 6213 bp, Oryza sativa
  unsure (1)..(6213): unsure at all n locations
nnnnnnnnnnnnnnnnnnnnnnnnnnnnnnnnnnnnnnnnnnnnnnnnnnnnnnnnnnnnnnnnatcaaaactctaaaaatacggattttcaaaaactttttaaattaaatgcatcatgccgatcttattcgcctattttatttggatttaatttcgaagttcattaatcgtgagtaaagaatagttaattaggaataaaccctaaaaacaaattgataaaataaatataatttaaaataaagattaggtgtggatagaaataaaatattatcgcgaccatatttggatcaattgaatttaaatgcgatggaataagaattaaccctaattaaaaattcaaataaattatataaataaaatatgagtaatattaatctagagtaaatccattggttggaatgacacaaatattgagtaaacttcatttatacaagatttaggatttatagaatcaaatttaaataataaataggctaaaatcgggttaaataagaaaagtcactattcattgccccctaggtgttcgatcgcgccctagcccctcctctgccacgctgcccttgcgccccgcacgccgcgcgccgctccgcctcccctctgctgtcgccatcgccatcaccgcgcatgccgtcgtcgcctcgcgcctcgtgccgccgcccgcccgtcgccatcgccgcctgccgccgcgccgacgtcgccgtgccgtcctgagcccgcgccgacatcgccacccccgtgctgcgcgtgctgccgtcccgtcgccacgtcgcctcgagccccacgcagccgtcccgtcgccgtcaagcccgcgccgcgccgcgccgcgctgtcctaccgccgctgctgtgctgtcgccgtcgccgtcgctgttgcgtcccgcctcgcgccgcgcgtgcgtcccatcgccgcctcgcgccgcgcgcccccactgccgcgccgtcgctgtcgccatcccgtcgccgccgtcgcgtcacccgccccctctcttccctcttccccttactcctccccctctcccctataaaagctccaccgttctcccctctcctcactccatctccccctcctctccctcttccccttctccacgcgccgccatcgtcgagccgccgcgtcgccgccttcgagccaccgcgccgccgccctcgtgctgtcgtgccaccgcattcgtgccgccgcgccgccgtctcagggtgccgtgccgtgcgccgtcgtcgctgccgccgtcggtgagccgctgcccccccctgtttgttgccgtgccgccgggtagagagggagccgagagagagaggaagggagaagccgagggcgagaaagaagaaggaaggaggagagaaaccgggagggagagagagagagaaagaaaaagaaaagaaaagagagagagaaagaaaaaaagaaaagaaaagagagagagaaggaaaaagaaaagaaaagatagagaaggaaaaagaagagagagataagataaaaaaaataaatagaaattagagggagattagggaagtttagaaaatttaaaataattagaatttaattatagattaattatagtcgtagaattgcaaaatttaatataaattatggattattcttggcaatttctataagaaatcaattcgcggtaataatttagatgtagttaataactaaacaaatagatgaattcttatagattattatagattatttttggtaatccctataagtaatcgattcacggtagaaatttggatttaactactagggattttacccgtgtattatatttaatcatttagtcatagactaaattaaatcgtataatatttctaggattttgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaatagtaaagttaatataaagaaatcgactttcgcattcgacttttatttggatttatttggatttttatttgaattctaaccaaattcaaatcaatttttgcacgtaactatagagcccgagggagttgcggatccaagcgaaggtcaagacccgcaagacattgagcaaggcaagtcatcactattccctgaacatgttggtcccaattgcgaaattgttttgtttacaaataaaattgcatgcaatgatgaacatcctacttgtgattatgccatgccttgattattatttgccccttattccttcgtaaccatatttacgtatgagtccctagtcaattatgacaattgcttagaaatgctattctagaatcatgcatactcacatttatcaaatgttatatgcttgggcaattacctttgggaaggtaattgagatgcggcatgtggagacatgagcgccacattgccatgatgttgatgacatgatttgtgaaaggagaaataaaattaaacaattgttttcgactggggcggacggtggatttgggtggtatctgggaaaggctagtaccatccccggtcaattaaggaccgagccatgaagttaagcatgaaacgacccccgtacaacagcacttctcgtatgagtatagacctagcggattagatagccgagcggaggcagtatccctgcatagatggttcacccctgagtgaggcaggtgcgctacggtggggcagccgttgaggtagggccgagaggcgtgccctacatcggtgtcgccatcggtaggactgccatgagtgtgtgagagagagaacttaacttgaaccataatttaatatgtgtgtgatacttctctttctcgggagcgccagaactcctctcactgctagaaacatggacgcctagagtgcatgaggatttaagttcatggagcgggtactgccaatgcgaggttatcaaaaagctttgccgtgacgcgtctcatgtgctgggacgaggctcatgtgttgggcaatcgtggagtgcgggtaaagtgtacatccactgcagtgtgagtaaaccaaatctattcgaatagccgtgctcgcggttattgagcaccgggacatgtattacacttggctagactctaaattcttaacttgggtgggatgggatgttgcatgatgatttctatgctgatggagccactttctgagaggcgggaaggtggacgtcctcagaaaaccatgacgactcaatggcgggaagctatccttgggatcataatggatggtggatagaaccgtcattgtttaatatgaacactggtaataaaaatttgatcagtctgtactaggtcttaggtttgtgaaaagaattacaaaacttgctttgcgcaaaagaaccatagccatcctttgaatacccctgtcatatgcattgttgatgtggtggcttgctgagtacggttggtactcacccttgcaatattcaaacttaatcagaggccggagatgaagcttcggaggatccctatgcctattaccaggagggtgatcaagacgatggcgctcagtaggtcttagttacggtcgttgcctgtggtaatggcgtgccgctgccttaactccgctgccttaccttcttctgtttttggaatgtattccggaccgctcggtccgatgatttaagactatgcctgcgggcttatggtgtaatgattcgtactagacactcgtgtatgtgcacttgatatttcagctaagaattcatgtgtaccagactacttgatccagggaaatggtactgtttacacgattgattcctgttataaaaacgggggtccacagatactcttcgacattgttgacatcccttacaactacaacgccatttttggcagaggctcgttgaccaagttcgaagcagcttctcatcacaattacctcaagctcaagatgcccggcccggtcggtgtcatagttgtgaagggttctcagccttcggccgtcacagttacacgtttcggcagagaggttcacactgtagaagtcgaagaacaagagaagacaaaaccagttccaaagccgaccccgcatggcaatgtcgtccagcgacagctagacagttctgacctagccaaggtcatttcacttggtagtgatctaagcgagcaagaagttgaaggcatcctagccgtgttgaaaaagaacattgacattttcgcctggggaccagacgatgtggggggcgtttcgccagatctcataatgcatcgcctcgcagtcaaacctgaagcaaagccaaagctaaggaaaatgtcatcagatcgccaagaggcagcgaaagcagaagtgaacaagctgctgaaagcaggggtgattcaagagatcgaccacccagactggttagcaaatccggtattggtcagaaagtcgaacgccaagtggcgaatatgtgttgacttcacagacctcaacaaggtgtgtgcgaaggatgatttcccattgccccgaatcgaccagctagtggattcgaccgacggatgtgagttcatgagctttttggatgcatattccggatatcatcatattcatatgaacccgacagacatccccaagacagcgttcatcacacccttcgacactttctgccatctcagaatgcccttcggcctgagaaatgcaggggccactttcgccaggctcgtgcagaaagtcctggggttgcagttgggtcaaaatgttgaagcctaatttgatgatattgtcgtgaaaagccgcaaggctttcgaccacacatcagatttgcaagagaccttcgacaacctcagaacagctggcatgaaactaaatccagaaaaatgtgtcttcggcgttcgtgccagtaagttgttgggatttcttgcgtccgaacgggggatcgaagcgaaccccgaaaaaatcgatgccattcagcaaatgaagccaccatcgagcgtacgacaagtacaaaagttcacggggcgaattgtggcactaagtcggttcttgtcaaaagtagctttcggtgagcttaagcaataccttcaaagccccccagcactggtcagcccagcagcaggtagcgaactatagctctatctggcagcttcgcctgtggcagtcagtgtagctctggtgcaagaaaccaaagcgggccagaacccggtttactgtctctgaagccctctagggggtgaaagtaagatacatcgaaatggaaaagttagcttacgccctgatgatagcttcaagaaagctagcttacgtcctggagcccgagcctatcgaacaaccatgggttatgcactcagatggcttgtggtctcacaaagggcgggcaccgctgcaatcctaacttcgccaggaggcataccaattcagtgtgcagcaagattacagttcgacacaaccaacaacacaacggaatacgaagcagtattattaggtctgagaaaggcgaaagctatgggcatgcggcgcttgctagtctggacggactcaaagcttgtcgcaagccaagtggacaaatccttcgaggcgaaagaagaagggatgagaaaatacctggaggccgttcggtctatggacaagagtttcgctggcataacggtcgaatacttgccccgaggccagaatgaagaagccgatgcattagcgaaatcagccgtttgtgggggactgcattcgccaggcgtcttttttgaagttctttacacgccgagtgtgccagaaaacagccaggacatcatggcaatcgaccaggtcgagctgggcgaagacccggacgactggcgaacgcccttcgtcaaatatctcaaagagggatggctgccagatgatgaagcaaaggcgaaacagttgcaaatcagatctacaaagtacagcttagtctctgggcaattgaaccgaaccgggatgctgtagcccatgcttcgctgtgtctccttttccgagggtgaagaaatgataagggaaatacaccaaggaatgtgtggagcacaccaagcagcaagaactgttgcatcaaaagtatttcgccagggcatatattggccaccggtactaaaagtatgtgttgagcaaatcaagaagtgcgaaagctgtcagaaacatggtcgaagccaagcggcccctcagtacgacttgcagccaatnnnnnnnnnnnnnnnnnnnnnnnnnnnnnnnnnnnnnnnnnnnnnnnnnnnnnnnnnnnnnnnnnnnnnnnnnn

SEQ ID NO: 61108 - DNA, 1388 bp, Oryza sativa
  unsure (1)..(1388): unsure at all n locations
catggcaatcgaccaggtcgagctgggcgaaaacccggacgactggcgaacgcccttcgtcaaatatctcaaagagggatggctgccagatgatgaagcaaaggcgaaacagttgcaaatcagatctacaaagtacagcttagtctctgggcaattgaaccgaaccgggatgctgtagcccatgcttcgctgtgtctccttttccgagggtgaagaaatgataagggaaatacaccaaggaatgtgtggagcacaccaagcagcaagaactgtcgcatcaaaagtatttcgccagggcatatattggccaaccgtactaaaagtatgtgttgagcaaatcaagaagtgcgaaagctgtcagaaacatggtcgaagccaagctgcacctcagtacgacttgcagccaatcgcgcccatctgtgtcgcgaccgagaaaatttgcattttcccgaacgctagtgtattaatccccgtcctaggaaaagccggggtacaccacacaaacatgatacaaaaggcacatctttattatgtcgataatatttacattattacaaaggcacataaggcctgacaatcaaaaataaacagcagcggactagcgggcctacggctccatcttcacaggcgctcaattggggtataagccaggactccacctaagacttcttctccaaagcttctcttactgaagggggaggtgtgtgtccaattccaccataagccaaccattccatactgtccaaatgatatgagaattcccaaagtctaaagttataaaaccacctaatgttgcataattaatcagcgaagcatctacctaaattcatactagtggaaccatgaatagggtacccactagttggggttttgtttatcctagggtgaacaaggtaataataacaatagcaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaactttggcttcaacctccacgtagagcggatcttccaaagctgcagcgtctacacgaccaacggaaaggaaaaaggcttttactctaataaactccatataacaagcaggaacaaagcacaaaaatgggttcttgacttcttaagggaaaattagagacttgaacggtccaattccgagttcaaatggccaagatatggccatttgaagtttatatgctctttaaatggatatttgcgaatttcttcatttaaattttaannnnnnnnnnnnnnnnnnnnnnnnnnnnnnnnnnnnnnnnnnnnnnnnnnn

SEQ ID NO: 61109 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnnnnnnnttggaaggcagcgtcggaggcccacggtgaccggcgacggcgaaggaaggtctagggttcagaggagagagatcgatctgaatcgaactcgaatccgcgaatttccaaacgaaattagccgacgattccataagagaaaagatagaggggattccgaagatcatttcccctctattgatttcaccggagaaggaaaggcgcgagcgaatttggaaggagatggcggcggcgcggcgctagggttcgggcggcgggcggccggaggaggacgacgagtccgacaggtggggcccacctgtcagcgggagagagagagaggagagcggcagctcggttgcgggccggcttgggccgaggagagagagaaaaagagagggggttttgggccgactttcggcccaaagcaaaaagagacttttaaaaacctttttcaatttaaattattcatgaaatgcaattccatttattcaaaatacttccttagctcaaataaatcccagaaaaatctaggaattatagaattaagcaaagtatttaatgaattttatctggccccattttatattggaatttattaattaaaattagatcttctcttctaggctttttaaaataaattctaataattccaattaaccaacaatttatatattttggatttttagggtgtgacattagaacatacagtggacgtcggcccacgcgcagatgtaaagcgta

SEQ ID NO: 61110 - DNA, 787 bp, Oryza sativa
acctcaaagttctttagagatcggcttcctgaaaagaatttccaagccaagcacgcttaacctcatatggttatcataggtcatagacgaagaagttgcaatatgagtattgtacccccagcttttataggttatagacaacaccggcttcagccaataggatgtagggctattacctatcatatcactcatgcgcactcgggaagaatttttaggccaagcacgcttaacctcaaagttctttagagatcggcttcctgaaaagaatttccaagccaagcacgcttagcctcatatggttatcataggtcatagacgaagaagttgcaatatgagtattgtacccccagcttttataggttatagactgccctcataaaccaacacaagtcttttctgcacattttgtcctcactcgtacgcactcgggaagaattttccgatcggtcacgcatccctaaattgctctaggccaagcacgcttaaccttagagttatttagagattggcttccggaaaagaagttgcaacttgttgatatgagtattctattaattatattaagccctaggccgggatgttacaccctggtaccgatgatccccataccatccaaatactgtagtcacgatctcaaacgtcgacagtgacgcgccaggtagggggattttggtgcttcaaggtttcgatgagatgggtttaagagatggattctccaacaacaagctactcaatgacttcaactatagggagatctaacccgaccggagtatgtcttccgacgaga

SEQ ID NO: 61111 - DNA, 770 bp, Oryza sativa
  unsure (1)..(770): unsure at all n locations
ttttcccggtcgcgacagattcacccctcagtcatcatccaagccattgggaaagatcacgcttcctgtgactttcggacaagggagcaacttcggaacagagcagatcacgtttgatgtcattgagtttgacatagcatacaatgccatcattgggagaactgcactcgcgaagttcatgcccgcatctcactatgcatatcaagtactcaagatgccgagccgaagggaacaatcactattcaagggaacgcaaagctggcgctccaattcgacaagtggagccttgacatggtcgagcacactcctagcccacccgccacagctgagccacccaagaaagtgagcaaaacaggttnngatgttgaaatcagatggtgcaattaaaattgtttcattttccagtgccaaccccaacaagacagtcaagattggggcatcactgaacaagaaataggaactcgcgttcatcaccttcctccgcgacaatgctgatgtgttcggttggccatatgagaagagcttgacaaacttttcaaagctggttttatcagagaggtactccatccagagtggatagccaacccagtcatggtgcggaaggccaacgggaagtggacgatgtgtgtcaacttcaccaacctcaacaatgcgtgccccaaggatcacttccccctccctcgaatagaccaactagtggactcaacagnnnnnnnnnnnnnnnnnnnnnnnnnnnnnnnnnnnnnnnnnnnnnnnnnnnnnnnnnnnnn

SEQ ID NO: 61112 - DNA, 2235 bp, Oryza sativa
catacccctcaccccatcctagccgtgacaaaaagtaccgacccacccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagcctgagcaccgagttaagccttacccattagacatgtggttagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataatccaacaattccatagtgtccaaatgatatgagaattcccaaagtctaaagttataaaaccacctaatgttgcctaattaatcagcgaagcatctacctaaattcatactagtggaaccacgaatagagtacccactagttggggttttatttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcagagagaacggccttccgaacctttggcgacgaccgcgaaccacgcttctggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaattaggttttgcaactataaaacatgtggaagcgctagcctggaaaagacaggaaggctgcgctgttgacatgcggaccccacatgtcaacctaaaggaccacggtagaccgagtacacagagacggtccacgggtcgacggaagcggaccccgtgtgtcaaccgaggcgaggggccaacaaacggactccactagacaccacacgggctgcacacgtggaaaccacgtggctaccgagcgggcacactaacacggtcaccacacgcacaagcgaacgactaccgacaccggtacacgggtaccggggtcgacaaccgcacaacgagcatgggcgacaccggaaggacgaggacggggcagcgagaggagagagatccttaccaccacgcgacgaggcgtgggaacgacaacgacgaacgggcgcggcggaggcggacggcgagggaacgacttcggcggcgatccttgaacgaaggcgagacacggccggcacgaggcttgacgacgcggaagcgaggacgacgaacgagaacggcttgacggagggacgaacgccacgacgatcgggaacgacgagaggacgaggacgacgacgaccggggccggcgagggggcgacgagggacagccagcagtggctgcacggagacggggacgacgtggaacacgccgctgcgatgacgatgacggaggcggcgccgcgagacgatgagccaggcgaccgatgggacgtcgatcggcgaggacgaacggtgacgaggaagcgacgatggcagccagcagcggctgcgcggaggaggggacggcgtggaacacgccgctgcgatgttggtgaaggtggtggtgcagcggggcgacgagccgacgaggaggaatgggtggttggcgcggcggcggcgttccggcgaacttcgggcgacgccgcagccgggccggagaagaggatggcactaccgcaccgacagaggtggcagcgacgtcggccggcgctcaggcgaggcggcagggatggctggagccggtggagtggtggcgacaccactagtcgtcggcgaggacgcgtctccggtgatttccccacgaaacggaggcgaagccgggaaagaggaggcag

SEQ ID NO: 61113 - DNA, 1045 bp, Oryza sativa
  unsure (1)..(1045): unsure at all n locations
nnnnnnnnnnnnnnnnnnnnnnnnnnnnnnnnnnnnnnnnnnnnnnnnnnnnnnnnnnnnnagccatgtgccatgacatctcgactatcgggccacagctcgtgtagccttcatttgtcctagagatgtccatcgacccccgacttcgtccatctccatccgtgtacctttgtttataaccagactgagccacaaactaagccttacccactagacatgtggaagtacggtagtgctttgcaacaaaagcccgagcttaatccttatagtacccgaggtacaactaacaaaacccaaccacacacctcgagcccagcctaaaaccgttttgggggttttgaaaagaaggggaggtgtgtgtccaattccaacataagccagccattccatactgtccaaatgatatgagaattctcaaagtctaaagttataaaaccacctaatgttgcataattaatcagcgaagcatctaccgaaattcatactagtggaaccatgaatagagtacccactagttggggttttgtttatcctagggtgaacaaggtaataatacaatagcaataataataaggtcataacaaaggtaaataggcatggctaaataaatcagtgataacgcgggaatttaaataaagcgacaatgcattaatttaaatcaaaataattttataaactgggattcaatatgctcaaggatgatgtgacttgccttgttcagagacaacggccttccgaaccttcagcgacgaccgcgacccacgcttcgagaacctccggaacgacagaagctacgcgaagcacacaagcaaagctacaagcctataaagaagccaataccattacattaaaaagaaagcgcagggttttttaggttatacaaacattaggagacttgaacgggtcgattcagagttggtatgaccaagacatggtcatcccgaagtttaatgatgttatatggagatttgcggattattatnnnnnnnnnnnnnnnnnnnnnnnnnnnnnnnnnnnnnnnnnnnnnnnnnnnnnnnnnnnnnnn

SEQ ID NO: 61114 - DNA, 2050 bp, Oryza sativa
  unsure (1)..(2050): unsure at all n locations
catatcataggtgtttagtctatcaattaggagaagccaagcaaacaccttaactttcatagaacactagaaaaaacgcgtggcaaaagccacgcatggtataatgagcttaggccattgggcctagtggggtaacaaatgagtatatacttccacttaattatgggcttattttctctgatgttttgggttttaaataaatttctatttcacattataaaatgtttggattttgaataaatttatagatggatcaatgtatgtgtattaaatgtttgaggttttgaataaatttatgtttcatagtataagatgttttgggttttaaataaatttataaatggatcaatatatgtgtttcatatatatgtcgaaatttatatgaacattagtgaatctagatgggagattgaagagcttaaaaatatccttgtgaagtttatgtccatattcattgtactacgatatgtcccatccagtacaggatgctatattttgagacggagagagtacaaggaaagtgaaaattaatcaaagctgtgcgtacaaaatagggaatacagactactgaatgtgccaattcatgcatcgatcatgcatcggatgtttgcattgatcagcatgcaccggatgtttgtatgctactcctacatcctacatatatggttaatatctcgtttcatccagcatcttcttgtgccattgcacggcctgctgagccatggtccatggacccaattgctcctcgatatattcgtgaagaagcttctggaagaaactccatccgatggctggtgcacgcacgcacgcaagagcaaatcgttgcacgcgcacacgcaagatcttttcgtcgagcctcttccgcgaaaccggtgctgccacgtggcaccattctctttgtgatcttttgcatcgaattcgtattataagatttgcttttccaaatccaacttaagtacccaggggcttggacatgcatgaagtttattgcatatattttctgagaagagaacagtccattaccccatacataagtccaaacatccttatcatcagataatagattcagggggtcagcttcactcatggattcatattgctggaaagcttgttcagataaaggcagagcaaaaagctgtgatatgcttttagtagaagttatgcttaccgagtccttgcgagagagtgcaaaagagtgaattctagggaacacagctgacctaactttaccattccaaaaatcatcccagaacaaaaaagtttttccatcacccactttacaatttgacggacttctgaaaatgtccacaaattgcaacacatccttccaccaaaaggaaccccttggatgaacaacatgtggtaatttatcagagttataagaggtctagatcaaatttacgcatgtaataggatgcctgttgtagaacttatgcaaatttttcatcaagagagcggcattctgaagattgagatcaataacacccaaaccacctgtattttttggttgacaaactctctcccaaagcactaaggatttcctactagaatttatgtcagatcccctccattggcaatgtctccttgctctatcaatactttcaatcacagattttgggagggagagggaacatatataataagtaggaagggaggaaagaactgaatttaccattgtgattctgtcaccataagacaatagagcagaggtagctgacagcctcctttcaattctatcaacaagaggtgcaaagtcaatcacctttggtctagtggttcccaaagggaggcccaaatatgtaaaaggtagtggtccaatagcacaaccaaacaaccctgaaagatgctgaactttttctggatccacattcaaaggaatcatgcaagatttactataattttttttgcggggagcaagatttactataattaacctttaaacctgtagaatcagcaaaggtgttgaggatagcctttagacaaaaannnnnnnnnnnnnnnnnnnnnnnnnnnnnnnnnnnnnnnnnnnnnnnnnnnnnnnnnnnnnnnn

SEQ ID NO: 61115 - DNA, 1505 bp, Oryza sativa
cagaggtagctgacagcctcctttcaattctatcaacaagaggtgcaaagtcaatcacctttggtctagtggttcccaaagggaggcccaaatatgtaaaaggtagtggtccaatagcacaaccaaacaaccctgaaagatgctgaactttttctggatccacattcaaaggaatcatgcaagatttactataattttttttgcggggagcaagatttactataattaacctttaaacctgtagaatcagcaaaggtgttgaggatagcctttagacaaaaaagttattttgaggaagctgtcaagaagagtaaagaatcatctacatattgtacaactggaaaatcattgtcaggtgttggaatgggaatagaaaggacccttgagaataggtcttattgattacagcctgcaaaagataagcaccaagcacaaataaaagaggggacaagggatccccttgcctcaccccccttgtgcaataaaaagatttccctgggacaccattaagcagcactgaagaggaagctgatgaaaagatcaagttaatccaactcaaacatttagagtcaaaacccatttgcttcataatattcaagataacagagtgttcaattgtgtcaaaagccttttcaaaatctagctttaagagcactatttccctctttgattgttgacactgatgcaggtattcaaaggaccaagcaagacaatcctgtatagttctgcctctaataaagccatactgattgtgatgaataagttctgtgaatactgattgcgacctatctgccagtacctactggtatttcttacaatcacagttaaaatccgcaagcgcatggatataccgatgtatcacttcccctacggagtattccaagggtatcgaatccaagggaacgtgtgcgatcagatcttcctctagttcaaccaaggacaccaagcaaatgataggccaggaaagagaggattcactagtaagaaatagtgtctagggaaagcttaactttaatcctaaggcaatacttcaggcactggcaacccgctgttcccagatgtcgctctactacgtaccccgacagggaggacttaagtgatttcgagggctgtcaccacctctacacctacctcaaacgtactgtgggatacacagcaattactggataacaattacctaaacaccacgtctaagaaattaatatctactttagtgtgtataactcaccaaagcaatcattatgcttttgttgattatagtgaacaataatcccgtatgctatttaggaactaaccaagagataattctcataagataaatctaaattactcaggaagaatattatattgaattcagagtaataaacagaataaaagaaataggagatgattaccgacaactccggaattcttccgacttcttatactctactttcttcctattctaatatacaatatagtatagtagagcttctataattcagctcaagcttggaaatgtgtga

SEQ ID NO: 61116 - DNA, 715 bp, Oryza sativa
cccataaccgcgggcacggctattcgaatagttttactctgatcagaggtgtaccactgtaccccaagacacagccccacatcatgtcaccatgtgcctcaataccaccacggtacctcggaaaggagctgtgatagtacccctcgcacaacacaatccaccacagcgcaccattcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaaataattaattaaccaatcacgattgaccatcgtgaactatcattaagccatcattaaataatagtgaatcataagttatcccaatagtgtgctaatgtttctaggcatggctaagcaatcatatctaatatctagctgaaccaatatatatagcccaactagtcaagttataatcacccaaggtatcaaggagtaaagtaatcaagaacaaaaaggctataacaaacaataagttaattccacccaatgacattcaaaaataaatgccatagttgaatagaa

SEQ ID NO: 61117 - DNA, 2889 bp, Oryza sativa
acgatcatcattttgctcaactgaatgtaccatcctttgatgcaagtatgcgatagcatggtgctttctatccttggtttgcccaagaacagctcccacagtaaaatcactagcattgcacatgatttcaaacggcagcgaccaatcagggggttggatgattggtgctgagatgagtgattccttaaagattttaaaggattttagacacttatcatcaaagtcaaacagagcatccttagctagcaaggcagttaggggtctagcgattttagagaaatcctttatgaaacgtctataaaaccccgcatgacccaagaagctacggactcccttgacattgacaggaggtgggagctatcgaattacttcgatttttgctctgtccacctcaactcccctttcgaagatttgacgtctcaggactattccttcacgaaccatgaagtggcacttttcccaattaagtaccaagtcctttttcctgacatccttgtaggaccctaagttctccagacaatgatcgaaagttttaccatagactgaaaaattgtccatgaagacttccatggtatcctcaatcatgtcggagaaaatagacgtcatgcatctttgatcatcgagatggatggggatttggtgataaccaaaatacccatcaaggaaacaaaagaaggaatggttcgctagccgctcaagcatttcatcaatgaaaggcagcggaaagtgatcttctaagtagccttgttgagtttcctatagtcaatacacatcctccatcccgtgacggttcgttgtgggatcaactcgttgtttgagttttcaacgaccgtcatgcctcccttcttaggcactacctgaacagggctaacccactcactatatggcacgggatagataatcccggcatataggagtttcaagacttcctttttgatgacctcccttatcgcattgtttagcctcctctgaggttccctagatggtgtacaagacgggtcgaagggaacgcgatgagtgcaaagggtcggactgatgccttttaagtcttggagggaatagctaaaagcaacacgatgcttttctaaaacagcgataagtcgggtcgtctccctctcagagagtttgtcacttataatgactggagactctgcatcactgttcagaaatgcatagcataggcctgaaggtaagggctttagctcaattggggctcatgacggctgatccatttttggcagatcaatcgtttctccagattcatccaccccttcattgaattcctcgatggattcatcgagattagactctggggcctcgaatggagaaatagccatcacttcctcaattggctcaggaacaggaagaggctccgtcaaagaattggttgattgcaatacagggacggaggtgacgatttttcctactttcaggttgaggacaccggtttcgggcacatttaagagtttctctatgggatgtcctatgagtatgtcaaaatcagagatatcaaacagatggaaatctaagatgacctcaacgctattgtaccgtatgggcacttcagagataatccctaaaccttcggtagtaggatttgtggagatttggaaggttttgatggttggtaccaacggtctgtcccctaaccaaggataccttttcttgaacttatctgcctgcctggcagaaaagctgaacttccactgaaaactccgaaggataaggcaagcattgtacactccactcagtgtgaactcattcaaccttggcaagcattaaatagaattgccactaggatgtaataatgggaatacatctacgtgcatgaatccagataacactacaacgtactaacatcactacgactattgtgtaaccaatatcaacatggctgttagcccaaaaccgggagacgttggcccaaccgggagaaaaccttgctacaccccaaaaagcttactcaagaggtgaggggctccccccacttttaagttggttcaactccccctagattagcaatgtgggactattcccaaaaatctcccccgtcacacattggtgccccttagccctgaccggccccacacacaggcacatacgggcctcacacccgcggtccactgaccggccccacacacgggcacgtacgggcctcacacccgcggtccactgggctttgggcttacaccgccctgagtgtgcacaagcactagagattgtgggtttggctctgataccacttgttagcccaaaaccgggagacgttggcccaaccgggagaaagccttgctacaccccaaaagctagctcaagaggtgaggggctccccccacttttaagttggttcaactcctcctagattagcaatgtgggactattcccaacaatggctagcaaaagaagaggaaaaaaacatatagttagcaaaaagacataaacacgcattatttttttagctacacaaagggaaataatttaccaatttcaacattcatagggtcaaatagatcaggtcacttgctataaatgctagtatcaccaagatccttgacatgtaacagataatcattatatgctttgtgcctcctgtgctagtgctaatttaaaaagagcatttgcaaatttcagatctcaaaccatgcgcctaccatacctgtaaaccctaacagagcctacatcataatgcggtcacaccctccatgatttcaataattgatcaaatccacccccaataattgctaaggcccggtttggaacatttgtatggttctaaaatttataataatatcaatattttaccagcacaatttcaagcctttttgtcagtatcagtagttcagtatgattgtccctaactctataagatacatatctaaaaatttagtt

SEQ ID NO: 61118 - DNA, 874 bp, Oryza sativa
  unsure (1)..(874): unsure at all n locations
nnnnnnnnnnnnnnnnnnnnnnnnnnnnnnnnnnnnnnnnnnnnnnnnnnnnnnnnnnnnnnttttgaacccgagtcagatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaatgtcagagaagaaattcctcccgaggtgcacaacagttgacagagcatcttttagctaatggaggtagagtgtctggtagtgaagattcagatcaagtctcctcagatgatgaagatgagaagtctccccaaggttttaaccagaatgaaatagaacttaaggcatgctctcgttgtggagaaatcggtcatgttgccagctcgtgtgcctctacatgcgttcattgtgaggaagaccatccacccgataggtgtccaatgagcaggatcacttgtttcttttgtgaaggaactgatcatgtaccaaaagattgtcgattcagttttctgctgacgaagaagatggccaaccaacccgtcagttccaacggagagaagcatcaaggaaacacaaatcctcgccaagattacagtttcagcctaactccagtgccaggacagaggaaacaaaatgagaaaagaaaatgccgagtccgggaagatatctgttgcttcaattgtcaaggaatgggtcattttgccgacaagtgccca

SEQ ID NO: 61119 - DNA, 775 bp, Oryza sativa
  unsure (1)..(775): unsure at all n locations
nnnnnnnnnnnnnnnnnnnnnnnnnnnnnnnnnnnnnnnnnnnnnnnnnnnnnnnnnnnnnnnnntctcggtatgatcagaaataacactagattcctcttattggcctttgtaggcactatattaggtttgtctaggttaatctccgatgtcgaccgagaagatacggaacatgcgactaagtctcccgtcttgttgtaatcgagaatttggattgaagtgaagaaattccatctcggcgggtataccatcgcttgattccatattccttgacaagccccatcaaccgttctcgagtaatcgagtaggcgtagagtctgcaacaaagccttgaaatctgacttgactattctaatgtctgactctcctaaaatcaatactcagaacatttgctgtactcgcttagtcgatctcggtgtagaaccatagagacacagagtcttcgacaatgttgaatagaattttcatgaaatcaacactcagaatagaatattaaatagaaatagccctcgagcgacactcaaagggtaacatgttataatacgtatggaaaaattgaaaataaacaaaatctgcgtgtgacaataaaagagtactctcgctagagttgccctcagcaaacggagtttggtacccttcctagcccccagctgtttttatggaaaaactattttccacaaagacagcttgaatcttataacaaatcatgctgaagctgacaaatcctagccccaaccatgaagttggaaaagtcaatttccattacacggcttgg

SEQ ID NO: 61120 - DNA, 1451 bp, Oryza sativa
  unsure (1)..(1451): unsure at all n locations
tcatcctcttcatcctggtcatccgatagacatccacggaggacatacgatcgctgataacccaccgcccccagtgccgggtgtagagctttcaaccgttccctacgtgatgtccgatgtcctgagagattccgacctggggcaatagagaagtacgatgggagtaccgacccagaagaattccttcaggtctactccacagtactatacgctgccggagcagatgacaatgcgttagcaaactatttgccgacagcgttgaaaggttctgcgcgttcgtggctgatgcacctcccgccctactcgatttcttcatgggcagatctgtggtagcaattcatcgctaacttccaaggaacttacaagcgccacgcgatctaagacgatctacacgcgttaacacagaatccgggtgaatctttgagggactatgttcggcgctttaatgagtgcagaaatacaatccccgaaatcacggacgcctctgtgattcgcgctttcaaaacctgtgtcagagatcgctatactacccaagagttggcaacaaggcgaagattgttcgaagtcatcgatcgatgcgctcacgcggacgacgcactaagacgcaagaacaacaagccaaagacggggggagagaagaagccagccaagggcacacctgaaccgagcaagaagaaaagcggcaagagtgggaaaaggaaagctcaagcggaagttcccgcgtcggaatacgaacgccctcccaaacacctagacccacaaggcagtgacacaaagagaatatggtgccccatatacaagtcggacagacattctctggaggattgcctcatcttcaaaaagtcgctggaaaagcaactggcattggaaaagggcaagcgagtacgtgtagtcgagaaagctgccgaggccaccactcaggactcgaactcagcatacccagattctgatcttcatgtctcgcacatcttcggaggttccaaggcgtactcctcaaagcgagaatacaagaaagtggagcgtgaaatttgttcgacatggcaggaggctgcacccaagatgaagtggtctgaacagaagatcgagttttcagatgaagaccaccccaaggctgctgttatccctaggacgatatccgatcgtggtcgaacccactattcggaatatcaaggaagcgtgagtctttattgatggcagcagctccatcaatctttttttcaccaacaccttggacgcaatggggaatccacgaagtaagttgaccccccccgatcaacccttttccggattttgtcacgtcctgataaattcatccggaaataaaaatcattttttaaaaggaataatggaattaattaaaaattcgaaaagaaattggccaaccctaaaannnnnnnnnnnnnnnnnnnnnnnnnnnnnnnnnnnnnnnnnnnnnnnnnnnnnnnnnnnnn

SEQ ID NO: 61121 - DNA, 1735 bp, Oryza sativa
  unsure (1)..(1735): unsure at all n locations
agtcagtgttttaattcttaaaatctgctcaacaattaaaatatggaatggtgggcctgggttggcttgggacgagctgggacacaggtcgggttgccagttcggtccgaatcatcgtaggccttgggttaaggcaggttcgtgagggttcacggccttgtttataatactgtgtagctctaggatcgtcttacaaaatggctctgggccattaagtgacttttaaatgctgttttctgcaaaacttaacccctatatattattaccccttgtacccccttgcattaatcatgcatctgccggtgtggctcgctgagtactgtggttgtactcattcttgctcaatcttttcccccttcagtaagagaagctttggagaagaagtcttaggtagagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaagctggtatcagagccatctcgactgtaggataagccaagtggataaaacctaaggacatattttatacataaaactatttccgaaagtccctttttcctcctttcccctgtgctatttgcaaaaggtttactcccttcttccttcttcagatttcaactagtactagttggttagttttgcgaagaagaagatgtcgccaattgttcgccgaaggtccggaagaccgcagggtccgctagcgaagtggaggaagcagtgaagccagctgtgaaggagtgaagatcttgggaactcgtcgcagaacctaagccaccctctagtgtttcgtttgtcgtgtgtttccttgcttgtgtgtgtagtgtgcggtttgcatcggtgggctgtgatgtgaccatgctaggttgtttgcttaatcaacttgcagaataagtgaaacaaacaacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaactccagttttcaactcaatccaccactggcctcaagagagttaaccagggcacacccttggtccattccaagcatgcggcttagttcacagctaccattggttggaagtcaagaccaaaataagtatgtgtttgatcgagcatttgccacccaggccaatgagcttcccatgccagaagagcatgtccccttttgtcatgattgtagagaacaaggacactatgccctgaattgtccatgggtatatgctaaagaagccccttcctttggtttagcagggcagacatcgctaagccagcctcctcgcaccaagtcaagcttgcagcctagtgtgcaaagcagagagcccaatgaagagaatccattgaatcccgggaattgctttcttcctagcctttcgtaccacgtggggtcacacactaagcaagccaaaggcaagaagagtaagaatcagaagagaannnnnnnnnnnnnnnnnnnnnnnnnnnnnnnnnnnnnnnnnnnnnnnnnnnnn

SEQ ID NO: 61122 - DNA, 790 bp, Oryza sativa
  unsure (1)..(790): unsure at all n locations
caatgggaaagaacacatcaaggttaaaggtgtaaaggaatacgttgaatgctaactgaggacaacctgaagataataatgggaagtaaactgaatgtaaagaaagtgaatccgagttgcttgttcgtgggagctattcccagttatgaaccaagtgatatgttcgaagatagtctacagaggtcagattaaaatcacatctaacaacgaagcttcaaatttggcaggataatgattagacaataacaaatccagcaataaagccatttgggaagacgtcaaagtatgtcaagtgggataagttggttctcttgagaaacataattcaaaggcaaagttatcgacccttgcatcgaatagcagaagtggctagcacccggagagcaggaaagttaatatgaggcagttggtggcaagttagaagtaaatgacaagcatggtattctcatgatgacaagcatggtatcttagtaatgacaagctagtgttgacgcatgacatgaagtggtaacttgtatgagggtgactccaaagatatgagttataagaagttctagaactgaagccccatcttccaatgccgcagcccagtcgaagtcagctagaggtgcaaccagggaaaagtcaggtgaagagaagattccatctataaccggagatcgagctaagcagtccagagtggagaagttttgctaggcaagtttgttataaaagacgcgacggaannnnnnnnnnnnnnnnnnnnnnnnnnnnnnnnnnnnnnnnnnnnnnnnnnnnnnnnnnnnnnnnn

SEQ ID NO: 61123 - DNA, 992 bp, Oryza sativa
tatttctttgtggtaatactgccatttcctggcggtctgtaaagcaaaccctggttgcaacgtcaaccaaccactcagaaataattgctctatatgaggccacacgagaatgtgtgtggcttaggcggatgatcggtcacatccagaagtcatgtggcctaaacattgataacacccccaccattatctatgaggataacgctgcttgtgttgcacaaatacatatgggctatgtgaaaagcaatttcacaaagcatattgttcccaaattcttttatccccacgagctccagaagagcggggaaataaatgtcctgcaaactaagtcatgtgaaaatctcgcagatttatttacgaagtctctgccagcctcaagtttccacagatgtgttcgtggcattggcatgagacgacttagtgaattgcaaggatcagggggagcaaagaatagcccatgattgtgatcctgaagaatcacaaacaagtcgtgaagacttgatcaactgttgtactctttttcccttggtgagtttttttccccattgggtttttctcacgcaaggtttttaacgaggcaacaggtgcaacacaatattcaaagtgccatgtactcttttctcctaccattttttcccactgggtttttgggaggagtttttgatgaggcatgcgcataattcaaactcgtctaagggggagtgttatgaaatctatcttattgtagacgaattaaattatgaatgggaaacttactacagaagaaagcttacgctgtaagctggaagccagcttacggcgcaagccagcttacaggagaagccagcttacagaggaagcccgcttacggcgtaagccggcttacgacgtaagccagaaggtccaaggcttacgacgtaagcctccaccctcctctgcctaaaaatagggcccagaaggtccaaggcgaggacaaccgatcttcggtctcctacttcttctcttgtagcttgtac

SEQ ID NO: 61124 - DNA, 714 bp, Oryza sativa
cccagcctaaacccattttgaggattttaatagagggggaggtgtgaatccatttccacaataatccgaccattccatagtgtccaggtgatatgaatattccaaagtttagagttgtaaaaccacctaatgttgcctatttaaccaacgaagcatctacctaaaatcatactagtggtaccgtgagtagagtgtccactagttggggtttgtttattctagggtgaacaaggaaataataacaataacaataataaggtcataacaaaggtaaataggcatggctagataaaacagtgataacgcgggaatttaaataaagcgataatgcagtaatttaatcaacataaatttataaactgggattcaatatgttcaaggatgatgtgacttgccttgctcgctttcccaaccgtcggcttcaacttccacgaagagcggatcttccgaagctgcagcgtctacacgaccaacggaaaagaaaaggcttttactctaataaactccatataacaagcagcaacaaagcacaaaaatgggttcttgatttcttaaggaaaaattagagacttgaacggtccaattccgaattcaaatggccaagttatggctatttgaagtttatatgctctttaagtgaatatttgcgaatttcttcatttaaattttaatttaaaaaaaaagtttattgcgggtaccgagctcgaattcgcc

SEQ ID NO: 61125 - DNA, 1263 bp, Oryza sativa
  unsure (1)..(1263): unsure at all n locations
nnnnnnnnnnnnnnnnnnnnnnnnnnnnnnnnnnnnnnnnnnnnnnnnnnnnnnnnnnnnnnacggaggttcgtaaggacctccagaaaatgaaggagctggtggccggcaacgagcggcaatggcaggggctcaagaaccgcatgtcggaactcgagaacaacctgtcggaaatccgcggttcgctgtgggtcacctacaccggcctacaccagctcgtcggggagtgtggtgttaagaccaccatcccggcgaaccctgacgagttctcgctgacggcttcgctcgcggagctggcgacggcgatggaggcgatcccctccaagcatgcggccaggatcttacatggtctttcgtctctaaaggatccgacaaggccttatcagctctaggcgtctccagcagaagttccttaggttccttggagggcttgtcaagacggcgtaaagagacatgaggatcagtttcaacactaggtgtgatctgggtgagggatcatcgggaagggacactttgattgaaatctgtacctgaagacaggctttattgaagtcgtaagatgtcttacaagtatggatactattgacttatacatagaatttacgcaattggtcaatgttccaagaattttctaactcgcgaccatcaccgtctgcaatcttgaatgcgcctggccacaagacttgtgtgatcgtgtacggtccttcccatttgggtgagagttgtttcgccctgcttggctttgaactcgccggaggacgtagtcgccgatcgaaagtatgcgtgctcggatgcgcttctcgtgataccggcgaaaggcttgttggtaactagctgccctgacggcaactcattctcgaagttcctcgantangttcacatcatcgttgtactattccttctaatcctcgccggactacttnnnnctcgtgtactctggtgttgtagctcggtagggagcatggcttctgagccgtacacaagaaagaagggtgtctccttgttggacgttatcggtgtggtgcgcacggcccagagtaccgaggggagttcttcgacccacttctttcatgtgacatgagcttgtcgtagacacgggtcttgatcccgtgtagtactatgccgtttgctctctcgacttgtccgttgctctgagggtgagaaaccgaggcgaagccgatcttgaagtccagtcatccagtgcagtaattctggaaatcggcgctgatgaactgggaaccgttatctgttatgatgcgggga

SEQ ID NO: 61126 - DNA, 3742 bp, Oryza sativa
gggttttaaggtttttctttttataaaactttgataaaggttgttgttgcttaataaataattccgttgctctgaaaattcaagtaaaatttgagggctccttttagaccaaggagaatttaacaaaaatttaaattctccggaccacattcgaatttttcttgtacgtattttagtgtttgccaatttatttttgaattttaattaattccattattccttttagagaatgatttttatttcgggatgaatttatcaggacgtgacaaatccaccgcccttacaggaatctcgtccccgagattcgagaacgctagcaagaatataggttgggatgtcttctcttctggactgacttcttccgctccgtcttctataacaaacttgcgtaacaaaacttctccgctctggagtgcttggctcgatctcctgttataaatggaatcttctcttcacctgacttttccctggttgcacctctagctgactttgactgggctgcggcattggaagatggggcttcagttccagaacttcttataattcatatctttggagtcaacctcatacaagttaccacttcatgtcatgcgtcaacactagcttttcattactaggataccatgtttgtcatcataagaatatcatgcttgtcatttacttctaacatgccaccaactgcctcatattagctttcctggtctccgggtgctagctacatctgctatttgatgcaagggtcgataactttgcctttgaattatgtttctcaacagaaccaacttatcccacttgacatgctttgacgtcttcccaaatggctttactgctggacttcttattgtttgatcgttatcctgccaaatctgaagcttcgttgttagatgtaattttaatgtgacctctatagactatcttcgaacatatcacttggttcataactgggaatagctcccacgaacaagcaactcggattcactttctttatgttcagtttactttccactattctcttcatgttgtcatcatttagcattcaacgtattcctttacaccttcgaccttgatgagttccttcccattggatcatcttccaagacatggcattgcctggtaaccggtgcctgcacttttcactccatgtagcatctgatccatagcatgttgatcccgtttaaagctattgtttctattcaactattgcatttattttcgaatgtcattgggtggaattaacctattgtttgttatagcccttttgttcttgattactttattccttgatgccttgggttattataacttgactaattgggctttatatattggttcagctagatattagatatgattgcttagccatgcttagaaacattagcacactattgggataacttatgactcactattatttaatgatggcttaatgatagctcatgatggttaatgatgattggttaattaattaatttgccaactaaaacctgataatggtgggttgtgagcacatggttttgatggtcgtgctcatgacaattaaggaccggttcacgagtttcggttgtgaaacattaaccgtgccaaccacaagccagcgtgggtaacgactttaccttttgtatagcatggttcattgcggagcaccaaactaagaagtggcggagataagcccacgggggtcgctggggagtccatgccttgtatataagggggtgattattgtcacgtcccaaaacgactttaaaatacatcctttaaatgatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtcccttttccctccctctccctcttgggccggctcggcccatctccctccccctccctctcctctccccgcggcccatccggcctctccccgcgcgtgcgccgctgacgggcgggcccgcctgccaccctactgacgggtggggcccacccgtcatccccttcctcccgccgctcccgccgcctcgcccacgccctagcgccaccgccgccgcgaatcccgccgcccccgtcctccccgcgtgcaatcaataggggggaattatttccagtgattccctccccctttccccccaattttccctccctctctcccttggattcgtttggaaaccctcccctaatcccgccggcgccattgatggagcccgagagcgccgcgccggtttccttcccctccggctgccctctcccccttccaaccctatataaaccctccccgcacctcctccgttcgtttccgcctctcgccgcccttcctcctcgccggaatggagcttgcgccgtcgctctctctctccgccgtcgccgccgagctccggtccgccaccgtcgtcgccccggaccacctcccacctcggcgccgcctccttcggcttcgccgcatcctcgccgacctcgtccacccctccgtttcgctcgtcgaccgccggagcgcccccgtccccgtcgacccgagccgcgccgccgccttcctccgctccggccgccttttcgtcatcgccgtcgacctagggtgagctgtggaccgccgcctcgtttccccctttccctcccttctctcggccgccgctccgatgtgcccatggccgccgccggcgaacattgggacgcgggcgcgccgcctaccgccggccgcgccgacgtggccgccttcgggcgcaccgagcggctgccgcgtggggcccggccgtcagccgcccgcgccctcgggtgcggctgacgcgtgggacccacggcgccggccggtgtgagcccgagtgcacccggtccaccgtggaccgtgaggctgccgcgtgggccccactcctgtggacccggtccgcgcgccccctcccctcgactgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcctttcttttccattggtcgtgtagacgctgcagcttcggaagatccgctcttcgtggaagttgaagccgacgtttgggaaagcgagcaaggcaagtcacatcatccttgaacatatttgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatggttttataaaaagaaaagctctaaaaagtctttttccccccccccttccccctcttgggccggctcggcccatctccctccctctctgtcctcctccccgcggcccactcggcctttccccgcgcgcgcgccttgactggcgggcccgccc

SEQ ID NO: 61127 - DNA, 4344 bp, Oryza sativa
  unsure (1)..(4344): unsure at all n locations
gataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatggttttataaaaagaaaagctctaaaaagtctttttccccccccttccccctcttgggccggctcggcccatctccctccctctctctcctcctccccgcggcccactcggcctctccccgcgcgcgcgccgctgacgggcgggcccgcccgccaccctcgctgacgggtggggcccacctgtcatccctatcctcccgccgctcccaccgcctcgcccgtgacctagcgccgccgccgccgcgaatcccgccgcctcccgccgtccccgcgcgcaataaagagggggaaatcactccccgtgattccctctctctttccccccatttttccctccctctctccctcggattcggttggaaaccgctcccctaatctcgccggcgccattgatggcggccgacctcccgcgccggtttcctcccttccccggccaccctctctcgcactggctctatttaaaccctccccgcacctcctccgtccggttccgcctctcgccgcccttcctcctcgccggatttgagctcgcgacgtcgctctctctctccgccgtcgccgccgagctccggtccgccgccgtcgtcaccccggaccgcctcccgcctcggcgtcgcctccttcggcttcgccgcgtcctcgccgacctcgtccacccttccgtttcgcccgccgaccgccggaacgccgccgtcctcgtcgacccgagccgcgccgccgccttcctccgctccggtcgccgttcccgtcgtcgccgtcgacccggggtgagccgtggaccgcccatttcgtttcccccttccctcccctctctcgggcgccgctccgccgcgccggtggtcgccggcggcgaccatcggggcgcgggcgcgccgcctcccgtcggctgtgccggcgaggccgccttcgggcgcgccccgcggctgccatgtggggcccggccgtcagccgcccgcgccttcgggtgcggctgacgcgtgggacccacggcgccggccggcgtaagccgcgtgcacccggtccatcgtggaccgagaggctgccgcgtgggccccactcccgtggacccggtccgcgcgcccctcccctcggctgacgcaataaatccgattttaaattaaaatttaaatgaagaaattcgtaaatatccatttaaagagcatataaacttcaaatggccataacttggccatttgaactcggaattggaccgttcaagtatctaatttttccttaagaagccaagaactcatttttgtgctttgtttctgcttgttatatggagtttagtagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccttagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcatgtcttccgtctgtataccgtggtggtatgtggcacgtggttgcacatgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggctcgtgcgggttcacgaccctgattaataatactgtgtagctctaggatcgtctttttaaaatggctttgggcaactaagtgacttttaaatgctgttttctgcaaaacttaacccctatatattattaccccttgtacccccttgcattaatcatgcatctgccggtgtggctcgctgagtactgtggttgtactcattcttgctcaatcttttcccccttcagtaagagaagctttggagaagaagtcttaggtagagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaatattgaatcccagtttacagaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgggaaattggattcacacctccccctctattcaaaatcctcaaaatggttttaggctgggctcgggtgtatggttttgatagtagcacctcggccatataaggaccggtcttcgggcctctgttgcaaagtactacggtacttccacatgtctagtgggtaaggcttagtttatggctcagtctggttataaacaaaagtacacggatggagatggacgaagtcgggggtcgatggacatctctaggacaaatgaaggctacacgagctacggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgactaataatattgtatagctctggaatcgtgtttacaaaatagctttgagcaactaagtgtcttttaatgctgttnnnnnnnnnnnnnnnnnnnnnnnnnnnnnnnnnnnnnnnnnnnnnnnnnnnnnnnnnnnnnn

SEQ ID NO: 61128 - DNA, 1830 bp, Oryza sativa
ccaatgagcttcccatgccagaagagcatgtccccttttgtcatgattgtagagaacaaggacactatgccctgaattgtccatgggtatatgctaaagaagccccttcctttggtttagcagggcagacatcgctaagccagcctcctcgcaccaagtcaagcttgcagcctagtgtgcaaagcagagagcccaatgaagagaatccattgaatcccgggaattgctttcttcctagcctttcgtaccacgtggggtcacacactaagcaagccaaaggcaagaagagtaagaatcagaagagaaaagcgccgatgcgaactgaagaagaagtacgtaagatgactattaccagcaccgaatggcctccagcagggataactattcctagacgtcaaagaggaaataccttccgaggtgcacgacagttgacccagcacctcctaagccatggtggcagagtatatgatagtgaagggtcagatcaagtctcctcggattatgaagatgagtctccccgacatctcggtgaggaagagatggaatcaaaagcatgcaaccgttgtggagaaattggacacattgctagcatgtgtctcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagttagctccaacagcaacatcgacaatatcatccacagcaccaatgctcctcctgctgcacctgactctgcaataaatcatagcaataataccttcagcaccaaccattctctgcaccgatagcctcagcaaagaattgtcatcgatggaagaagctgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctatcacatcatcacagaaccaatcaaggatgcagtcactagaacaatgccagctatacctctccagaatcagaatgagtagccatgtttgtggttttcagttcgctacttatcattgtgtaatcgggagtttgcagcaatcatgtaataaataaatacattcatgattataaacaatgagtttgttatgtttatggatgattcatgttgaggatgcaatgtaccgatgttaagcaccttccctttttgtttaaggcaaggccttgtattcatgtaataagggagacatgtgtaataaaaacaagttctatgaggattatttcggaagatgctgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtcttttttggatcaaaggcaacaaccgccagtctagtttttgacaaaccacatcaaggtttcactgaaaggcagcaagccaaaggacctcatcgtccccagaagcgtccgcaatccacattaaagaataccagctgttagagataagccgaaagaagattgataaaagagattggcaaagatgttctctagcatgaaagaagtaggccgaaaggtgattgataaacagaaacatgctctgcatcgctcaaggaagacccctgattg

SEQ ID NO: 61129 - DNA, 1535 bp, Oryza sativa
  unsure (1)..(1535): unsure at all n locations
nnnnnnnnnnnnnnnnnnnnnnnnnnnnnnnnnnnnnnnnnnnnnnnnagtttcagatgtgtcttttttggatcaaaggcaacaaccgccagtctagtttttgacaaaccacatcaaggtttcactgaaaggcagcaagccaaaggacctcatcgtccccagaagcgtccgcaatccacattaaagaataccagctgttagagataagccgaaagaagattgataaaagagattggcaaagatgttctctagcatgaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaagagtgaaatcttcaactcggtatcagatgctacacggagtgaaaagtgcaagcaccggttaccaggcaatgccatgtcttgggagatgatccaatgggaaagaacacatcaaggttaaaggtgtaaaggaatacgttgaatgctaactgaggacaacctgaagataataatgggaagtaaactgaatgtaaagaaagtgaatccgagttgcttgttcgtgggagctattcccagttatgaaccaagtgatatgttcgaagatagtctacagaggtcagattaaaatcacatctaacaacgaagcttcaaatttggcaggataatgattagacaataacaaatccagcaataaagccatttgggaagacgtcaaagtatgtcaagtgggataagttggttctcttgagaaacataattcaaaggcaaagttatcgacccttgcatcgaatagcagaagtggctagcacccggagagcaggaaagttaatatgaggcagttggtggcaagttagaagtaaatgacaagcatggtattctcatgatgacaagcatggtatcttagtaatgacaagctagtgttgacgcatgacatgaagtggtaacttgtatgagggtgactccaaagatatgagttataagaagttctagaactgaagccccatcttccaatgccgcagcccagtcgaagtcagctagaggtgcaaccagggaaaagtcaggtgaagagaagattccatctataaccggagatcgagctaagcagtccagagtggagaagttttgctaggcaagtttgttataaaagacgcgacggaagaagtcagacaagaagagaagaccgcccaacctatcttcttgctagcctcctcgaatctcggggacgagattcttgtaaggggggtggatttgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaatttnnnnnnnnnnnnnnnnnnnnnnnnnnnnnnnnnnnnnnn

SEQ ID NO: 61130 - DNA, 1370 bp, Oryza sativa
  unsure (1)..(1370): unsure at all n locations
acttcagactttgagaattctcatatcatttggacagtatggaatggctggcttatgttggaattggacacacacctccccttcttttcaaaacccccaaaacggttttaggctgggctcgaggtgcgtggttgggttttgttagtcgtacctcgggtactataaggattaagctcgggcctctgttgcaaagcactaccgtacttccacatgtctagtgggtcaggcttagtttgtggctcaatctggttataaacaaaagtacacggatggagatggacgaagtcgagggtcgatggacatctctaggacaaatgaaggctacacgagctgcggcccggtagtcgagatgtcatggcacagggctggtgtcctgctgctaggggctcaatcctgcctgcctgtcccagaggttccggccgtaggcggggttgggtcggtactcttgtctagggctaggatgggttggaaactatgtcacgtcttccatccgtataccgtggtggtatgtggcacgtggttacacgtgaggaagatgtgtcttgtgggtaaagatgtacacctctgatcagagtataacctattcgaatagccgcgccctcggttatgggcatgcctagcaatgtacccaagttagcgttttaattcttaaaacctgcttaacaactaaaatgtggaatggttggcctgggttggcttggaacgagctgggacccagggtcgggttacaagttcggtctgaatcatcgtaggccttgggttaaggcaggttcttgtgggttcacggccttgactaataatattgtatagctctggaatcgtgtttacaaaatagctttgagcactaagtgtcttttaatgctgtttactgcaaaccttaaccctttatattataacccccttgtactcccttgcatttatcctgcacttgtgggtgtgtcttgttgagtacggtggttgtactcagtcttgctcaatttttcccaaacccagaagagaagcccctgaaagatgaaggctttggtgtctagctcgtgcctgccgtcaaagcgcttgtggtcgtcgcccctagtctttccgctgttttcccgtttgtcttttgtgtgtggtgggcctttgccggccatgttattaatttaatattttacgtttccactttattaacttttaaaaggaatcaacttttggtggaccttgccttcttggacaaagaaataatacacgcacgtaagaaaggccggttgggttaattcgggtggtgacaggatttataccaatagagtggttcttaataaaatttgaaatttannnnnnnnnnnnnnnnnnnnnnnnnnnnnnnnnnnnnnnnnnnnnnnnnnnnnnnnnnnnnn

SEQ ID NO: 61131 - DNA, 849 bp, Oryza sativa
  unsure (1)..(849): unsure at all n locations
nnnnnnnnnnnnnnnnnnnnnnnnnnnnnnnnnnnnnnnnnnnnnnnnnnnnnnnnnnnnnncttcggaatcccctctatcttttctcttatggaatcggcggctaatttcgtttggaaaattcgcggattcgagttcgattcagatcgatctctctcctctgaaccctagaaccttccttcgccgtcgccggtcaccgtgggcctccgacgctgccttccaacccctttaaaaggacccccaagtccgccgctacccgtcgccacccttgccttcgtctctcgtcgtccgtagcgccctagccccgtgagacctcgcgccgccgtcgtcgccgccgctccagccgtgcgccgccgtcgctccagtcgtcgtcgtcgctcgggaaggtcgccatcgtggtcgccgtcgcgtcgccgtcctcgtccgcccctccgccgttgctgtcgaccgccggaacaccgccgtcgtcgtcaagccgaaggtcgccgccgcttcttcctcgacgccgtcgccgtccgttgatcttccgtcgccgttttggtcaccggtgagtttgccgtgccgtccgctacccgtaggtgctctccgttcgcgccgccacgccgtcgttcgccggtgagcatgcgcgcccgagccgccgccggtggtgacgtcgtcgctgacgtcatcgtcgtcgtctctcgtggtctggccgtggaccgttcgatctcggccgtccgttttggataggatcgatctcggccgttcgtttccgtgagccgccgccgtgcacccggtccaccgcaaaccctagccgctgacgcaataattcctttttcctgttcaaaaataattcattattgcgtcata

SEQ ID NO: 61132 - DNA, 1240 bp, Oryza sativa
agccggcgccgaggaaagagaaggaggaggcggggagaggtggtgtggccacaggggagctcgggaaggggctaaaacgagagaacgtagcgagggggttccattttataggcaaagggaaggagccggccatgggaggagcggggaacggcggcggaaaactcggccggcggccatggaaggtggccggggttggcgcgtccgttcccggcgatttaaggcgctattcaaggggaaaattaggggcaattgaagaggaaggaatggggattaaaaccccctaatcaatttcggaaaccccggtttgaatcgtgtggattttggggaggattggcactagggtttgcatgggagagagaaaggaaggaggccgggcgggaggacgacgacgacccgggggtgggacccatgcgggcgcgccgtcagtgcacgcacgtgcgcggcacgggcgggagggcgccgctctgcttgggcccggaggcggcccaggaagagaggagggagaggcaggcctgggagagagaggggaggggagggagctgggccgggagggggagggaagaggtgggccgggaggaggtggagaggcccgggagaggagggaaagagagggaggagagggtgactttgggctgggcttggcccaaaggaggaaggaggatttatttttagctttttctttttaataaactttgttaattgttgttgttttttaataaataattccgttgctctgaaaattcaagtaaaatttgagggctccttttagaccaaggagaatttatcaaaaattctccggaccacattcgaatttttcttgtacgtattttagtgtttgccaatttcttttcgaattttaattaattctattattccttttagaaaatggtttttatttcgggatgaatttatcaggacgtgacaaatccaccccccttacaggaatctcgtccccgagattcgaggaggctagcaagaaaataggttgggcggtcttctcttcttgcctgacttcttccgctccgtcttctataacaaacttgcctagcacaacttctccactctggactgcttggctcgatctcctgttgcagatggaatcttctcttcacttgacttgtccctggttgaacctttagttgacttcgactgggttgcggcacttgaagatggggcttcagatccagaacttctcatagttcatatctttggcgccaacctcatacaagttacccacttc

SEQ ID NO: 61133 - DNA, 4030 bp, Oryza sativa
  unsure (1)..(4030): unsure at all n locations
aggcccgggaaaggagggaaagagagggaggagagggtgactttgggctgggcttggcccaaaggaggaaggaggatttatttttagctttttctttttaataaactttgttaatggttgttgttttttaataaataattccgttgctctgaaaattcaagtaaaatttgagggctccttttagaccaaggagaatttaacaaaaattctccggaccacattcgaatttttcttgtacgtattttagtgtttgccaatttcttttcgaattttaattaattctattattccttttagaaaatggtttttatttcgggatgaatttatcaggacgtgacaaatccaccccccttacaggaatctcgtccccgagattcgaggaggctagcaagaaaataggttgggcggtcttctcttcttgcctgacttcttccgctccgtcttctataacaaacttgcctagcacaacttctccactctggactgcttggctcgatctcctgttgcagatggaatcttctcttcacttgacttgtccctggttgaacctttagttgacttcgactgggttgcggcacttgaagatggggcttcagatccagaacttctcatagttcatatctttggcgccaacctcatacaagttacccacttcacgttatgcgtcgatatcagcttgtcattactaggataccatgcttggcgcttccttccagcttaccaccaaatgcttcagactaagatatcccacttaccaaggataccatgtttgacgacttgccactaactgcatcatattagctttcctggtctccgggtgctagttacttctactattcgatgcaagggtcgataactttgcctttgaattatgtttctcaacagaaccaacttatcccacttgacatgctttgacgtctccccaaatggctttactgctggacttcttattgtctgatcgttatcctgccaaatctgaagcttcgttgttagatgtgattttaatctgacctctgtagactatcttcgatcatatcacttggttcataactgggaatagctcccacgaacaagcagctcggattcactttctttacattcagtttacttcccactattatcttcaggtggtcattatttagcattcaacgtattcctttacaccttcgaccttgatgagttccttcccattggatcatcttccaagacatggcattgccttgtaaccggtgcctgcacttttcactccgtgtagcatctgataccgagttgaagatttcactccttgccttcatagaaacacttttacctaggtcatcttgcttactcacgatttttttttctctcaatgacaaggtgactgttgcagggcgattactgtcaggagtcttccttgtgtgatgcagagcatgtttctgatgatcctttatcaatcacctttcggcctacatctttcctgctagagaacatcttggccaacctcttttatcaatcatctttcggcctatctctaacaggtggtactctttaatgtgggttgcggacacttctggtggcgatgaggtcctttggtctgctgcctttcagtgaaaccttgaagtgtttcgccaaaagctatactgactgtcattgcctttgatccgaaaaagacacatctgaaactcttagtccaaacaaatgtctctttggttaatcgcttgattttcttttccatcatcaggttggttattaactcgaggttagaacatagttcctctgaaatgagaccctaggtctcctttgacagtaaacaattatacgcataatcccatatcagcatcttccgaaagagtcctcatagaacttgttgcattacacatttctccctcattacatgaatactaagcattgcctaaaaggaaaggtgcttagcatcggtacattgcatccttaacatgaatcatccataaacatagcaaactcactgtttataaacatgaatatatttatttattacatgattgctgcaaactcccgattacagtgataggtagcgaattgaaaatcacaaacatggctactcattctgattctggagagatatagctagcattgttctagtggctacatcatccttgattggttctgtgatgatgtgataggactgcatattgctatcattcacgagagaaacttccttctgattgctggttgaagcggatgacggtcttctgcttggtatcgccctcctgaggttgattgccctttgctcggcctggagtaggtcggggagagacacaacttcttccatgcatgacaattctttgctgaggctgtcggtgcagagaatggttggtgctgaaggtattattgctatgatttattgcagagtcaggtggagcaggaggagcattggtgctgtggatgatatcgtcgatgttgctgttggagctgactagctgatgagacaatcgtagggttgttcgttggatttctgcggtcttggtcaacaacacactgagttggcaatccttgggcacatggtttgtaccttcgcatagaaaacatgcgaccttgcgggtgggacactcccctggtggatggtcttcttcacaatgagggcagactgtgagacacatgctagcaacgtgtccaatttctccacaatgggtgcatgcctttgattccatctcttcctcgccgagatgtcggggagactcatcttcatcatccgaggagacttgatctgacccttcactatcagatactctgccaccatggcttaggaggtgctgggtcaattgtcgtgcacctcggaaggtatttcctctttgacgtctaggaatagttatccctactggagtccattcggtgctggtaatagttatcttacgtacttcttcagttcgcatcggtgcttttctcttctgagtcttactcttcttgcctttggcttgcttagtacgtgaccccacgtggtacgaaaggctaggaggaaagcatttccggggattcaatggattctctccattgggctctctactttgcacactaggctgcaagcttgacttggtgcgagaaggctggtttagcgatgtctgccctgctaaaccaaaggaagggtcttctttggcatatacccatggacaattcagggcatagtgtccttgttctctacaatcatgacaaatggggacatcctcttctggcattggaagctcattgacctagggggcaaatgctcgatcaaacacatactgattttggtcttgacttcgaaccaatggtagctgtgaactaagcagcatgcttggaatggaccaagggtctgcccttgttaactctcttgaggccagtggtggattgagttgaaaacttgagttactagaggcatacccgctgacattctttcctttttctctattaaacatctattacagggattgaggtgagagaggaaacaagccaggaaagaatagaccagaactagagacaggtccttaaaggaactaactcttcttgttgatgtgttgtttgcttcacttattctgcaagttgattaagcaaacaacttagcatggttacatcacaacccaccgatgcaaaccacgcgctacacacacaagcaaggaaacacatgacaaacgaaacactagagggtggcttaggttctgcgacgggttctccaagatcttcactgcttcttccactttgctaacaaacacaacagccttctggagcttcggcagacaactgacgatttcttcttcttcgctaagttgaccatctagtactagttgaaatccgaagaaggaagaagggagtaaaccttttgcaaatagcattaggggaaggagaaaaaaaaggaactttcgcatagttttatttataaaatatgcccttaggttttatccatnnnnnnnnnnnnnnnnnnnnnnnnnnnnnnnnnnnnntcgcgaccgagaaaaatattaatcccgaacgctagtgtattnnnnnnnnnnnnnnnnnnnnnnnnnnnnnnnnnnnnnnnnnnnnnnnnnnnnnnnnn

SEQ ID NO: 61134 - DNA, 894 bp, Oryza sativa
agtcgaaaaaaacaatacttcctccgacacagaatataggcagtttttaggtgggcacgaatattaagaaagtagatcgagatgattggaggagggttgtgattggtggagaggagaaagtaggtgaaaagaatgtttgtgattggttgagaagagagggtatttggagaaataacttcattttaggacaagttattgcgctagaaatagctacattttggaactgaggtagtaccgcagcattcagatacccagtacgtggacagtagtagtcagtagtaccacgaaatggcactagtggttaaaatgacccggaccctacctgactgttgcacggctgtgcgcctcccaaacaacctcacagtttcaataacagcacgcaaatctggataggcgggtccaacacaatcatcattgtactaacctttacatgtatcagcaatgaaaataggaacagtacgatagtacctgcaaaatataaccaactagctgtacagtagcggacactcagtcacgcagtagcacggaacataggcaaggacaaagcaccaagcgggccgtcgagcagagagataagataaataaagctacgattgttgattggcttgtggtgagtatgttaccgtcggggaaaagaggccgggggagcccccgaggaacgcggtggggctgagtccgtgcggcaccgggaacggtgagggcggaccgggggcggaggcggcggggtagcccatggcgccgacgaggagctgggtgaaagagccctggaaggccggggagggcgcgtcggggaagagcgaggcggcgagagtgagcgcgccggggctggactcggcggagaagagggaaccggccgcggatcgcgggggcagcgagagcgtggggagcagcggc

SEQ ID NO: 61135 - DNA, 1261 bp, Oryza sativa
gttgtgtatattataataaaaatataaggtcaaatatacattttgtagattgtgtcattgtccaaaagttaattaaaatgaaaccggagggagtaagactttctagtattgcctagattcattaacatctatatgaatgtgtgcaatgctagaaagtcttataacctgaaacggatgaagtaggattcagttgtcatgttcccttatagaaacccagttgaatactacccagcactccttccgtcccattttaagtgtagccatggttttccgggcccaattttgatcgtccgtcttatttaaaattttttttaaaaatttaaaaacataagtcacaagtaaagtattgttcatgtttttatcatctcataacaacaaaaatactaattataaaaaattttcaaataagacggatgttcaaagttgggcacagaaactcatggttgcacttaaaatgggacagagggagtaatagattaggaaagtgataccggctctgactagatttttctctttgtaaccttgccaccaacacacataaggtgggcagggagacctccatggacataagcacaatcagatcattagatcaatacaacacctggcacggatgacatctgtaagtgtcatggatatcacgtacccaataataatcgattcagctcggcggtgcctaccacataccatgtcttatatgaaaaaaaacttcgtatataaaagagttccggataaggaaggatgagtagagttctatacggaaacgacaaggactacttgaattgtatccatattggtctccctggttcaagcacgcttaacctcaaagttctttagagatcggcttcctgaaaagaatttccaagccaagcacgcttaacctcatatggttatcataggtcatagacgaagaagttgcaatatgagtattgtacccccagcttttataggttatagacaacaccggcttcagccaataggatgtagggctattacctatcatatcactcatgcgcactcgggaagaatttttaggccaagcacgcttaacctcaaagttctttagagatcggcttcctgaaaagaatttccaagccaagcacgcttagcctcatatggttatcataggtcatagacgaagaagttgcaatatgagtattgtacccccagcttttataggttatagactgccctcataaaccaacacaagtcttttctgcacattttgtcctcactcgtacgcactcgggaagaattttccgat

SEQ ID NO: 61136 - DNA, 6540 bp, Oryza sativa
  unsure (1)..(6540): unsure at all n locations
gattttggtgcttcaagggttcgatgaaatgggtttaagaaatggattcttccaacaacaagctactcaatgacttcaactatagggagatctaacccgaccggagtatgtcttccgacgagatcggaacactatcaccgccacgggcaacaatggtccaatattgttgaccggaggacttcggcctgatcaactacttccgagctgctcaacgaatctgattccatcatggcggcgccccttgtttctgtcaatttgccctctatttggtcgtacttaaccaaagacggcaggtggcaaaatttcatgggaggccgactagcgtgggcatcagatgaatcaggagctcagattaaactacttcacatgcatcatctcgacgcgggcagtctccagcaggagttctaccgatgacgggacatattgatttttcaaagcaagtcagtgcagccgagaagatcttgtacgtgtacatgagtggctagaggagaatatttattaatctacaggcctactgcatgtatacaccatcaaccaaggtaactggtatattgattttttaagtcaatctactaacttcgtagatatatctgtaaaggtacgtaatattttatacaacttaccgtaccaattctttagatcaatacaaattgttagatctataatttattatatttaactagagcatgttttctatataatatttattgtgcgagtgtttccggtgttaggtcgactacggtttaatactgggggctcgctttattttctttagtataaatcatgcttgtttacagtttacataatgcctaatatttaatctgctcgttatatcatgataatattagaagattcacgcagtctttcaagtacatgctcgatattctctgctatatatatctttttcaggaacaattgagcactcgagtaggatgtggtcgagtacatccctttatcgtgaacattctcgaaaaatgctgagttgtcacaaccaacctaccaacgaagaccgacgacttatctcatgtacagcgccggctataagttgggtatgtgagtcatgttggccacatgagatgcacatgtaataaccaactctagcgcctctataggtgattaagagacgcctactcctggttatcgaccagacagttgtaacgacatctcaccgcctatcaatctaaattcacttgtgcatcgctgaactccatctatcgttgtcgaaaactccatgtctctacggtcttacaccgggattgaccaagtgagtacggcaaatattgataaggggagtcacggataacaagagatgctttcgcgaatacggtttgttttcgtgtgcctatcaattgcctatatgtgattgagatacacctacaccaggtccttgaccagtagatcgtagcgatctctcaccacctaaaaatgcatcttcaagtaatcgagatatgcctacacctggtcctcgaccagtagatcgtagcgatctctcaccacctaaaaattcgtcttcaggtgatcgagatacgtctactcctggtcctcgaccagtcggttacagcaatctctcgacatctaacgcgacaatcaacattatcgtgatagcgacaaccaaggccgaatagatcgccgttgtcaccagaacaacaacgtctaggactaacgacattaggatgacaacaaacaaggttatgacatcacgacatcacacgacgacgatgaaactcgagatccccagacttctagagagcccgaggatgaggtagtaggtccaggagccgaacctccgactacaataattccttatcatcttcgtcgtcatcaggaggcggttctcgcaagttgcgaggacgccgtccatctattactccggattcccttcaggtggccgaggtacgactacgactggtcctcgaccagtaatgtagtgatcctcgccccacgacttctaatggtcgaggtacgactacgactggacctctaccagcaacatatcgatccttgtaccacgacttccaatggtcaagttacgactacgactggtcctcaaccagcagcgtagcggttctcgcacctcaatttttagtggtcgagttatgactacaactggtctttgaccagcggtgtagctattctcctactacttctgcgatttgttgagtacaactatacacttggtctttgtccagtgtggtggtcgtctcatcatctacatcaatttttgtaagtatttacatgtgcaatatttatccgttgatctcttcttatatcgcctcgtcttgaaggtggtcctattgtccctttgcactgttctgacaagcctctgagaaacccaagggaatttcggcaggggacgcccagaacagataaggtcttgttggattataagaaccgaatgaaccatgtaaaacctggtcatgtaagagtgctcaatggatgcgtattaaccaagccgtgtaattggaaattgacttttccaacttcatggcttggggctaggatttgtcagcttcagcatgatttgttataagattcaagctgtctttgtggaaaatagtttttccataaaaacagctgggggctaggaagggtaccaaactccgtttgctgagggcaactctagcgagagtactcttttattgtcacacgcagattttgtttattttcaatttttccatacgtattataacatgttaccctttgagtgtcgctcgagggctatttctatttaatattctattctgagtgttgatttcatgaaaattctattcaacattgtcgaagactctgtgtctctatggttctacaccgagatcgactaagcgagtacagcaaatgttctgagtattgattttaggagagtcagacattagaatagtcaagtcagatttcaaggctttgttgcagactctacgcctactcgattactcgagaacggttgatggggcttgtcaaggaatatggaatcaagcgatggtatacccgccgagatggaatttcttcacttcaatccaaattctcgattacaacaagacgggagacttagtcgcatgttccgtatcttctcggtcgacatcggagattaacctagacaaacctaatatagtgcctacaaaggccaataagaggaatctagtgttatttctgatcataccgagaacggtcaagcgagcacgacaatagttgttccaaagtcttcgatcgagaaccttaactcgttcatttgtattgaagtcgggggctactattagggttatggataccacatacccaatagtaatcgattaagctcggcggggcccaccacataccatgtcttatacggaaacaaacttcgtatatagaaggagttccagataaggaaggacgagtagagttctatatggaaacaacaaggactacttgatttgtatccatattggtctccctagttcaacttggacaagagggcacttatgggtataaatataagcccccctaggaggagaggggacaagacacaagatacaacatatacacaaaccaatacgccgccaaatatcggcattagagattagtctagacataccctatccggtgtatacggagaccggcaagagggatctagcgccatctcggatctcgacggattcatattcaaggaggaagactgccctatcttcgactacgtgttggttatctcgccgccaagtcgacgacagctagataggttatcccaaatgttgtacttgtgtgattcagatgaataagagcaacaccggctttggccaacaggatgtagggctattacctgtcagataaggggcccgaacctttataaaaatccctatctctatctctttatctcaatctcgcatataccctggtaccgacgatccccataccatccaaatactgtagtcgcgatctcaaacgtcgaaaacatcctcaaacatgagtagtattacctctcatcgaaagggtctgaacttgtctaaaatccttgtctttcgtatccatccacttttaagtcttgtgtgctaccccttttattattaccgatacaaaatatcgacagttcacgtgtcaggtaggggtcgcgctgagaacggttgatggggcttaacaaccattccacattttagttgttaagcaggttttaagaattaaaacactaacttgggtacattgctaggcttgcccataaccgagggcgcggctattcgaatagattatactctgatcagaggtgtacatctttacccacaagacacatcttcctcacgtgtaaccacgtgccacataccaccacggcatacggatgaaagacgtgacatagttcccaacccatcctagccataaacaagagtaccgacccaaccccacctacggccggaacctgcgggacaggcaggcaagattgagcccctagcagcaggacaccagccatgtgccatgacatctcgactatcgggccacagctcgtgtagccttcatttgtcctagagatgtccatcgacccccgacttcgtccatctccatccgtgtacctttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccgttttgggggttttgaaaagaacgggaggtgtgtgtccaattccaacataagccagccattccatactgtccaaatgatatgagaattcccaaagtctaaagttataaaaccacctaatgttgcataattaatcagcgaagcatctaccgaaattcatactagtggaaccatgaatagagtacccactagttggggttttgtttatcctagggtgaacaaggtaataataacaatagcaataataataaggtcataacaaaggtaaataggcatggctaaataaatcagtgataacgcgggaatttaaataaagcgacaatgcattaatttaaatcaaaataattttataaactaggattcaatatgctcaaggatgatgtgacttgccttgctgagagacaacggccttccgaaccttcggcgacgaccgcgacccacgcttcgagaacctccggaacgacagaagctacgcgaagcacacaagcaaagctacaagcctataaagaagcaataacaatacataaaaagaaagcacagggttctttaggttataacaaacattaggagacttgaacgggtcgattcagagttcgtatgaccaagacatggtcatccgaagtttaatgatgttatatggagatttgcggattattataattaggttttgcaactgtaaaacatgtgtaagcgctagcctggaaaagacaggaaggctgcgccgttgacatgcggaccccacatgtcaacctaagggaccacggtggaccgggtacacagagacggtccacgggtcgacagaagcggaccccgtgtgtcaaccgaggcgagtggccgacaaacggactccactagacaccacgcgggctgcacacgtggaaaccacatggctaccaagcgtgcacactaacacggtcaccacacacacaagcgaatgactaccgacaccggtacacaggtaccggggtcgacaaccgcacaacgggcatgggcgacaccgaaaggacgaggacggggcagtgagaggacagatccttaccaccacgcgacgaggcgtgggaacgacgacaacgaacgggcgcggctgagacgaacggcgagaagacgacttcggcggccattcttggatgaaggcgagacgcggccggcacaaggcttggcgacgcggagccgaggacgaagacgatgacggggctgcggcacttgacggagcgaggacgacgaacgagaacggcttgacggagggacgaacgccacggcgaccgggaacgacgggaggacggcgacgatgacgaccggggccagcgaggaggcgatgtgggcagccggcagtggctggacggagacgaggacggcgtggaacacgccgttgcgaatccgacgacggaggcggcgccgcgagacgatgtgccgggccgncgacgggacgtcgacgtcgaggacgaacggtgacgacgacgacggacagtggaggggttgggatggagggaaggcgatgccgaggatgaccttgccgctgcgattctgaaggtggtggtggtgcggccgacggcgcatgggtggaggaagggccgaccggggaaattgcggctaggcggatggagaggttcgcggcgatgtgcggcggcttctgggcgaaaccgaggagtggatgaggtggaaggctacgtcaccttgccgagggaggggacggcagcgccggctgacgcacgggcacggcggaaggggctgccggaggaactccggcgaggcggagggcgagaccggcgcgggcgacaacattccgttaaaattcgagcgacgccgtggcctggccggggaagaggatggcgctgctgtgccgggagaggcagcg

SEQ ID NO: 61137 - DNA, 2067 bp, Oryza sativa
  unsure (1)..(2067): unsure at all n locations
atagagtacccactagttgggttttgtttatcctagggtgagcaaggtaataataacaatagcaataataataaggtcataacaaaggtaaataggcatggctaaataaatcagtgataacgcgggaatttaaataaagcgacaatgcattaatttaaatcaaaataattttataaactaggattcaatatgctcaaggatgatgtgacttgccttgctgagagacaacggccttccgaaccttcggcgacgaccgcgacccacgcttcgagaacctccggaacgacagaagctacgcgaagcacacaagcaaagctacaagcctataaagaagcaataacaatacataaaaagaaagcacagggttctttaggttataacaaacattaggagacttgaacgggtcgattcagagttcgtatgaccaagacatggtcatccgaagtttaatgatgttatatggagatttgcggattattataattaggttttacaactataaaacatgtctaagcgctagcctggaaaagacaggaaggctgcgccgttgacatgcggaccccacatgtcaacctaagggaccacggtggaccgggtacacagagacggtccacgggttgacagaagcagatcccgtgtgtcaaccgaggcgagtggccgacaaacggactccactagacaccacacgtggaaaccacgcggctaccgagcggacacactaacacggtcaccacacacacaagcgaacgactaccgacaccgatacacgggtaccggggccgacaaccgcacaacaggcacgggcgacaccgaaaggacgaggatggggcagcgagggagagggatccttaccaccacgcgacgaggcgtgggaacgacaacgacgaacgggcgcggcggaaacggacggcgagggaacgacttcggcggcgatccttggacgaaggcgagacgcggccggcacaaggcttgacgacgcggaggcgagggcgaagacgacgacggggctgcagcggcacacttgacggacgcggacgacggacgggaacggcttgacggagggacgaatgccacgacgaccgggaacgacaagaggacaacgaccggaaccggcgaggaggcgatgagggcagccggcagcagctgcacggagacgaggacggcgcggaacacgccgctgcgatgacgacgagggtggcggcgcagcgagacgatgagccggcgaggacgaacgaccgaccggaggagtcgtcgacgaggacgaacggagacgacgataacgaacaccggcggggttcggatggaggggatgcgaggccgagtgcaaccttgacgctgcgatgccggaggaggagatggcgatgtcggccgacgcacgggcacggcggaaggggttgccgaaggaactccggcgaggcggagggcgagaccggcgtgggcgacagcgttccggcgaaaccgagggcaggccagggtggaggggacgtcgagggaggatggcgatgacgacagccgtggcatcggcgaggcggcacaagcggctggaggcggtggcgacaccactagtcgttggcgaggacgcgtctccggtggcttccccgcaaaacggaggcgacgccggggaagaggtagcggctgcgacgccgggggagacgacggcacggccggccggagcgctgacgcggcggcaggggcggctggaggtcagccggcgccggagagagagaaggagaaggcagggagacgtggtgaggccacgggagatcgcgggagggggctaaaacgagtgaacggagtgagggggttccattttataggagaggagagggatccgggcacgggagaggtgggaacggcggcggaaaagtcggccgggggcccatcaaaagcgcccggggttggcgcgtccgttcccggcgatttggggcacgaattcaaggggaaaattaaggggaattgaaaaggaaggaatgggaattacctccccccaattaatttnnnnnnnnnnnnnnnnnnnnnnnnnnnnnnnnnnnnnnnnnnnnnnnnnnnnnnnnnnnnnnnnnnnnn

SEQ ID NO: 61138 - DNA, 1804 bp, Oryza sativa
gaaggaatgggaattaattccccccaattaattttggaatccatggtttgatttgcgcggattagagggagcaagaaactagggttcacgggagagagaggagctgtgcgggaggaggacgatgacccaggtggtggggcccacgcaggcgcgccgtcagcgcacgcacgtgcgcggcacaggcgggagggcgccactcggcttgggcccggaggcggcccaggaggagaggagggagaggcagcccgggagggagagggagaaggagggagctgggccgaggggaaggagggagggcggcccaagagagagagagagggaaggaaaaagagagggaggagggaaggactttggccgcgggccgagagagagagggaggcttggggattatttttagctttttttttctttttaataaactttgttaattgttgttgttgcttaataaatatttttggtgctctgaaaattcaagtaaaatttgagggctccttttagaccaaggagaatttaacaaaaattctccggaccacattcgaatttttcttgtacgtattttagtgtttgccaatttcttttcgaattttaattaattctattattccttttagggaatgatttttatttcgggatgaatttatcaggacgtgacacttcccaagcggatgggagtgtgcctcgccaccagaaaatatggttacatagccacctacgaaaatgggacaagttcgcctaggagaatattcgcgtcaaaatataaattttcccactacattttttaatattaatttttaatcaataatgttgcaattaattaattatctaatacataaatacatttagccactaacaaacattttattaggatataatacatatattgcatgtgttaaaagtgacgtgaatacatacaataatatttttttttgagggaaaacactgtaggggaagcccccacagttaatatattaaattaaaagaaggaatacaaaatatttacaaaaggtttatgcactgagataaagcttgtctctccgaatcttttaatctaaagactaaaagggaaagatcaatcttaaagagagctttccaggaaacaaccgaaggtggttcattctgaaaaattaaagcgtttcgttgcttccaaatgttccatgcagcatagagaatttttttcaacaatatgtgtggatctatatgagctctttgcctgcagcagcatatcatcaaaattgagagagaggttccagacaattcccagctgcgcccaacaatatgaactgaattggcattgaaagaaaagatggaaagaagtttcccttgcttgagctggacaaaggacacatgttagatctgaattttcaggagggtagtgccttctctgcagcatatcataggtgtttagtctatcaattaggagaagccaagcaaacaccttaactttcatagaacactagaaaaaacgcgtggcaaaagccacgcatggtataatgagcttaggccattgggcctagtggggtaacaaatgagtatatacttccacttaattatgggcttattttctctgatgttttgggttttaaataaatttctatttcacattataaaatgtttggattttgaataaatttatagatggatcaatgtatgtgtattaaatgtttgaggttttgaataaatttatgtttcatagtataagatgttttgggttttaaataaatttataaatggatcaatatatgtgtttcatatatatgtcgaaatttatatgaacattagtgaatctagatgggagattgaagag

SEQ ID NO: 61139 - DNA, 6271 bp, Oryza sativa
  unsure (1)..(6271): unsure at all n locations
nnnnnnnnnnnnnnnnnnnnnnnnnnnnnnnnnnnnnnnnnnnnnnnnnnnnnnnnnnnnnnnnnaaacaccacgtctaagaaattaatatctactttagtgtgtataactcaccaaagcaatcattatgcttttgttgattatagtgaacaataatcccgtatgctatttaggaactaaccaagagataattctcataagataaatctaaattactcaggaagaatattatattgaattcagagtaataaacagaataaaagaaataggagatgattaccgacaactccggaattcttccgacttcttatactctactttcttcctattctaatatacaatatagtatagtagagcttcttataattcagctcaagcttggaagtgtgtgagtgaagtgagggagtgatgtctttatatagaggtaggtatgacggttggcgaaggggaaatgtccgaagtgccctccaaccgtcatctgggatgcatctgagacgtccacgccaaaccccacatccaacggtggagatgatggttcggccgaaccagggggttcggccgaacctgggctgggcccatcttgcctggcctttagcccatgttctcccctggtcttcctctattcattcttcggtattttgggttgatcctctgatgttttgatgaagtttacaacccttccttgtatggatacataattctcctcactttagtctagatttcctcccaacatcggggtttatcgcctgcatacaaatatacaccaacacttgtggaatatgtgagattaagcacctatcactatgttggatgttttattatctgaactttatgcagatgttggcggtatagaatcggcatttaacagccgccaacaaaaccccccacacttagctctttgctcgtccctgagtaaaggttagtgtagaatgaatttcttcaagatatgaatcaagcatatacaccattaacaaccatacctgtacttgtgaactttatcagtggctatcttaccatcttgagtaattgatagatggaatgatctcaattccagtccttcttgcttctttgtcagactcatgggattttttatgaattttcgcaaaccaactcttttcctcatattgactttctctcttgtctctcaaggattttctttttggatcctcaccaaggcaaagtgtgccagaattttatcccttattctaaggctgatatgtggagcttggtagggataaattgtgatatacctgcatcatatatatcgcgaagccaaaaatatggactcaagaagatcatcagtcatactcctagatcaagggtctttatttgtggtggaaaatggaaaagtaaaatattttgtggaatgatggaataaagaaatgattctcccctttttcctataccttctcctccattttgttttcttggcatgaatatgcaaggggcatggctatattttcttttcatcatgctcaaatattttgagagcaagttttatttccttttctctcttttctttcatagccatgcctttccctccttttctcattttcctttttgccaagaacttttctaggagaagaaagcatagtctaatgtaggagtttatttgaatgaaatctttgtgggaagccagcttccagtgtagaagcttagcttaattaaatatgtgaaaatgaaagtggaaatgaccccttgatcatgagaatatgaaagatatctaacatgagtcacacaaatttgacaaagtttaatataatgtcaagcagtcatatgcataataaggtttatcaaagatactcttgcatatgcccttggtaggtataacatggagtcaattggaggattgaacttttgaaaaaaaaattattttgaaaacaaattcccaagagtcataacaagagttgcaaaaattcctttcatcttgaatcatctcacataaagcaattacttagatgcataaggttccctaaacatggatggttgttcaaaagcacaagtccagctgagaatcatgaatatacaagatcaatcttatgaagaaatttcattagttggaaattttatattttacttatgcttgaaccaattgttttctgaattttcagctctagtactatatcatggtggagatatacagataatagacgtgctcacctgcttacctgtaaaaattgagaggaattggagccaacactggttcggccgaaccactctggtgcccaatccttctgcaattttctgtagagtacagtgcctttcaggtgttcaaagattcaacaattttcagagtatatgcacgtcagaagctgggatatctcccccacacttattcaaaatctaaactttattaacataaaacaaaaaacaactttggcaaccattggggttaacaccaatgagccacattattcatagtaagtactttacatgattggaaaaataaaaaccaagcatctactaccattttatttatgggaaaggagacatctaattagcataatacttattctccttccatctctatgaatgcacgcttgattttagcgcacaaactgcggctaagggtaccaacattatttctaatctcagcgagttctacccctagctccgtgttgcgatccctaagctctatgttctccttgcggagtttcttcacttgagcggtgagcttatggaccgagggctccggcgattttacttcatcctcttggattttgctgggagccctcacgattggagggggcgtcaagtgatgcttcaccttcataggtggagggctacgggattctgttgccccctcattctccgatgccgtcaaaggccggagtaaacctttgccatacctaccgctgggaattcgcactcccatgatgcagaatcgctcctcctttggagtggatggagtagcggtgggtgtggtgtacttgtggagcacctcatcccctgccttggtgaatagggtgcccacatatcgctcggcgggaggcggagcgtgtaacatcccgcctctcccaggctaggcctacttacatctggtagttttcataggtcatagactgccctcacaaaccaacacaagtcagcccacttacaagactgccctcacaaaccaacacaagtcagcccgcttatatctggcagctttcgtaggtcatagactgccctcacaaaccaacacaagtcttttctgcacactttgtcctcactcatgagcaatcgggaagaatttcctgatcggtcatccatccctaaattgctccaggccaaacacgcttaaccctagagttctttggagatcggcttccggaaaagaagttgcaacttgttgatatgggtattctattaatcctattaagccctaggccgggatgtcacaatcctcacccccttaagacaccgacgtcctcgtcggttgcctgcgcaactgcgacacacacgcccgtgaaaccgcgagagtcggctctgataccattttgtaacgtcccgcctctcccagactgggcccgcttacatctggcaactttttaaaggtcatagactaccctcacagaccaacacaagtcttttgtgcacactttgtcctcactcgtgtgcacccgggaagaatttcccggtcggtcacccatctcgaaattgctccgggccaagcacacttaacctcagagttctttcgagatcggctttcggtaaagaagttgcaacttgtttatatgagtattctattaatcctgttaagccctggcgggatgtcacacagcgaccttctcatcatattgaaaaaggcgtcgcgctttcaaaataccgagctctcccatagtcggccatcacgcaggtgaatccccctgaattttttgtcttcataacatggcgaggggagagggatcgcgttgccgaacggggccgaggagggttcggccgaagccctggttcggccgaaccacggagctcaccgacgggctacaaatttgcaggggagcctgacactattgcgaggggctgcgcccacagtgcgtttaccccttccatcgtgtagttttccaccgggatcaattgattcgctggtgttggctctccgtcgagattataggtggaattagaggaggagccaatgtatgggatcaaggacttgccagccattggtgagttgtgtgtggagaatcaaggaattgaattgggatgaagaaggagtttgcacaagaggaggagaggaggaagaataagtgctctgagctttgatccgatcgatctacctccgaaagcgcatcacaacagactacaaacgagcgagggaattggaactaatcgggcgccgtcctggtttggccgaaccagtaggttcggccgaaccctggtgggtccaactggcggccaatttttccctaggcccactaaattctaaactaagcacaaaagtgacaactatacatggttttaagcatgcattagatgagatcatcatggttcatgatcgattaattcaataacatccacttcttcatctaaagtttcatttggttcaagaaaaatctttaagcgttgaccatgtaccttgaatattttacctgagtcgtcgcggagtgtgattgccctgtgcgaagaggtgtcgatgacatcgaacggtatgttgatgatatgctgatgattttcccctagaggtatgtacttggataccatgtagttcactatgttggcataccacgggttggagtcgcgaaccgtcatcagcatatcatctctcaagaagtcatttatcggctgttcctgcatgtcaatgatctgcagtctagacaaatgatctgctacagaattttgtactccctttttatccttaatttctaagtcaaattcttggagcagcaaaatccaacttaagagacgtggtttagcatctttcttagtgagcaagtatttcagagcaacatgatcagtatagactatcaccttagctcccaccaagtaagatctaaacttatcaatagcaaaaacaaccgcaagcagctctttttcagtagtcgtataattcaactgagctccgattagggtttttctagcatagtgttgacgaccaaatttggtaagatatgtacgaggttcgacattggaatcgaatcggattcagcaaagagaggattcgaagaacagagcatgcatcggctacgaaggcatcggttggagtctgcatcggctgagatggatctgacagaggacaaccgatagaggtgatgcagccgattccgatgatgatggtttcaaagatgtttctagaatcgatcaaggtgcttcacgaggattgccgtgatggagataaagctctatgatagggaattgtatctattaattaggatatttcatgtaatttccttagagatatgtttaggcaaaagtctgtcacaaagacttatggtatcttagagtttgttagagataagtgtcgagtccggcaattacatattttgtacctcgagtataaatatgacccgaacccatgtaatcaaacaacaataattcaatacaatctcggtgcatcgccaccctttttactttcgtttatttcgacgagttcttgctttcgggttgagctgcatcggattcgatcttcaactagaggtaaaacttgttatggtggcttgcgttctcggggttaatgcttccatcttcatgacattttaaccctatttatgtaattcgccgagttatcatatacatgacacaatctatgttgtgctatataacttgttatcggctggttcttattgttaggaagcaatcgaaagagttatgtgtcgcgaccgggaaaatttcattttcccgaacgctactgtattaatccccgtcccaggaaaagccggggtacaccatacaaacatgatataaaagacgcatctttattatatcgataatatttacattattacaaaggcacttaaggcctgacaatcaaaaataaacagcagcggactagcgggcctacggctccatcttcacaggcgctcaactggggtataagccaggactccacctaagacttcttctctaaagcttctcttactgaagggggaaaagatagagcaagaatgagtacacccacagtactcagcaagccacaccggagatgcataattaatgcaagggagtacaaggggataataatataggggttaagttttgcagtaaacagcatttaaaagtcacttagttgcccaaagccattttataaagacgatcctnnnnnnnnnnnnnnnnnnnnnnnnnnnnnnnnnnnnnn

SEQ ID NO: 61140 - DNA, 1788 bp, Oryza sativa
  unsure (1)..(1788): unsure at all n locations
ggcctacggctccatcttcacaggcgctcaactggggatgatacaaaaggcacatctttattatatcgataatatttacattattacaaaggcacttaaggcctgacaatcaaaaataaatagcagcgaactagcgggcctacggctctatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatataggggttaagttttgcagtaaacagcttttaaaagtcacttagttgcccaaagccattttataaagatgatcctagagctacggagtgttattaatcaaggccgggaaccctcacgaacctgccttaacccaaggcctacgatgattcagaccgaacttgtaacccgaccctgggtcccagctcgtcccaagccaacccaggccaaccattccacattttagttgttaagcaggttttaagaattaaaacgctaacttgggtacattgctaggcatgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccaaggtacgactagcaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccacgaatagagtacccactagttggggttttatttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcagagagaacggccttccgaacctttggcgacgaccgcgaaccacgcttctggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcannnnnnnnnnnnnnnnnnnnnnnnnnnnnnnnnnnnnnnnnnnnnnnnnnnnnnnnnnnnnnnn

SEQ ID NO: 61141 - DNA, 1087 bp, Oryza sativa
  unsure (1)..(1087): unsure at all n locations
ccatgtttctttgcacaggggaactttgaaatgtcccatcaacaagccttggcacaagtaacagcagaagcagtccattctccgtacagtatgattaatcaatcagatttctcactcccgttctcgtcgacaacgacttcagtgttggcatcacaacatgtcaactcttctgccaatgtgtcatcaccacgagaaataccaactctgccatcccacacagataatagcaccattgaatcaactgaggtttcacatggattccaaactactgccctcactgaggataaacctgctgatgatggctacaactggcggaagtatggccagaaggcagttaagggtggggagtatccaaggagctattataaatgtacccatttaagctgtccagttaagaagaaagtggagcgctcatctgacggacagattactcaaatactttatagaggccagcataaccaccaacgaccaccaaaaagaaggtccaaagatggtggcgctttactaaatgaagcagatgtttcccctgagaaggaagatgcatcaactagatcagaacagggctcccaagattattctggaaaattcaaggcatcaaatgatggtggtccttcatcatccaggaggggagataggggtgagcaaatatcgggctcaagtgatagcaattcgagctcggtacccgaagaagtgaaggttgagggtagagctactagtgatggaaatgcgaacaaaaggtggtctacaaaacatttttgttttacttggacattttctgagcttcaatatataaatgctagtttctattggacagacatgtgccagctccagctcaaagaatcattgtgcaaacaactagtgaggttgatcttttggatgatggctaccgatggcgcaagtatggtcaaaaagtagtaaaagggaatcctcacccaaggtaattctgttttttaaattgcacttacttgttcccgatgttctgccatgttttttcattatattggagcagctctgaatagctcaatgcaatcactttatttttttttggtacagannnnnnnnnnnnnnnnnnnnnnnnnnnnnnnnn

SEQ ID NO: 61142 - DNA, 1872 bp, Oryza sativa
  unsure (1)..(1872): unsure at all n locations
gtatagctctggaatcgtgtttacaaaatagctttgaacaactaagtgtcttttaatgctgtttactgcaaaccctaaccctttatattataacccccttgtactcccttgcatttatcctgcacttgggggtgtgtcttggtgaataccggtggttgtactcaatcttgctcaatttttcccaaacccagaagaagagcccctggaagataaaggctttggtgtctaactcgggcctgccgtcaagcgcctgtggtcgtcgccctagtcttccgctgtttcccgtttgtctttgtgtgtgctgggccttcgccgcccatgtaataaattaactatttacgcttccacttgataaactctgaaatgtatcaacttttggtgtaccttgcctcctgggacaaggaataatacacgcacgtaagaaacgcccgttgggttaattccggtcgtgacaggatttataacaatagagtggctcttaataaaatttgaaatttataagtagtttttgtcagccaacccgaggataaatcttaccgagtctagtacaatcactataacgggatcgcttatctctaacgggctgaaagcctcatcactatcgggtaaggcccccgttagtgggcaaaggtcactgatgtgagaaaatatctcaatcgggctaaagcccgccacggatggatgctatctcaatcgggccgacaaccaagcccgtcacagatgagtacgaccaatcaaaccaccgtagttaggagcccgtgacggatgactaatctcaatcgggcacaccactaagcccgtcacggatgagtagtcatctccatcgggcatttagccagagcccgtcaccgataggtttgaccccacgtgttaagtcaaactagtcccggttcggatgacttatctctatcaggtgtattacaaaagcccgtcacggatgactaatcactaacgggcttgactctatagcccatcacgaatgagttatctctttcgggcattagctaaatgcccgtcagggatgagtttagagccaaaaaaataaaatttgtctttttggctagcctcaggcctttgctagccacgcccgctgcaaaaatgacagaagcatatatatatatacatagtcccattcccagcaaccccattcccagcatcaattcacatataccatcacagccaatttatatagacccattcccagcatcacatcagaaaattcacattcatattccatcacagcacagtcaattcacaaaatcaaacacatatacattcacatccacaacccattcacatatatatgtcattcacatccatttttctctccaaaccgccgacatgcatcaaaacctgcaaaactaagttataaattggaacaattttatatgtaactagaaatgcaagtatatacagagacgatctacctaggactttactgtaaagaatttaattgtattacaaagaatatttacaaaaatcaaatgtttgtcgcatatgcattgcaaatgttctgccatttcgagacgagctaactaggacttcactctaaacatccctttcggtgacaagatatcatctagtatgaattgtgctatctcctctctaatgatttcgaagttgatttccggaatacttgaaataaattcctgcatgttcggtgccaagttagtctacatacttgtaaatttgttgtcctatgtgtgtataaacaattgaaatacacacctcagggtcgagcaatgtcaccttttctgcgaagctcctcatgttatggcagacatggaacccgcactggtcgccaactnnnnnnnnnnnnnnnnnnnnnnnnnnnnnnnnnnnnnnnnnnnnnnnnnnnnnnnnnnnnnnnnn

SEQ ID NO: 61143 - DNA, 1276 bp, Oryza sativa
  unsure (1)..(1276): unsure at all n locations
nnnnnnnnnnnnnnnnnnnnnnnnnnnnnnnnnnnnnnnnnnnnnnnnnnnnnnnnnnnnntgctcatattcctaggattgggatcatctcaattaccctgataaaattggcaaaactaccaaaaggatttctctcacatttgcaggattagactactcaaaacaaacatttgcctgagatatactccatgttgatgcctgaggcttgatggagggcattggcaatgctgttcaacatcccttaccacctaggttcaagtcataggacccatgcgagtgatcaccacttttttaataaatttttgctagtctacagttcctgccatgtttaagatattccctttttagatctatagcaccaaaagatttcagttcacttcaatagtactgaaagttgccattctgatttgtaggaatccattcaatttagttagctgtcacccctcaccatattactcttcccttcagtgaaaagcagagcagagcatggtagaggctacaaaaccaactttggatggtatagaaccaattctgcggacaaggcaaaaatactttgagctagttgatcatgttaattagaatgcaatactgggatatctagagtagatatggttaaaaggcagtcccattagggcatcttcgatgcagaatgcctgacgaggtgctttggaagagaaaataatcaagtcccttgtgaattgtgccctgcaatgcaaggtgctcagaactgcttccaatctgattcatgcagggagttgtcctcctaaatcggcagccatgcagattggtagaatcaaaaagttgttggttccgttaattaagcacttgaggtagcatcaactcctgaagaagcatcgagcgcctaggcttaacctgactatggaaaaaatccggatttatttttgtaagagcctccctagcctacagaaattgcttaaaatcatagccaaaatctaaaaaaggaaatgttttagagcaccgacactggtagcaagtgaggactattgtgtatcttttcttaaagaaagatgtgctggaataactatggcctggtttagttcccaactttttcttcaaacttccaactttttcatcacatcaaaactttcctacacacacaaacttccaacttttccgtcacatcgttccaatttcaaccaaacttccaattttagtatgaactaaacacactatatatcatttagtaaggaatgcgatggagcccatactcatgagtcaaacaaatgatatcataccgagtaaggctgtgttcgtt

SEQ ID NO: 61144 - DNA, 926 bp, Oryza sativa
tcatcttcaaaaaatcgttggaaaggcagctggcattggagaaaggcaagcgagtacgtgtagtcgagaaggcaactgaggcaaccactcaggactcagactccgcgtacccagattccgatcttcatgtctcgcacatcttcggaggtcccacagcgtactcttcaaagcgagaatacaaaaaagtggagcgtgaaatttgttcgacatggcaggaggctgcacccaagatgaagtggtctgaacagaagatcgagttttcagatgaagaccaccccaaggctgctgttatcccaggacgatatccgatcgtggtcgaacccactattcggaatatcaaggaagcgtgagtccttattgatggcagcagctccatcaatcttctcttcaccaacaccttggacgcaatggggattccacgaagtgagttgacacccaccgatcaaccctttcacggattctgtcacgtcctgataaattcatcccgaaataaaaatcattttctaaaaggaataatggaattaattaaaaattcgaaaagaaattggccaaccctaaaatacgtacaagaaaaattcaaatgtggcccggagaatttttgttaaattctccttggtctaaaaggagccctcaaattttagtggaattttcagagcacgaataataattattaagaaataaacaaagttgaaaaggttttataaaaagaaaaatccctaaaagtcttcttttcccccccttcctctcttgggccggctcggcccaactctccctccctctctctcctctcccccgcgggccatcggcctcctcccccgcgcgcgcgccgctgacaggcgggcccgcccgccgccctcgctgacgggtggggcccacctgtcatccgcttcttccgccggtcccgccgatccgccgtgcctaacgcc

SEQ ID NO: 61145 - DNA, 5812 bp, Oryza sativa
ttttaaatgctgtttactgcaaaacttaatccctatattattattcccttgtacctcccttgcattaatcatgcatctgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggatggggattaatacactagcgttcgggaaaaggcaattttcccggtcgcgacaagctggtatcagagccatcttgactgtaggataagccaagtggataaaacccaaggacatattttataaataaaaattatttgcgaaagttcctttttctccttcccctaatgctatttgcaaaaggtttactccgttcttccttcttcggatttcaactagtactagatggtcaggtcagtgaagaagaagacatcgtcagttgttcgccgaagctccggaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgattgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaatgtcagagaagaaattcctcccgaggtgcacaacagttgacagagcatcttttagctaatggaggtagagtgtctggtagtgaagattcagatcaagtctcctcagatgatgaagatgagaagtctccccaaggttttaaccagaatgaaatagaacttaaggcatgctctcgttgtggagaaatcggtcatgttgccagctcgtgtgcctctacatgcgttcattgtgaggaagaccatccacccgataggtgtccaatgagcaggatcacttgtttcttttgtgaaggaactgatcatgtaccaaaagattgtcgattcagttttctgctgacgaagaagatggccaaccaacccgtcagttccaacggagagaagcatcaaggaaacacaaatcctcgccaagattacagtttcagcctaactccagtgccaggacagaggaaacaaaatgagaaaagaaaatgccgagtccgggaagatatctgttgcttcaattgtcaaggaatgggtcatttcgccgacaagtgcccaaaaccgagaaacgtagctgccagcacgtcagtccacgcaaacccccgcaatcagaagcttgctcctcaacgaattgtcatccatgcatcccgaagcagtcctatagcccgcgttgcaacagctccaatttcaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgacttggcaataaatcatagcaaccattctctgcatcgacagcctcagcaaagaattgtcgtagatggaagaagttgtgtctctccccgacctactccaggccgagccaagagcaatcaacctccggagggcgataccaagcagaagaccgtcatccgcttcaaccagcaatcagaaggaagcttctcctgtgaatgatagcattatgcagtcctgtcacatcatcacagaaccaatcaaggatccattccctaaaccattgccagctttatctttccaaattcaaaatgaccagccttgttgggggttttaattccgttactaataatggtgtaatcaaaagttgcagcacccatgtaatacataaatatattcatgtttataaacagtgagcttgctatgcttatggatgattcacgttgagaatacaatgtaccgatgttaagcaccgtccctttttgtttaaggcagtgcctcgtattcatgtaatgagggagaaatgtgtaatacatacaagttccaggaggattcgtttgaaagatgcggatatatgatcatgtgtataattgtttactgacaaaggagacctagggtctcgtgtcagaggaactatattctaaccttgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattagtttatccggtatcagaaaaaggtcaaaggtgatgtggcagaagaacaatttggatgctccccatctcgaggaagcactaaagatgaccattggcaattaaaccctagtggtatagatacagatagcaggcaatgtatttccctgaaggtagtcagtgcagcttttgacgaaccacatcaaggttccactgaaaggcagcaagccaaaggacctcatcatccccagaagcgtccgcaatccacattaaagaataccacctgttagagataagccgaaagaagattgataaaagagattggcaaagatgttctctagcatgaaagaagtaggccgaaaggtgattgataaacagaaacatgctctgcatcgctcacggaagacccctgattgtaattgccccgcaacagtcaccttgtcattaagtaagcaagatgacctaggtaaaagtgtttctatgaaggcaaagagtgaaatcttccgctcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaacatgaagagaatagcggaaagtaaactgaacataaagaaagtaaatctgagttgcttgttcgggggagctattcccagttatgaaccaagtgatatgttcgaagatagtctacagaggtcagtttaaaatcacatgtaacggcgaagcctcagatttggcaggataatgattagacaataacaaatccagcagtaaagccatttgggaagacgtcaaagtatatcaagtaggataagttggctcccttgggaagcataattcaaaggtaaagttatcgacccttgcatcaaatagcagaagtagctatcacccggagaccagggaagctaatatgaggcagttggtggcgagttagaagcaaatgacaagcatggtatcttagtaatgacgagctgatctcggcacatgacatgaagcgggtaacttgtatgaggttgactccaaagatatgaactatgcgaagttctggaactgaagccccatcttcaagtgccgcaacccagtcgaagtcagctaaaggttcaaccctggttcgagtcaggtgaaaagaagattccacctgcaacaggagatcgagccaagcagtccagagtggagaagctttgttaggcaagtttgttatagaaagcggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaaattcgaaaagaaattggccaaccctaaaatacgtacaagaaaaattcaaatgtggcccagagaatttttgttaaattctccttggtctaaaaggagccctcaaattttagtggaattttcagagcacgaataataattattaagaaataaacaaagttgaaaaggttttataaaaagaaaaatccctaaaagtcttcttttcccccccttcctctcttgggccggctcggcccaactctccctccctctctctcctctcccccgcggcccatcggcctcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataatgaggggggaatcattccccgcgattccctctctctttccccccgtttttccctctctctctccctcggattcgtccggaatcgctcccgcaaacctcgccggcgccatcaatggcggccgagatctccgcgcccgtttcctccctctccggccgcgctctccccctcccgacgctatataagcgttccccgtgctctccccctccgtttccgccactcgccgtctctcctccccgtcggaatcgagcccgcaccgtcgcaccttctctccgccgtcgccgccgagctccggttcgccgccgtcgtcgctccggacctcctccccactcggcgtcacctccatcggctttgccgcgtccccgtcgacctcggccacccctccgcttcgctcgccgaccgccggagcaccgtcgcccacgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccct

SEQ ID NO: 61146 - DNA, 7569 bp, Oryza sativa
gctgacgcaataaacccgattttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatgttgaatcccagtttatcaaattattttgatttaaattactgcattattgctttatttaaattcccgcgttatcactgttttatttagccatgcctatttacctttgttaatacattattattgttattgttattattaccttgttcaccctaggaaaataaaaaccccaactagtgggtactctattcctggttccactggtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatctgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggacggggattaatacactagcgttcgggaaaaggcaattttcccggtcgcgacagattcacccctcagtcatcatccaagccattgggcaagatcacgcttcctgtgactttcggacaagcgagcaacttccgaacagagcagatcacgtttgatgtcattgagtttgacatagcatacaatgccatcattgggagaactgcactcgcgaagttcatggccgcatctcactatgcatatcaagtactcaagatgcccgagccgaagggaacaatcactattcaagggaacgcaaagctggcgctccaattcgacaagtggagccttgacatggtcgagcacactcctagcccacccgccacagctgagccacccaagaaagtgagcaaaacaaccaagacgccgaaaccagacggcgcaatcaaaattgttccactctccagcgccaaccccaacaagacagtcaagatcggggcatcactgaacaagaaataggaactcgcgctcatcaccttcctccgcgacaatgctgacgtgttcgcttggccatacgagaagagctcgacaaacttctcaaagctggttttatcagagaggtactccatccagagtggatagccaacccagtcatggtgcggaaggccaacgggaagtggacgatgtgtgtcaacttcaccaacctcaacaatgcgtgccccaaggatcacttccccctccctcgaatagaccaactagtggactcaacagctggttgtgagctgttcagcttccttgacgcttactccggctaccaccaaatcagcatggcaaaagaggacgaggagaagacagcattcatcacgttgttcggtgtattctgctacgttaagatgctgtttggactaataactgcaggaaacacattccagcgtacggtccaaggggcactcaacgatcagctgggaaacaatgttgaggcctacgagaaacctttgacaacctccgatgatattgcctcatgctcaatcctgagaagtgcaagttcggagtaccatcgggcaagctgctcggcttcctcgtctctggcagaggaatagaagcaaaccccgaaaagatcaaggcaatcgagaacatgaagtcgcccacgagactcaaggaagtacagaagcaaaccggatgcatggtggcactaagcaggttcgtcgctaggatgggcgaacgaggacagcctttcttcactctactgaagaaacaagaaaaatttgtatggacacaggaagccgaagaggcgtttatcgcactcaagcgctacctgtcaaatctccctgtacttgttgctccccaacctaatgaagaattattcctctatattgccgccacgccctattctgtgagtacgatcattgttgtcgagagagaaaaggtgcaaagaccagtctactacgtcagcgaagctctccacgacgcgaagataagatacccacagatccaaaaactgctctatgcagtaatcatgacgtcaagaaagctacgccactacttccaagcccacagggtcacagttgtctccaccttcccccttggtgaagtggtgagaaatgggtagtcgagctaagccagtttgatgtccactttgtaccacgaacagccatcaagtcccaggttctcgccgacttcgtagccgattggactatgcctgaaaacatgttagacagtcaaacagacaacgaaacatggacaatggcgttcgatggcgcactcaacagccaaggagcaggtgcggggtacatcttgacatcaccttcaggagatcagttcaagcatgcaattcaccttacttgagggcgaccaacaacacagccgaatatgaacgactactcgctgggataagagctgcggttgcacttggagtcaagcgactgatcgtaaaagtggattccgaactagtcgcaaaccaggtgcacaaagactacaaatgctctagccccgagttgtctaagtatctcgcagaagtcaggaagctggaaaaaagatttcatgggatcgaggtccgacacatatatcgcaaggacaacatcgagccagacgacctaagacggcgtgcgtccagacaagagccactcaaacccagcacctttctagacatcctgacaaagccatcagtgagagaggccaacgatgaagatagcccagtcgcccccgacatcagctcgggggctatagaggcagaacgcatcgttgccgacattgagaccacgaacgactagcggatcccattcattaaattcgtaagtagcgacgagttacccgaggacgattgttaacagtgaaatttggtaaatccggaatagtcatcggcttagagtcagcatcggcttcgaagtcctgagattagccgataagagttgtcaagtcgccagttgtcggattcttgctatattcggttaaggaaattgatctactaaaggaagcttatccagaagagaccgagttcaaagagaatacggcatggcaagttatctattaattaggaatagtttgttagtttccttttatctttaggaaagtgtgtttagtgtcctataaggactttatcttttccttttatctttaggaaagtttctttcttgtccgacaaggacttgtatcaactcatggttataaatatgtacacccggggtgtatgtaatctatctctacgatcaatacaattcggtgcatcgccaccttttaccttttctactttattttatcgtccggcgggaattggaacttgatgcggggctgcatcggtgttcgatctccgcctaaggggtaagtccaatgttccaccggcccaggcaattgtatcgtctacatcggcatcgttcaaggctgcatcagtacattcgatctcttggattgctctggtttgaatgatatatttgcctacctatttatcatatgtctctgttaatctagtcttagcatctcaatttagctctatcggctgcttctcgttttagggtttctgccggtatcggctaaatcgccatgctagattagattagcttagatatctaccaccctgaaaatcagtcaacggcttgattgtatagatattgtgtttcttttcatacttagtgctgcatcagttaagtttgatctactaagtcgtgcttagattcataatctctagcctgctttttgactgccaataagggtttcatcggggtttcagccgatgaggtatctggacattgcatcagcttataaggattgcatataagttggatttagcttatgacaataaaggtttcactgttttatctaatcatttggattttatggcatcggacccccagccgatgtatgctttagccttcggatcaatgcttattccatcatattattatcagccgattggtttttatcggattatattatcgttatattatcatcagccgattgcctttatatcattattaatatcaagtgtcagattctacattggatatatagccgatttatcaaaaccctatcgagatcggctggtatcggtatcggctattatcggcatcggctagaatcactccatcggcttgtcagctatcagctgtttgatctactgtttgcatatcttgtcagttgtaggatcaaactgactggcacgtccgcatctcatcaagatttggacatgcacaggagctaagcagatctcctaggctggtgtgttcgatttttttcgtcaacaacgatgcagaagccgagaaaataacccgtcaggcaaaaatctacagtatgatcggcgacgatctatacaagaaggcgccaaacagggtacttctcaaatgtgtctcgtccgatgacggcaaacacctcctcctcgacatacacgaagggatctgtggatcacatgccgtcggtcgtacattggtcgggaaagcctttcgacaaggatttttctggccaactgccctcaaagacacttgcgacatggtacaacagtgtgaaacttgtcaatttcatagcaaacacacaaagctaccagcgcaagcgctgcaaaccatccctctcacttggccgttctcgtgctgggggctcgacatactcggaccgttcccacgaggacagggcggctacaaattcctgttcgtaatgatcgagaaattcaccaaatggatcgaagtgtcacgaccagaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgagaaacagcggaagactagggcgacgaccacaggcgcttgacgacaggcacgagctagacaccaaagccttcatcttccaagggctcctcttctgggtttgggaaaaattgagcaagactgagtacaaccaccgtactcaacaagacacacccacaagtaaacagcattaaaagacacttagttgctcaaagctattttgtaaacacgattccagagctatacaatattattaatcaaggccgtgaacccacacgaacctgtcttaacccaaggcctacgatgattcagaccgaactggcaacccgaccctgggtcccagctcatcccaagctaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgtagctcgtgtagccttcatttgtcctagagatgtccatcgacccccgacttcgtccatctccatccgtgtacttttgtttataaccagactgagccataaactaagccttacccactagacatgtggaagtacggtagtactttgcaacagaggcccgaagaccggtccttatatggccgaggtgctactatcaaaaccatacaccccgagcccagcctaaaaccattttgaggattttgaatagagggggaggtgtgaatccaatttccacaataatcaaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacataattctgtaaactgggattcaatattgtcgcgaccgagaaaattgcattttcccgaacgctagtgtattaatccccgtcccaggaaaagccgggggggtaccgagctcgaattcgccctatag

SEQ ID NO: 61147 - DNA, 2441 bp, Oryza sativa
  unsure (1)..(2441): unsure at all n locations
gcgagctcgattccggcgaggaggaagggcggcgagaggcggaaacagatggaggaggtgcggggagggattaaatagggttggaagggggagagagcggccggcggggaaggaataagcgcgggaggtccggccgccatcaatggcgccggcgagatttgcgggggcaaatccgcccgtttgaacgcgagagagagagggaaaaatggggggaaagggagaggggatcacggggagtaattccccccactttattgcatgcgggaacggcggaaggcggcggaattccaaccgccggcgcccttaggcccagggaaggcgccggaaccggcggaagaagggaataacaattggccccacccgtcagggagggtggcgggtgggcccacccgtcagcggcgcgcgcgcggggagaggccggatgggccgcggggagaggagagggagggggagggatatgggccgagccagcccaagagggagagggagggaaaagggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcatcatttaaaggatatattttagagtcgttttgggacgtggcaaacctaccccccttaaacggaatctcgaccccgagattcggaagaactggcgaagagatcgggataggctgccttcagctcgtcttgacgctcccaagtagcttcttcctcggcgtggttgctccattggaccttgcaaaaacggattacccggttcctagtcctacgctccatggtgtccaggattttcactggcctctcctcgtaggtcaagtcttcgcgaacctcaatctgctctgagtcggcctgctcggacggcactcgaaggcatttcttgagttgcgacacatggaacacatcatgcacgttgcccaaggaggcgggcagctccaactggtaagcgacttccccacgtcgagcaatgatacggaaaggacccacaaaccgaggtgcgagcttccctttcgtctgaaacctgtgtacacctcgcaatggcgtgacccgaaggtacacaaaatcgtccactgcgaattccagattacggcgtcggttgtctgcataactcttctgccgagactgggccacctttagattatcccgaatggttttgactttagcttcagcttctctcaggatatcagtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgatttagacctcggtctgtccatctgtctgcgggtgatacgcggtgctgaaatttaatcgggtacccagctcttcttggagcttcttccaaaagtgagaggtgaattggcttcccctatcagatacaattttcttaggaatgccatggagactcacgatcctagcgaagtagagatcggctagtttgttccctccacaggtggtcttcacaggaataaaccgagctaccttggttagtcggtccacaactacccatatagaatcatatccgccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctctttcaagtctaagtacatcttcgtactgccagggtggatggaataagggctttcatgagcttcctgaagtatcaactgtttaagttttctgtcgtctggaacgcatacccgatttccgttccatagggttccgtgttcatcctctgtgaaaccagcggctttaccttgtttcatattcttgaggagtccacgtatatccggatcattcttttgagcctcgcggatttgatcgagcaaggtaggcttggcttccagtgtagccaagaatccacgaccaactatgcttaggttcagggcttccatctgttgattaagttcaggtggaatgccacggacgccaagagtgttgcaatggctttttcgacttagagcgtcggcgaccacgttggccttannnnnnnnnnnnnnnnnnnnnnnnnnnnnnnnnnnnnnnnnnnnnnnnnnnnnnnnnnnnnn

SEQ ID NO: 61148 - DNA, 3151 bp, Oryza sativa
  unsure (1)..(3151): unsure at all n locations
aggcataggctaccacaggaccgtcctgcatgagcacgcaccccaatccttggcgcgaagcgtcacaatacaccatgaagtccttatgagtatccggtaagattaaaaccggcgaggaaaccagcctttccttgagagtttggaacgccttctcgcattgcgggctccacacaaatttctcttctttcttcaacaactgtgtcatgggtcgagcgattttggagaagttctcgatgaacctctggtagtatcctgccaaacctaagaagctgcgaatttgagtgactgtcttgggttgcttccaatcagtgacggcggtcactatttcggggtccacagcgactcctttagcagatatcacgtgccctaagaatttgacttcggacaaccagaactcacacttgctaagcttggcatacaattgatgttcccgcaactttcccaacaccagacggagatggtgctgatggtcatcctctgattgtgagtacaccagaatgtcatcaatgaaaaccacaacaaacttatccaagtattccatgaacactttgttcattaagttcatgaagaaagcacgagcattggttaaaccgaatgacatcaccgtgaaatcatacagtccgtatcgcgtggtgaatgcggtcttagggatatcttcttcacgaatacgtaattggtgatatctggaacgaagatcaatcttggagaatacagtggcacctttaagctgatcgaacagatcatcgatccggggaagagggtacttgttttttatggtaacttcattgagagctctgtagtcaacgcacatcctctttgtcttgtctttcttctccacaaaaatcacaggagcaccccagggggaagtactcggccgtatataccccttttctttcaactcttccaactgtttcttgactttggccagttcattagctgccatacggtagggtcgcttgtacagaggagtggttcctagagcaagatcgatccggaactcaatctctcgcttgggcggcataccgggtagttcttccggaaacacatctccgaactctctgacgatggggatttccgacagtcttatctgatgaagttctgaactaccgacagaggttgggggtgcaaagaaaacgaccggttgttccgtccctcggtacagagtgacagtgcatcttgcacaatccactacacattggaattgagccaaccaattcatcccaaggatcacatccaagttcttggtgtctagaagaatcagatccgagggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggatgcgcttggccttgctggcgcctcggctttgggcatttatccgcaaagtgcccaggcttgaagcagttgaagcacagacgctgctgaccttgaacgtccctgcggccttgaccaggctgcacggctggcataggaggacggggcgcacgagtcccttgctgactctgctgttgctgcggctatgggacgcgcaccacgaattgaggacccggcgcacccgggctcgcaccggccggcgccgtgggccccacgcatcagccgcacccgagggcgcgggcggctgacggccaggccccacgcggcagccgctcggtgcgcccgaaggcggccacggcggcgcggccggcgggaggcggcgcgcgcgcgcccctacggtcgccggcggcggccataggcatggcggagcggcggccgagagaagggagggaaagggggaaacgaggcggcggtccacggctcaccctaggtcgacggcgatgacgaaaaggcggccggagcggaggaaggcggcggcgcggctcgggtcgaccgggacggcggcgctccggtggtcgacgagcgaaacggaggggtggacgaggtagtcgaggatgtggcgaagccgaaggaggcggcgccgaggtgggaggtggtccggggcgacgacggcggcggaccggagctcggcggcgacggcggagagagagagcgacggcgcgagctcgattccggcgaggaggaagggtggcgagaggcggaaacgaacggaggaggtgcggggagggtttatatagggttggaagggggagagggcggccggaggggaaggaaaccggcgcggcgctctcgggctccatcaatggcgccggcgggattaggggagggtttccaaacgaatccaagggagagagggagggaaaattggggggaaagagggagggaatcacgggactgggccacctttagattatcccaaatggttttgactttagcttcagcttctctcaggatatcagtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgatttagacctcggtctgttcatctgtctgcgggtgatacgcggtgctgaaatttaatcgggtacccagctcttcttggagcttcttccaaaagtgagaggtgaattggcttcccctatcagatacaattttcttaggaatgccatggagactcacgatcctagcgaagtagagctcggcggcgcggagcgaggttgctgctgctgttgctgctgcgaggacgatccccctggatagggattggtgtagcggaccctttgattagccccctgttgattgcggaaattcgccaagcgacgcttgtgcgactccagttccttnnnnnnnnnnnnnnnnnnnnnnnnnnnnnnnnnnnnnnnnnnnnnnnnnnnnnnnnnnnnnnnnnnn

SEQ ID NO: 61149 - DNA, 4201 bp, Oryza sativa
  unsure (1)..(4201): unsure at all n locations
nnnnnnnnnnnnnnnnnnnnnnnnnnnnnnnnnnnnnnnaattggggggaaagagggagggaatcacgggactgggccacctttagattatcccaaatggttttgactttagcttcagcttctctcaggatatcagtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgatttagacctcggtctgttcatctgtctgcgggtgatacgcggtgctgaaatttaatcgggtacccagctcttcttggagcttcttccaaaagtgagaggtgaattggcttcccctatcagatacaattttcttaggaatgccatggagactcacgatcctagcgaagtagagctcggcggcgcggagcgaggttgctgctgctgttgctgctgcgaggacgatccccctggatagggattggtgtagcggaccctttgattagccccctgttgattgcggaaattcgccaagcgacgcttgtgcgactccagttccttgtgcttggcttccaagcggatgctcttgtcaaccaaacgctggaaatccggatagtccccggagaccagacgcacggatagctcagggtccattcctgccaagaacttctcctgcttttcctcatcttcccgtacatcctccggggcgtaccgggccaggttgttaaactcatgcaaatactccatcacggagcggttgccttgcttcatctcccggaattcccttttcttaagggccatgactccggcgggcacatgggttctccggaaagcgacggtgaagcgggcccaagtaataggttgcccctctggctgcgtagcctggaaatggtccctccatatagatgcgggcccctgcagttggtgggcggcgaagatgactttctcctcatcgctgcactgcacggtgtctaactttttccccacggcatgcaaccaatccaacgcatccacggggttattggagctagagaaggtaggcggacggatgcggaggaactcggcgagtttagaatgttgtgggggtggtggtggagcattatgttgtggggggattttggatgtggtgcaggaaagcagtcatcatgttggcctgctgggcgaggatttgggtgaggatggcgttggtgtctggtggtggtggtggaggcggaggaggaggtggaggtgggctgccatggttgttgtggttgctgccttcgaggtgactgccttcaccggtagcagcacttctcctggttgtcaccatctgaaaacccacacagaaccagcaaacagagagagctgacaattaaagctaaccacccacgactaccataattcttgaatttattactgctattaaattggttcattaaggttcaagttgcttaagcaaataaaataaagacatgctccgacatagttataccacacaccggcataaccatgccctatatgactctagcagaaaaacaaacgagaagaacacacgcgcaagcctactaactgctcgtctactgctacgacgggccagggcggaaggtgagcagcaacgcatcctctgtgctgccaacgccggaggctccatcctcctgaggaacaacgggggcgggctcggcacgaggggtctcgacgaagcaggtccacgccagggactgacgaacaagctcgggcctggaggtactcttgcgggcggtgatcttcaggctgcggcagacgcgacgacgcttggggcgatagacctctccctgggcgatcttgagctgatgcagctgcgcctccactgcgtctaggtccttcttcagctgcagattctcctgacgcagctccaggatcttcatgttgttctcgaccaacccgcgacgcaccatctgatggaagtcgatacgggccacgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagtgcggcgttctggcaagcggcggagaaggaatcaccacccgcggtgactgccaacgaagtcctctcgggtgagccagtgaggatcactgcagtaacctcccaagcagcgtggggctctgcatcgtcaccctcttgctccgggagctgcttgccctggtaatccactccatgcggataccctaggacaacgcacatgccccgtagctccaaaacgaagccagtcaggtccagaccacgacggttgatgctgctggccatctacaaacaaaaacaaaagagaaaagcaacattttaaaggttagattttgacgataaatgaagcagcaggacagagagagactagaggattttcacaaataagaaaggatttttattttgaaaatattgctaaggcttgggatctacggctcgtcctagtgtcaagggggctctgataccaacttgtcacgaccggaattaacccaacgggcgttccttacgtgcatgtattattccttgtcccaggaggcaaggtacaccaaaagttgatacatttcagagtttatcaaacggaaccgtaaatagttaatttattacatgggcggcgaaggcccagcacacacaaagacaaacgagaaacagcggaagactagggcgacgaccacaagcgcttgacggcaggcacgagctagacaccaaagccttcatcttccaagggctcctcttctgggtttgggaaaaattgagcaagactgagtacaaccaccgtactcaacaagacacacccacaagtgcaggataaatgcaagggagtacaagggggttataatataaagggttagggtttgcagtaaacagcattaaaagacacttagttgctcaaagctattttgtaaacacgattctagagctatacaatattattaatcaaggtcgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacctacaagacacatcttcctcacgtgtaaccacgtcccgcataccaccacggtatacggacggaagacgtgacatagtttccaacccatcctagccatagacaagagtaccgacccaatcccacctacggccggaacccccgggataggtaggcaggactgagccccttgtagcaggacaccggccctgtgccatgacatctcgactaccgggccgcagctcgtgtagccttcatttgtcctagagatgtccatcgacccccgacttcgtccatctccatccgtgtacttttgtttataaccagactaagccacaaactaagccttacccactagacatgtggaagtacggtagtgctttgcaacagaggcccgaagaccggtccttatatggccgaggcgctactatcaaaaccatgcaccccgagcccagcctaaaaccattttgaggattttgaatagagggggaggtgtgaatccaattccacaataatccaaccattccatactgtccaggtgatatgaatattccaaagtctagagttgtaaaaccacctaatgttgcctatttaaccagcgaagcatctatctaaaatcatactagtggtaccgtgagtagagtgtccactagttggggttttgtttattctagggtgaacaaggaaataataacaataacaataataaggtcataacaaaggtaaataggcatggctagataaaacagtgataacgcgggaatttaaataaagcgataatgcagtaatttaaatcaacataaatttaggaactgggnnnnnnnnnnnnnnnnnnnnnnnnnnnnnnnnnnnnnnnnnnnnnnnnnnnnnnnn

SEQ ID NO: 61150 - DNA, 858 bp, Oryza sativa
ttcgtccatctccatccgtgtacttttgtttataaccagactaagccacaaactaagccttacccactagacatgtggaagtacggtagtgctttgcaacagaggcccgaagaccggtccttatatggccgaggcgctactatcaaaaccatgcaccccgagcccagcctaaaaccattttgaggattttgaatagagggggaggtgtgaatccaattccacaataatccaaccattccatactgtccaggtgatatgaatattccaaagtctagagttgtaaaaccacctaatgttgcctatttaaccagcgaagcatctatctaaaatcatactagtggtaccgtgagtagagtgtccactagttggggttttgtttattctagggtgaacaaggaaataataacaataacaataataaggtcataacaaaggtaaataggcatggctagataaaacagtgataacgcgggaatttaaataaagcgataatgcagtaatttaaatcaacataaatttataaactgggattcaatatgttcaaggatgatgtgacttgccttgctcgctttcccaaccgtcggcttcaacttccacgaagagcggatcttccgaagctgcaacgtctacacgaccaacggaaaagaaaaggcttttactctaataaactccatataacaagcagcaacaaagcacaaaaatgggttcatgatttcttaaggaaaaattagagacttgaacggtccaattccgagttcaaatggccaagttatggctatttgaagtttatatgctctttaagtgaatatttgcgaatttcttcatttaaattttaatttaaaaaaaaagtttattgcg

SEQ ID NO: 61151 - DNA, 12926 bp, Oryza sativa
  unsure (1)..(12926): unsure at all n locations
nnnnnnnnnnnnnnnnnnnnnnnnnnnnnnnnnnnnnnnnnnnnnnnnnnnnnnnnnnnnnnnnnnnnnnnnnnaacattgaccaattgggtaagttctatgtataattcaatagtatccatacttgtaagaacatcttacaacttcaataaagcctgtcttcaggtacaaatttcaatcaaagggtcccttcccgatgatccctcacccaaatcacacctagtgttgaaactgatcctcatgtcttcttttacgccgtcttggacaagccctccaaggaacctaaggaacttctgctgaaaacccctagagctgataaggccttgtcggatcctttagagacgaaagaccatgtaagatccttgccgcatgcttggaggggatcgcctccatcgccgtcgccagctccgcgagcgaagccgtcagcgagaactcgtcagggttcgccgggatggtggtcttaacaccacactccccgacgagctggtgtaggccggtgtaggtgacccacagcgaaccgcggatttccgacaggttgttctcgagttccgacatgcggttcttgagcccctgccattgccgctcgttgccggccaccagctccttcattttctggaggtcctcacgaacctccgtcaagtcatgcgccagcttgtcggcgcgtttgttcaccgacgacgctgccgccgccctcgcctccgctatctcgcgaactatgccgcgagcgccggcctggaggaggcgccccatctcgacttggagctcctcccaggtgaggacgtcagcaggagggcctcgagcaggcgcaagatcgccgacagggccgctgggcgtcgcctcacggctcctgggcacgaccacgacatctgtcgaggccacggccggagacgcgctagagttccctccagatccatcttgcgctgctttcacccgcgccgccctatgaaaggctgccatcaagacaggatgcgagagttcaacgaaataacaaaacctcgaattcatccacttacttctcaccaagcgtcacaagccgctgccgtcgcggaggtggcggagacgcatccgaggcctagagtaaaacgagcatgatgtgaggtcaaggttttccaactacgcgatgaaggaccatgagagcttaccgagggggtgggcatctttcgacgatttctgagcacggaggagaacatcctccctcttctcggaacgttgctgccactcgttgtgacagcagcggcagcaacatcggatgcctccttggcaatgtcctccttcagcgacgccgccgcctgatggtccacgagcggcccgatgatatcagtcagagggagagcctgcactacatgaagtcacagtgcgatcccggaagaaaaaggcaaaagggtcgctgagtacactcacgttgattacggcttcgcgttcggctgcccccttcttgcaaagagggacagggacgttgctcgccgttgaagggccgctgatcacgacttgaccgacgcggcgctccacggtctcgccgttcaaacctgtagatcgagaaccaaaatcgataagtcaggaggaacacacacttaaggagtggagtccaaaatactagaaaaataccccgaggagaaacccgagtcacatcctccagcccagaatagtcaaaggctggatgggctcgagcttggagcggctagatccgcctaccaatgaagtcggcggcgacttcataccccgacaaccctcgcactcggaggtcatcgatgacatcgataaaagactgaagggaaggggttaaggtggtttggcggtccaagacgaaatcttgtctggttgttcctcaggaacaacaatgactggatctgaattttctatctgaagatagaaccacctcgcccgccatttactacgagaagaggggcactagaaggggatgtagcgtgacttcaggccatcctgaagtcggaaaccgacgcatccagataccctgttggattccatccaacgcaactcatagtagaagcgaaagaggtcatgaaacggctctaccccaatgtaggcctaacaaagatgagaaaagatgatgaggaaggcgatagaattggggttcaaatggagcaaggaaagaccgtagaaattcaagaccaaaagaagaaactcggagggaggaggaagaaaaccacagagaatatagtcctcaaccgcaaccatgcggcccaggacaggttcaggttcagtacctcctggttccctctccatggtcccgcgaccagggagagcgccttcctcctgcaacttcttcagggacgcgctggtggaagtggacttatcaaggtccattgccgtcggagatcgccggagaagggaccgagatgagcaagctagggtttgtgcgggaatggagaagacgaagagcacttggaggcttgaaagttttttcgcaacaggcagactccaaaatggatccccaaaactcccttaaatagacgcactaccgacgatgcgaattccaaggaaagaagagagatgcccgccgaaaatttctgggtctgttacccacgacagtttttggacttcaatttaaattcactcacgcccattgaatttcacatagcgttgtcgattactccttgtctctacgatcttcacgccgagatcgactagtcgagaatgacaataaccccgacatcggaagtcgcgatcggttatatgagttcatttaagcagaagtcgggggctactgtcagggttacggataaggtataccctctacccttggatatacgctttacatctgcgcgtgtacggacgtccactgtatgttctaatgtcacaccctaaaaatccaaaatatataaattgttgtttaattggaattattagaatttattttaaaaagcctagaagagaagatctaattttaattaataaattccaatataaaatggggccagataaaatttcattaaatactttgcttaattctataattcctagatttttctgggatttatttgagctaaggaagtattttgaataaatggaattgcatttcatgaataatttaaattgaaaaaggtttttaaaagtctctttttgctttgggccgaaagtcggcccaaaacccctctctttttctctctctcctcggcccaagccggcccgcaaccgagctgccgctctcctctctctctctcccgctgacaggtgggccccacctgtcggactcgtcgtcctcctccggccgcccgccgcccgaaccctagcgccgcgccgccgccatctccttccaaattcgctcgcgcctttccttctccggtgaaatcaatagaggggaaatgatcttcggaatcccctctatcttttctcttatggaatcgtcggctaatttcgtttggaaattcgcggattcgagttcgattcagatcgatctctctcctctgaaccctagaccttccttcgccgtcgccggtcaccgtgggcctccgacgctgccttccaacccctttaaaaggacccccaagtccgccgctacccgtcgccacccttgccttcgtctctcgtcgtccgtagcgccctagccccgtgagacctcgcgccgccgtcgtcgccgccgctccagccgtgcgccgccgtcgctccagtcgtcgtcgtcgctcgggaaggtcgccatcgtggtcgccgtcgcgtcgccgtcctcgtccgcccctccgccgttgctgtcgaccgccggaacaccgccgtcgtcgtcaagccgaaggtcgccgccgcttcttcctcgacgccgtcgccgtccgttgatcttccgtcgccgttttggtcaccggtgagtttgccgtgccgtccgctacccgtaggtgctctccgttcgcgccgccacgccgtcgttcgccggtgagcatgcgcgcccgagccgccgccggtggtgacgtcgtcgctgacgtcatcgtcgtcgtctctcgtggtctggccgtggaccgttcgatctcggccgtccgttttggataggatcgatctcggccgttcgtttccgtgagccgccgccgtgcacccggtccaccgcaaaccctagccgctgacgcaataattcctttttcctgttcaaaaataattcattattgcgtcataattcaattaaaatccatataagtgttttaatctgatttaatctttaaaaattcataactaattcatcttagctcggatttagttggttcaagtctctaaatttttctaaaattgagatctacatgttaaaaatatccacatgtactgctcatgcttgttattgtgctgttttggtgattttgctccattctgtttagattccgatgtttccggagagtccgttttcgcaggagaagaatttgaagagttccaaggccagcaaggcaagtcacacagatcccaaacaaccctttgagcatgttgatcccgtttaaagctactgtttctattcaactattgcatttatttttgaatgtcattgggtggaattaacctattgtttgttatagccctttttgttcttgattactttactccttgataccttgggtgattataacttgactagttgggctatatatattggttcagctagatattagatatgattgcttagccatgcctagaaacattagcacactattgggataacttatgattcactattatttaatgatggcttaatgatagttcacgatggtcaatcgtgattggttaattaattatttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaatggtgcgctgtggtggattgtgttgtgcgaggggtactatcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtttcacacttctcatcataataaaagatgctataactgatagtaatttgattagctcctggtttggaatggtatattcctggtttggagatagaactgtgcagccgggatggttgttcagaatggttgggcctatgcaacagggtatgttgtatagcgttggattaatattgtttaattatcacttaactgttttattaaattctgaaatgtttattaaatgctgtttatgcaaatgaaaccctactatgccatcctttgttatcctgagcacttgcatatttgctgcgtggcttgctaagtatgtcatatactcaccttgcaatcattcatcagaggaagagttctacagtgatgctgatggtgtggaggattaggtgtagccttggtcaagctgcctgtggagtggagtcgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagctaaggaaattcatcatggagtccatagatggagagattcctacttggataggactgggttgtcactgtatcgtgtagggtccgatgtctccgagtcctacttggagaccacctgatctgcggtataaaaggtaccccccgggagaacctaaggcatcgaatctcagaactaagaccaccacagcttatgaagacggagcctacaggagccaagtcgccgggtgatttagtcgaaccaactcaactacgatctcgtcggtatcatcgagttctgttattccctttgtaacttgtggtttccattatataatcccataccaactggattagggctattacctataaaggggcctgaatcagtataatctttgtcttctgtttccttgatgtcgtactacgtagatcctcgtaccagcgtaccccagtaccctctatatccggtctacgggtatcccccgtcgacaattgtgccgatgcattatttatcacaaaatttatttttagataaataaataaaaaatatgtatttactttttaaaagaaagttattaaaaatgaggagcattcatacaaagttaggactaccaatgctcacaatatgttttttatgaatgctgctgatcaaaaatatccgttgtcctattaaaatttcaaatataaaatttaatttattacatttgtttatttttcataatttatgtcaaaattttgtacactaattatttagtctcattagtttcataaaatgcacatactatgcacttgaacaaaaatttcaatcgtttttcaagcatatattcaaacctaaagcatcaagagtaaaaatgacatttgcaaccaaacgtaatagtgaaatgatggaaaatgtaacggtaggggcatggaagggatcaagttgaaatttcagggatatagaagggatcaggtaaatttcaggggtatgaaagagattgagtgaatttttaggggtatacagggaatttctcataatatgaatgatatattggagtaggaagatagatacagaatgatctattttggatgactattcagaccaagatatggagtaccgatactctagtgtgtgatatggagggtaaacaaaggaaaatagtataattataaacagtgttccttgttatgaaatctatcttattgtggatgaattaaattatgaatgcgaagcttactacagaagaaagcttacgccagaagccaacttacagaggaagccagcttacggcgcaagccagcttacaggagaagcccgcttacggcgtaagccggcttacaacgcaagccagaaggtccaaggcttacgacgtaagtctccaccctcctccgcctataaatagggcccagaaggtccaaggcgaggacaaccgatcttcggtctcctgcttctcctcttatagcttgtactcaaatccagaagaaataaagcttccactcactcatactttctatgttcaacaactctgtgtttggtttgcttgtgtgctgatcagtagaatagactggtttctcaacacgttatcagcacgagactctaccgagctaaaaaggtaaacaggtgagaaatcagtttctactgatcatcttgctctttatatgcaaatcattcttctgctatagttgaaataagcagaagagcatggtacctgaagtaccatcccccgatattatctcaacgatacacaataacatcatggcggctctgccgccattatcgttgaattgctacagttgatacatcctctcagcaacgcccggtaacatgatggcagctctgccgccattaccgtccaaaggcttgagatggtacatccccttagcactatttgataacacaatggtggctctgccgccgttatcgtccaaatggtaggggcgatgtaggtgcctgaagcaccggcatggcaacttggacggctccgcggccgttgccaccaaatatcggaggcaaacgaaccttctgcacgaccctgaagtgtcgttttggatgtcctttgttttatggacatcacccatatgggcccttgatgccactaaggtcggctctgccaccatgaagcatgggctcatagtggggaagtgctacatggtttatcttactttttacagtctgcacaatatacatgaagttgtgcccatgtatactcttcgttttgttttacatgcttactttgttgtttgcatgtctttcataacatttattttattgttatgaaattgatttcctagcatgattgataatagttaatcaagcaatatgtaatcctgaagattacttaagttaatttgctaggaaagattctatgggaaactgtgtgataatcctaaagattacacacactagtaatcctgaagattacgcatgaccaattcatgtcgaccctgcacatcgtatttaccagtcgtaaataccaaattatgttgcagaacatgtcggacataacaaagaaggaattcgccgagcttgccttggatggtagtaactacctcacttgggcattggacgttgagattaaactcgactccattggtctcgatcatactattgtgctgcccgaacttggcactgtggagtctacgaaggccgagaaagcaaaggcattgcatttcttgcgccaccatctccacccagacctgaagtctgagtatatgaccgagaaaaatccactggtattatggcaatccctgaaggatcgctttgaccagcaagggtcaattgtgctcccacaggtacaacatgactggatcaccctacacttccaagactacaagtctacggcggcgtataactctgccccccataggatcatttctcagttgcgtttttgtggccagaagatcactgacgctgagatgatcgagaaaaccttatctacctttcatcccaacaacatagtgctgcaacagcaatacaggaactcaaagtacccgaagtactctgatcttatctcagtcctgttagttgcagaaaggcagaatgaagttcttctaaagaatcattctgctagacccactgggtctatggcagtgcctgaagcacacgccaatgttgttggaaactcgcgtggccgtaaaagaggccatggtgagaagaaagggaaaggtaagggaagtatcaaattcaagggcaagagcaagggtaaacccagaggtaaaggcgaactcaagaaggttacaggtgaatcatctggggaaaagcaggataactgctatagatgtggaggcagagggcattggtcccgtaactgccatgtccccaagcacctggttgagctctaccaacaaagcatgaatgagaaaaagagccaacatgagtcccacttcaccattgagcctgaagctcagattgaaaagcatgatgacatgcttatcaatgttaaggatggtggggacgtccgtatggacgatgattggaacaaccttcttgaaaaagatgataacatatttggagacctgaagtaatctcctatatgtcagtcatatgcagtgttccgcatgagtagcacatgtagaactttggtcataaataatgctcctgaagagcaagcttagtattttactgggcctgaagtccttgtaatgtttcccttaatagaatcaatttactccatgtttaatttcatttatgtttatgttctataaacagaccttatgggaatcccatggcagaagaggatatatgtctagtagacaatgccaccactaacacaatcttaagggaaactatgtatttccacaccttaactaagaaaactagaaatattatgaccattgccggaagcaatgctcatatagtaggcaccggaagtgctactctagttctccctatgggtacccatatctttgtaaaggatgctctattggatcctgattcaaagcgtaccctcttaagctttaaagatatccgtgcaaacggtttccatatagaaaccgagattgagcaagatgctgaatatctgctcataagaaaaatagatggatatcaaaagcaagtggtggaaaggctcccttcattgccatcgggtttgtactacacgtacataaaacccactgaggaatatgtggcgatgaagaccatatttagaaacccagagtcatttagagtttggtatgacaggctgggtcatcctgggttgggtatgatgaggagaatcatcagcaattctgctggccacaatgttgaaactaatgacttccctaatcctgaagattttatttgccctgcttgtgcaaaagggaagttgatcattaggccatccctcctgaagattagggatgagtcacctgttttcctggtaagaatacaaggtgacatatgtggacctatccagcccctgtcgggcccggttaggtatttcgtggtactgattgatgcttctaccaggtggaccatgtggacctgttgtccacaaggaaccatgcttttcaaagctaattgcccaaatcatcaagctaaaagcttgcttccctgatagccgcgtacaatccattcgaatggataatgctggtgagttcaggtcgaaggcttttgatgattattgtttagccatggccatgggcattaaggtagaatattcagtaccacatgtccacactcaaaatggcctagctgaatccttgatcaagaggatcaagttgattgcacagccactgttgcaggattgtaggttgccaaccagttgttggggccatgctgtgttgcacgcagcaacactaatccaactcaggccaactgcatatcatagtacatccccccttcaactagtgcgtggaaaagaaccaagtatttcccatttgcgtaatcccaccaccacagcgtacttctatgggaccccaccagaagttggggatatacgttggttatgagactttgtccataatcaagtatcttgagcgtatgactggggatcttcatatggctcggtacgctgattgtatctttgatgaggactattttcccagcattagggggagaaaggcatccagaagaatgccgagatataatatggaatgcaactgggatgcagtccttagatccacgcactagtgaagctgaactagaagttcagagaatcataaatttgcaaaatattgtaaataagttgccagatgccttcactgattacaagggagtgacaaggtcgcatatacctacagtaaatgcgccggaaagagtagaggtaacccagaaggttactgactctgctcttaccccccatcctaggaagatggggagacctccagttgaagaagctcaacctgaagttgagaaagccccagaagaggcaactcaacctgaagttgagatggtcccagaaggacaccatcctaaagatggagaacccagtgccttacgcgcgtaccttggctctggaagatcggaacactccaactcggtcgttatgggaaatcacgatgagctggaggaaataaatgaggagatttccactaattgttctgatacaggagagttacatcatagaaagaccactatcgtcgacattcactttgcctcaaagattgttgtcataatggatccagatccagaaccaaagtccatgattgagtgccagaagcgctcagattgggacaaatggaaagcagcaatagaggcaaagatgcggtcgctttataaaagagaggtttttgggcctgcagtcccaacacctccaagaatcatccctgtaggatgcaaatgggtcttcctccggaagaggaatggccaggtggtgaggtataaagcaaggctagtggcacaatggtccatgcagagacccggtattgactatgatgaaacttactctcctgtgatgagtggaatcacgttccgatacttgatctcaatggcaactaatatgaacttagatatgcagttgatggatgtagtgaccgcatacttgtatgggtcactagattcggaaatttatatgagggtccctgaaggactcaagattccgaatccgaaaggaaatcgcaacatgtatagtgttcgcctgcagcgatcattatatggattgaaacaatccggaaggatgtggttcaatcgattaagtaactatctcctgaagagaggttacttaaacaatgatgattgtccctgtgtgtttataaaatccctgagatgaaggacttggggaaaaccaagttctgcttgggcctgcagctcgagcacctccctgaaggagtgttcatgtaccagtctacctataccaagagggtccttggtaagtttaatatggataaatgtcatcctttgaaaacccccatggtggtctgatccctggaagcggataaggacccatttaaacccaagaaagatgatgaggaaatgttgggacctgaagttccctacttaagcgccattggagcactaatgtatctagcctattgcacaagacctgatattgctttcgcacttaatctattggctagatatagtgcaaccccaaccagaagacattgggttggcgttaaaactatcctcaggtaccttcgaggtactcaagatcttgggttgtggttcccgaagaaccaagatccatccatggtgggatatgtggatgctggctatatgtctgatcctcataatgccatatcccagactgggtttatatttctttgtggtaatactgccatttcctggcggtctgtaaagcaaaccctggttgcaacgtcaaccaaccactcagaaataattgctctatatgaggccacacgagaatgtgtgtggcttaggcggatgatcggtcacatccagaagtcatgtggcctaaacattgataacacccccaccattatctatgaggataacgctgcttgtgttgcacaaatacatatgggctatgtgaaaagcaatttcacaaagcatattgttcccaaattcttttatccccacgagctccagaagagcggggaaataaatgtcctgcaaactaagtcatgtgaaaatctcgcagatttatttacgaagtctctgccagcctcaagtttccacagatgtgttcgtggcattggcatgagacgacttagtgaattgcaaggatcagggggagcaaagnnnnnnnnnnnnnnnnnnnnnnnnnnnnnnnnnnnnnnnnnnnnnnnn

SEQ ID NO: 61152 - DNA, 2712 bp, Oryza sativa
  unsure (1)..(2712): unsure at all n locations
nnnnnnnnnnnnnnnnnnnnnnnnnnnnnnnnnnnnnnnnnnnnnnnnnnnnnnnnnnnnnnnnnnnnnnnnnnnncaggggagtggggctgtgggggcaggtagtggggctccagttctccaccagcacaagggtccaaggcacgctgagtcagacccacttgggcggggcggggcgcggcgcggcggttttggttgctgcccgacacgcgaatccacgaatgcatcccatccatccccaccagcacacggaaaagcagggttgaggtaggggtaggacagaagcggcaaccacgcgacgtgcggacgcggcgcggcgcggcacgcccacccaaaaattccccgagccgtgccgtccaacaccactcatccgatccgacagcccgcgggagcccgaccggccgcggagacacagaaccggccccgcgcacacccccaggccccaggaccttggaacttcctcctcattcactccccgtcgcaccatgctctccgttaaccatagtccctctaaccacggttagttgctctccgagtcactctccaccgatcccagggttcttctacctctgcctgtctatatagctccctccccggcttctcatccgccgttccctccccctcgctctccctgctccggtatagctagttgagctctgatcgatcaggttgcatgagacggagaagctgagtgaggctagggtggttggttgtgatcatcaccatgagctgcaacgggtgccgggttctgcggaaggggtgcagtgacggctgcgtgatgcggccatgcctgcagtggatcgacgccgccgacgcgcagggccacgccaccgtcttcgtcgccaagttcttcggccgcgccggactcttttccttcatctccgctgtccccgaggcgcagcgacctggtatgtagaatacaatccatcacggctctgcacgtgtaccgtacatattcctgtacgaagcagctgaccatatgtcgttggttgcgcgcagcgttgttccagtcgctgctgtacgaagcagcggggcgaaccatcaatccggtgcacggcgcggtgggcctcctctggacggggaactggcccctctgccaggccgctgtcgagaccgtgctgcgtggaggcgccatcggccctctgccggagctcggcggggcctgcggcggcgctggcggggacctctacggcgccgccaagcgcaacggcggctggtctaccttctccactgcgaagcgggtgaggaaggccgaggtacctgaagccccgtcgtgcgacctaggcctgtgcctcagccccggctctccgccggcggtgggggagaggaaaccagcactgcggccggggacgccgtcaatgagctccgatgagtccggcaccacaaccggaggcgaaagggatcctgtgctgctcaacctttttgtctgaggccggtcgtcaagctagctaatactaatccttgcttgacctccgtctactggatcccggcggcgaagcagtagtaattttttctcgccggcgagcctagtttattggcatttttttttctttccctttcttttaggagtactagtctacgagtcttggtttttgccgtgtacgtagaaaagaaattaccggccggcctggacgccccgtttgcgtgggcgagcaactttttaccctttttgttcgtttaaattatataaataatccttcattaagctatatagacataggttgcgttcgttcattggagacagcggagattgttactcgttttccgcgcgcacgcttttcaaattactaaacggtgtgttttttataaaaattttctatagaaaagttgttttaaaaattatattaattcatttttgaagtttaaaatagttaatacttaattaatcatgagctaataacttaactcgttttgcgtatctttcccatcctctctccctcgaacacacccatactcatcttgtattgatccctatgacttgttatgagaacgattggagctgcaggcacagagtctagatttccaaatgaaagggctcttctacagaagttttggagaaaaataaattgttctcttccttcatgtcaatgttcttctcacggggtgtgttttgctggtgaaagagtgcaagtcgtataggcggatttgggggtagggagcaaaggcgccgcgtcatggggctacggagttgacgaggtattgccgcctcgaggataggagggcgctgagggtgagagagaaagagagaggagagcccacacagtggccgacacggatgctccaaaagtcctcatagttgtaccgcttgtacgatggacaagaccgggcacgtcacacgatgcagcacacacgaccatgctgtggctacaagttctacgcacgctctagtgtaccgtggggtgaagttttactctctccatccataatataaaaaattttagatgaatgtgacacattctaactaatacaataaatctggacaaattatatatcatatatgtcaaaatttattgaactaagatgtatcgtatccatccaaaatcccatatattattggacggggagagtattttcgaaaaaactggcttttgttttttacacctttgcatggcaatttcagtgcagttgttaattctattttcaaattatgtcatgtacaagttgctcatagtgctgattccttagcctaagggatatactccctccatttac

SEQ ID NO: 61153 - DNA, 3753 bp, Oryza sativa
atatagttcatccccactaagtgtagttaatattatttatctcttctctcgttaagccacatcaccctaattatttctaacctttggatgatagatctatggctcaaattatctcttcttaatttcttctctcgtaaaatcatgcaatctcaatttttttaggctcaaaattgtatcaatttgttttccttttgataatcttactacatcttatttgtacatattatgtaacataattttccatagcaacgcggcagagtatttactagttatataggattttagcatatcatccgccaatgagcccagaacaatcgtgcaaggttacgggatgtggatctgccatcgtcatgaatctattgattggcacactaaccagatagttgctttggtttaacatttgttattcggtgagcattggtagagaaaccatctttggtcggtcgacccaaatctacaatagtcccggttcgattaaaaactgagactaaaaagtcccggttgttgttaccaaccgggactaaacattatctttagtctctgttggtaactccaaccgagactaaagttcatctttagtcccagttaattccatgtcaggccgtgtcagggccctaggatttttagtcccggttagtaacacctaacgggactaaaaacttatttttagttccggttgatgttactaaccaggaataaaaatcaaaaagcactatataatccctagtacctatactctttttccgtccacacaacaaactcctccctctatctcttttttcctgtctaatttcttatgtctttccttatctctaactctggcttttctttcctttttttccttcaattcacagcgaagaagacgactggcacgaggagaacgggccggccgggcggcggcctgcgtggcggcgccagggtggcgtggcggcagccggcgcggcggcgcggggggccgcgcggaggcggcctgcgcgcgcggcggcgtggggggccgctcggcgacggccggccggcaaactgcaccagctagaacgcccgccctgtcctccgatcctccttctgcatatgtaaatcaacacatctctatatagtattgtgtggcctctgttgtatgcctgcccaccaaacgaattgtgtctctaactcgtgagattgctgtcctcgtttggtcgtattacatttgaattaagctttaaacttgtgatgtaatttttttaagagtttgtgatgtatttggagatgatctatttgaggatttggagatgttatgtgatatgtgatgatttagatttgggatttcttggtatgatttgaggatggtgtgaaatcaatattgaatgttaaaaacaatgaaaaagaaataaagaaaaaagatctttagtgccggctgataacaccaaccggaactaaagatggatgtttagtcccggttatttgaaccaggactaaagatagcgatctttagtcccagattcgtagtcccggtacagggggttacgaaccgggactaaaaagcacttctccaccagtggagattatgctctattggaacctagaaattttggaaatcttgtttattataggattaagggactactccgtagttgtgctactttgttttcgatattaaggtaaccaaaaacaataaatagtgtagactgtgaaagttgttcgatatttggggcttgtttagattgtagccaaaataaaccttaccaaattttgttattaccaaaattttaacaatttggcaatattgctaagttttgtcaggatttattatttattttttagagtttggtaagaaactaaatggatgcacatatttgacaactttgaaaaaaaaaatatggtttgaaatggcattaatctaaacaagtgcttaaacaagtgcttggttttgatttcgtggaatcttccagatgggaaagttgaagggaaacattaccgtttgaccctgtaaaaggcaaggagaaaaatcttgcatggtgttgcacgcatattctgctataaattattcctgaatatgcagtagtatatctctcttaaccactaatgttgatccttttatcttctctatcgatcaataaggcaaatattttgccttaatttcaattttcttaaaaaactaatgttagaaaaaagaaagttgtttgcatccgaatctctacatctatgtttacgcagacataaaggccaatgttgatttgtgtttccataaacattttttagttatttatacatgtatctagattatagataatttaaattagtagttgaatacaagtgctttgctacagataataaaacaactttatctgtctaaaaacacaactacctatgcccttgtctttaacaaaagactaaatttgggatgataaatgtttgtggttgattgagatgagaacataggtggagaaatggttgtattttttagacaaatttaaattctagaagtagttatattctaaaatagatggagtatattataatattacctaaataaattataaatatattttctataaaatatattatctatcatgcttgtcagtgtcaagcgtaatgcataccatacatggattcatggaatatgacaataccatatacccgattgtatacgagaaggtgtctttgattaatgaaatatggcggataaataataaattagctactcggaatagaaggtgttagagtctaagtcggagaagataagatctccttgcccgtattctgttttatctctccgattctctgagttctacttgaagaagaagaggatctacactatatatacctatgttttaaatagcgggttaaggcatttagcggttagcgcttctcaaacagctataacagcagttatggcggtctaaatggagttatagtgcctaaattgtacatgagatcaaatagttagaacccttatcaaaccactatagccggagatagcggcagctatagtgggagatttaaaactatgatatatacaaggcccccgtgtgttcagggaggggcatcgagttacaagtcatagccaaagccatattaagaaacaatttggaggaagccagaaactgtattcgctgaatagaactcgtcggaccattctcgacagcttctaattggtgaattagactagttttcctatttcccattgtaatctttgtgacatcctatccataaatccagataaactagactagggttattactctccttttgggcccgaaccagtataaacctttgtctcttgcctgcttgatctgatcttgtgtataccatggttccaataatctttatactttacaaattaatctcgtcttcgggtatagcccgtcgacaatgctgctatagggaatgttcatcttaatttaactttagatgtgactatccatttagatttaatttattttttatactaaggagtttgagggataatttataaaagtacaacggagataggtgggatgacagatttactgtccgcttcactacttttttataagtaatatagaaagctagaagaccactctaagctggtccactttgcatcaagttgcattattattcaacaatgactatgaattttaaagtttttctgagaatagtagttttagggatactctctaaaaatctattgagtaatcatgaaaatagagctagataacaaaattgaaaaaaaaacttttaaaattaggtgtaaacacatgctaaaatgtggataattatttactcgtttggttcagg

SEQ ID NO: 61154 - DNA, 1129 bp, Oryza sativa
  unsure (1)..(1129): unsure at all n locations
catcggtgacgggctccaaagaaggcccgattgagatggcctgaatgcccgtcaccgatgactcttatcggtgtcgggcttctatttttgctcgttagagattagtgtgcgctcgttagagatgacttttttttggcccgattgagatatactttgcacactatatatactccagcagtccgttgtctgtagttatcccactgttcactattttggtgggaggttgaagggggcgaatttatgtaatttttttgcaaacaaaaataggaaaatcataaaagtaagtaaaagggtactactaatttcctattaatttagtagtacttatgttatgagatgttaactaatattttgttcattgttcagcgatggatcgaagttagatgtacacgactggcttgaggcgtcagtacaaagagtatagagatggcgtattaagttttatgaaagccgcagtggaggataggataagaagaaacgataagtacatgtgttgtccatgtagcgattgcaggaatgagatttggttggacgatgaaaaggaagtacacacacacttgatacgccggggattcatgaagagatacacatgctgggtgaagcatggagagcaagatctgggtactgatggtgtagctgcggacggaagtggtgcagacaatcatgaagaaggagatgaagaagagcatgacatgtttgtcccatctccattgggcggtgaaatggttgatgtggaccctgatatgctgcaagacatgttacgtgacgttgatgacgtagctatgaacgagacagattcaatgaagttcagcaggttggtcagtgactcggagactcctctatacgcaggatgcaagccaaagcacaccaaattatcagcaacattagacctaatgaagttgaaggctagtagtggatggtcagacaagagtttcacagaacttttgggaatactgaaggacatgcttcctcaggagaacacattgcccgagacgacatatgaagcaaaacagggtttgtgtcccctagggttagagggtcggagaattcacgggtgtccaaacgattnnnnnnnnnnnnnnnnnnnnnnnnnnnnnnnnnnnnnnnnnnnnnnnnnnnnnnnnnnnnn

SEQ ID NO: 61155 - DNA, 1826 bp, Oryza sativa
ctgttctcccactgtgtgctactgccgccgccgcgtcgtggatttgtcgcgtggggtgaagtttttgggcttttgtgtgtcgctgacggggtggggcccactccgggttggtcccacgtgtctgtcgccgtgtggcgggggtctaatcgtgcgggcgtttttttgtgcaggtctctcgccgttgatgccgccgccgccgctcgccgccccggttcccgcggcggtttctccggccccggcgacgcctcccgccgtcctctccccccgcaagctcctccgcccgcaaggtaaaagcaagcttcctatccccgattccctcggcgatgcttatctcgccgtccgattgaccgatcggacggctgctgcttggcccacgcggccggcgctttctccgacaagcctctgacgcaggccgtgggggccagaggggggggagcctgatatgtggggtccacggagacgcctcctgttttgtcctcggagacgagacgatccctttggcgcgccatgattccgtcgccctcacattccattctgtcgtatcggagcatgacatgtgggcccgtgtctgcggtgctctcagtttttcgtcgccgcatgcatgcagtgactgaccggtggggcccgcttgctttcaccctttttgcaggcgcggacgtcgtcggcgtcggtttcgtctccggcagcggcggcggaggaggaggagacggagtacggacgcgccgggtggacgacgggtgcgcgggggcggacgacatcgcgatctaccaggggagggcgacgccgctgccgagcggggtgccggcgtacacggtggacgtgatgaaccggtgcgccggcggcggcggcggcaacaaggagtgccccatcgcggggatccacgtgcggtgcgggtggttcagctcggtgagcctggtggacccgcgcgtgttccgccggctcggccacgacaactgcctcctcaacgacggccgcccgttcctcgccggcgagaccgtttccttcgagtacaccaactccttcccctacaagctctccgtttccgtcgcaacctgcgtcgtcaaccccgccgccccatagccgccgtcaatcgccgcaaggaaaaggtgcacaaaacaaaggaaccgaaagagaaacggtggtactagtgacatctcttgccttactagtttttttgttcatttctttttttttgaccccgtgtcagtatcactcacagaacaacagctcaccatttgctacgcctcacgcagtgcgtactcctccaacatgtttgaaaccctcattatactactactagacctgcagtatagcgttagcagtagttcctgcttcttgcatgcagcttaatgttgttgttaagttgcctgtcaggcagaccaaagtgtaattaaccctgttttactcaaatctctcgggtggttttggcgcggatggaacaagtttatttttgtcactctttggttgtgcttccctctcgtggtactgtgctttgaggtggtggttggttgtagcaaaaccgggaatgaatcaggtcacgtgtaagtacaatcggtgcatgcatgggtgacagctcgtcggaagtggaattaattgcacttttgaggctaaaatggaatcttctctttctctccccccctctggctcgtctcaggcccgggtcaagttaacaactgtagacatgtccttcaaccttcgcccttcgtcttgttgcttctgctacgattgcaggtttgctacactgttcgttgcagcaacaaagcatgcatgcttgcttgctttctccttttggctcaagcttttgcatgtggtttggcccctgtgct

SEQ ID NO: 61156 - DNA, 1275 bp, Oryza sativa
caaggagatcccccttggcgatgatgtgtccaagaccgccaaaattggcggaaacctgggcgccaaataggaaggcgcgcttgtctccttccttcgggcaaattctgacgtcttcgcatggaagctgtcagatatgcccagggtcctcaaggaggtgatcgagcaccgctttgccgtccggcaaaaagtgcggcgtcaagccctggagcgacaggccttcatccgagaggaagtggcgtggctcctggaggctgacttcatccgcgaggttatccatccggagtggctggcgaacctggtggtcgccccgaaggccaacggcaagctccggatgtgcatcgactacacggacctcaacaaggcatgccctaaagatcccttccatctaccacacatagatcagatagtcgactccactgcggggtgtgaccttttgtgttttctagatgcctactctgggtatcactagattcgcatggctagggaagataaggaaaaaactgccttcattactcctgtgggcaccttttgttatacaactatgccttttgggttaaaaaattcaggacctacttttcagcgcatgactcgtattattttgagtaatcaaatagggcgcaatgtagaggcgtatgtcgatgacctggtggtaaagacgcgccactaggacacgttgctgcaggatttggctgagactttcgatagtcttaggtccacacgcgtgaaactgaatcccgataagtgtgttcggtgtgccggcgggcaaacttctcggttttctagtctccttccgaggcatagaagcaaatcccgagaaaatacacgcgatagagaggatgggcccccctacaaacttagggatgtgcagtgcgtcactggatgcatggccgccctaagtcgattcatatcgaggctgggagagagggcgctacccctattcaagctcctcaagcgctctaggccgtttgtgtggacggaggaagctgagcaagctctcaaccagttgaaagcttacctcacctcccccccatcttggtagccccggggccggaggaaccgttgctactctacttggccgcaaccccccatgtggtgagtaccgccctagtagtcgagtgcgaagagggcgaaccggaggcccctttaactcgcgatggccctacgtctcccaaaggcccggagcccgaggcccccgtgggaggaagggaggctttggcgagtggtcctaaggcctatgatcccgacatgactcgagacccccccggggcccccgag

SEQ ID NO: 61157 - DNA, 1224 bp, Oryza sativa
gcccaaagggagcacaaacgcgggccgcgccccgggttgcgccgaaccctgggggctcggaagggcctacactcggccgtccccgaccccttgtcgttgtagccccggtctggcaagtcccgctgggcggcttcctcagggcgtcggttttgcctttcaccacttaggtaccacggaccgagcgcgggtttgccttttcgctagaacaagcccgagggggggggggaggatggggtaaaagcggcatttcgatcacaggcagattaattatatacttttgctcttgttttttcctctttctatgccgcaggcattcaatggaaaaagcaaaggggtaaaaagtgcgaaaaggaagttttaattgcagaacaagacaggaagacacgatggcctaaatacaagaagtgtctgctacaggcacacaacaatgggaaattgaaagcgcgggtaatcacggagtgctcgggcccccgaggccggtgccgctaacgacgttgtaatgccccgatttttgttcgggaataaaaatcaattaataatgcattttctagaaattaaataaaagttaaatcaatttaatcaagtgaaattatagaggaaattaaaaatttcctttaaaaatcattggccggaaatattttgtaatattctctttgccctaaaatactctccggatttttcagcaaattttcggagctcaaggagtaattataataatacaaagttcatttaaaccaattaaattaaatgaaaaacaaataaaatccctcccctccttccttgggctcagcccaatcccttccccctccttccccggccaggccggccttccccctccattcttgggccgtcggcctgttcccctttccccttgtaaaagtccgcttcacgtcctcctcagcctcctctctctcactccggccgacaagtaggaccgcagggcccactcgtcagcttctccccctacctccatccggccggctgaaactgccatggccgctggttccgccccacgacgccgcgcctcccgcgccccaccccgtcccgtgagcgcgtggactcaatccccacctcctcttcccccactctccccacggaatcggcaccgaaccgctgccaccacccccacgtctagctccacgtctccggccggtttccacctctctcaggctcaatcccgccttccctcccatcttcccctcatccgtttcctccatttttccc

SEQ ID NO: 61158 - DNA, 3156 bp, Oryza sativa
tctggttccttgggtttttattagagttttcctcgttttgcgtgccaaggtgtagtttccgttgtttcggaagttcgtagtcgcgaggaaaagagttcagaagatcaaagtgaagaagcaaggcaagtcacacattccccttgagaattttgatcctaatttacaaatgttttatcgtttacaaataaaattgcatgtcttgctaattacatgggatccgggtattacctatctgcttgcttgtgccatatttacttgatatctgtcctttgtcaaccttgggtaataaatcaactagctcatgttacttatgtgacctagctagaactatatgcttagccatgcttaattaccactagcccggttgatgggataattatagtattagacctttttagtgtcagaatgagctgcatgctcgagacatctggccatgcttcatggtcgtaattaccccactaaaatgtgacttcatggtgggctgtgggtgcatggttttgctagtcgtgcccatggcaattaagaaccggtcacgggaaaccctggaagaatttatcgtgcttaccacaagccagcgtgggcaacagctgggcttgtagtgtagctttcctctagccgacgcatcaggcaagggtgggtgtgatggaatttggatgggccctgcgacggcctatgcggcttccggattcacctaggcacgagaggggactgcccgctgccttgcgaggagtggggtgaaattttaggtgtggtgtggttgggtaaaagggaggttatgagaagggtcctatcacgacctctttccagtatgtcgtggtggcatgtcagcgcacggaaacgtgtcgtggggctatgtcttgtgggtacagttgtacacctctgatcagagtaaaactattcgaatagccgtgcccgcggttatggtcggtcgaccagattcaccgtgattagtctcacccctaataaatcgacccaatgcactgtagttcaggtgggttggttgggcctgttcaacgtggtatagcgttgatcagtggagatttaatagtaccttaattactcaatagttttactgttttgctcaataaaatgttttacaaccgcctttatacaaatagccacaagccattcttgaatcccgttgcacgtctgcatcattggtgtggcttgctgagtatggtggttgtactcagccttgctattattccccttttttcagaagtgtagtgcttctgagctgaagacgaagttagaagaccaaggttcagaccccagttaagttttgcctgtgagtggagctgaagccccgctaggatcgccttttcccgctgttgtcattttctttcggtgtgaggactaagtgcctcttctgtaagtatttacgctttatttatgtttggaactgtatattacttgtcgttttgtgtaccctggcttgtcctggacagggatttaatacacaaaatagtccggaaatttgggttaaatttctgggcgtgacagacgtcgtcccagtcctcgccgccgaagtcgtcatcatcgtccccgctcccgctctccttgtccgaggcaagcccgaaggtgaaccggggggccgacccctcgaagttagagacgatcgcgtcggccgcctcccggacttgctcccgagcccttgcctcggtccctggaggaaaatcctcgagtgcgcgccatgggacgaagtcggggtcacgcgcttggtggctcgcgaggaccagttccaccgcgtcccgcgccaagaaagccgacgacgatttcacagtctcgccgacctccttctccagcctctccagatccgccgccagcccgtccagccggagtgcgactgccggcgtgtgggcggaagcttactatcccggtgcacggaaatgccgactcggcgccccgcgcgctccagccggtcgacggcgtcggagagcttcccgggtccgatcccgttggtgaggcggagggccgcaatctccctggcctgatcttgcaccaagcgctctatatcggcgagagtgctctgagccatggcaagctggctccccaactccgcgccgccgggctgcccgcccgccgccaggtccttctcacgggcctccagctcagaagccctcgccgctatcgccgcgcgctcggcgcgagcactctccagatgccgagcatcgcgcccggcaacagcctcctcgcgttttgcgagctgctcgcccagccggcgcgaggccacctcatggcggttcacctcagcttcgcgctcggcgagtacaacgtcccgttctcggcacgcctcttcccagagccgtagctcctctgcgtggcggtccactgaagctttcgcggcgagggtgatccggtcacgctcagctgcggcctcttcacgaaggtgaagggaggcctccacctccgctgctgttctctcgtgggcggccaaggtggactcccgcagatcgagcagacgcgctcgctcctccagcgcctgagtccgcctctacagctcctgggctcgctgcgcctgctcctggccacgcgcgttttgctcacgctggctctgatcgaggacctcgattcgccggcgaatcgtggtctcgaactcctgcgtggagcggacacgctcatccaaggccctgcgttcggcctcgagcgccgctgtccgagcccgcagcgaggcatcggcctccgatacccgctgctcttgggcagcagctgcgtcgaggataccgcgggcgtccttgatcctcttcgccagatcctcggcatgggcctcgtactgaaggcgatgtcacccagtgcttcgtccaggacgctcgaggcaatcagcgccgcctgccgctcttcctccacctctcgcatgacggagtccagcgactcctcgcgcgcctggattttggctagttgggcttggcgcattttgcgtcccaccctcaccatgtcgtccacggcgcgacgcccctcgtcaactcgcacgcgagctgtgcccatgcagcctccagggccgctcgctcttccgccagggcttgaacttgggcgttgagcccctcccgaacggtggaatcggcggcagcgagcacctgcaggagcggctccatacttgccggagtcggagaagaaaaagttgcggcccgcccccgggacgacggaggggctgcagga

SEQ ID NO: 61159 - DNA, 1030 bp, Oryza sativa
gacatgccatgtcaccttcctatgcaaaatctatatgatttgtccaatttacccttacgcattggaaaataaaaaacaaaaggaaaaagttaaaaaaatatatggtatatgcaagacaaaaatatacctcaaaatatgtgaaaaaagaagtattttttcctatgattatgtctaattcacccttatatttatttttatatgatatacgtaagggtaaattggacaattcattatagattttgcatgaatgatgacatggcatatccatatgatggttttggtggacccaaggactattttaggctttatgataaaggttaaggatttctttggaccatttaaaaggtagggagtaaactgatcctacagagaaactttagggactaaagtagctattctctctaaaaattacatacaaattaaatttatgtagttaaggtcttatttcaaacaaatatttatttcaaagaaaacaaccgaacatgcaataaaaaaaagaaagaaaaattagattcaaacaatgttctttgttgcactaccaagccaagcaattatgcaggtgttttatttgcgctggaaccctttattataactatggagaaaatattgttgaacttatatagaggataaaaaatctaacttaattttaatcaacccttgatttgtttgttacgtaccttcacgaggcgattcaatcacacgaaagttgagttccttgattttgtaatttttgcttctagccatatttatatggcatgtgtacaaatggtatataggataattagctagcggtagtataatatttactcgatacaagagttgtgtgaacttaatctatcttttattcaaaagtcaataaatggtttttgagatatgctaaaaaaaatagaaccctcgatatactttaaagaagtacattctccgactacatataagacttgaacaaactaaaatgtttcccttcaacaatataaatgcccacacttaggctcatgccaccattcctattaccacaacatatcatccaaaa

SEQ ID NO: 61160 - DNA, 1525 bp, Oryza sativa
catatttgaattactatctcatattaaaatatagctatattatcttaaggtagttatatttttagatagcgggtgtagtttttcactagaactacaaatctatatgatgagtagggtgcgatggcatattgttatatatcgtctatatttgtatatttgtaaggaacgcatcaacagtgatgatcactattcgatgcatgcctagctatggttttctttgttatgttttttcacataaaaagtacattgtctatgtcattcacctatagtttcataataagaatcacttcatccagcgttgggctcatggtgactcgccgtcaccaagtccgcctatataaacaacatatatggattgcttatacggatgaactgcatttatacctaggaaaaatatgtagtggaaactaaaaactatcgctgtatctaaaaatgaacgcatgagatttgtccacgtcaactagagtaaaaattttactcccagcattactttggttgacgtggataaaactcatatgtctatttttagatctaacgaccgttttcagatttttagtgtatacgtggtttgcactacatatttttcatagattttcaggacctactctttgttgcttacatgtaaaaacagagtatgtccattgaggcacttcgtgcaatgcaaatctatatttcgtctcagtggtttagtaatgaaatcaatatttttttatattctattgtactagttctcggaaccgtcgatagctttgaacctgagattacaattccggaacgaaattctgaaacttcggtaatttcgcccccaccggcaagcacatatttcacacgaaagtttccgattatcttttttcagtttttgtgaattggtttaaaatttattcaaattcattcaaaattcgtcaaactttcaaaaaataattagggaaagaagtactgaaattccaaaaatttcggaaaccctgcttcgaaccaaaaaaatatctgctccattaggaagtccgattccggggctaaatcggaatgttcagttctaatccgatcagtccctcgttcttctccgactgttaatcggactcgaaccaaacagttcccacgcgccatatagcctcgccatccatgatccatccatggcgacgcacacccaccaatcgaaacctgtagaagaacccatggctgcagctacgcaagatcacctcccttcttctccggccggccccgccgccgaccaaccacagggcggcgggcgtacatccgccttgtcatagagcagctgctatccgcgacaccgccagcgacaccggccgcatccgcctcctgctccggcgacgcccccgcggcgtcgtcgccgccagcttccccgcggccgtcacggcggcgctcgacgacctggaggcgctctactccgaggggagcgcgccgatggcggcgctggcgcgcgacgcggcgcggtcgaggcgggcggggcacgaggagcggctgcgccgcgccgcgtcccagcgcctcgctgtcgagggcccgatcc

SEQ ID NO: 61161 - DNA, 712 bp, Oryza sativa
ctgcagccctggatcggcaatggatgtacgctgaccggcggtccaaaagaggttattgccggcgtgcactatttttggaggggccgaagctaacaggcaaaggggttttatttgttgtccatgcaataagtgtaagaatcagaaggagtattctgcatccaagactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggaacaaaacgttggataccactctggagttgttgcaatggaaggcaaaaaatggggttagtgacaaggcatttggcgatttattgaaactcgtcaagaacattctttcgggggggaaacaaattgcccgagacaacgtacgaggctaagaagatagtctgcccattaggactggaagttcataagattcacgcatgtccgaacgattgtatcctatatcgcggtgaggagta

SEQ ID NO: 61162 - DNA, 749 bp, Oryza sativa
  unsure (1)..(749): unsure at all n locations
ttcctgcagcccatctgaaaattttatttttgataggcatatttcaatccaacaacctatatcttaatgactttctcggatttaatgcatgactctctattctttcacacatgattggctacatgggcattgagaaatgtaaatattaatgaatcgcttgtttacgatgaataactaatacatgtttaaatggatgataagtagaattacttatccttggtctgtgtgccaagatgaaatatgactatcaaaagtagatggagggagtatgtaactattgtatgaatgagctattagattgactatagatgaattggagctagtagttggctatactattaaacttgctctaaatggacattgatgcatgcatccatgcacacatgtatttataacccacatgcaatattttgatttgctattggctagaaaatagtggggatggtgcatgcattgagtttgttgctatagtaaatatagtatgagagagagttattagcttttcttggtcttggtgtacctatgaaatatatagattaatttggaatggagggagtattttgttaaattgatattcccaaaaaatattatgtagtacacgctaaaattcggctttgttaaattgattgtagtatcgtaaagggcatttctcaccccaaaaactaaacattgagccaatgaggtgaggggctcccccacttatatattangtcatttgcccttccacaaccaatgtangactattcaac

SEQ ID NO: 61163 - DNA, 1196 bp, Oryza sativa
tccatcattagcaaatgtttactgtaacgctacattgtcaaatcatgaagcaattaggcttaaaagattcgtctcgcaaattagtcgcaatctgtgcaattagttttttaagtctttatttaatatttatacatgtgttcaaacgttcgatgtgacaggtgtacaatttttatgtgggtcctaaacagggcctaggttcctgctccggcccttcgtttcgtagaatggagtaaaggtattttgttttttttccttaagtggcaacattttaacgtactcccttcccttggtcccgttccaagtaccgtcccattttaagtgtagtcatacgttttttttccaatatttgatcatccatcttatttaaaaaatttatgataaatttttaaaaattaagtcacgcataaagaactattcatattttatataataataataatgatgataataataataataataataataataataataataataataataataataataataataataataataataataataataataaaaaataagacggacggtgacactgaaacccacaactggacttattatgagacaaagggagtagaacaaatatattataaaaatatactattcaataatggagtttcattttttagagcgatagtggagttaatgaattgattttgtgttttaaagttgttattttttataaacttaatcaaacataaaatagtttgacttataacaaaactaaatcattctagtacgttctaagatgcacgaagtattagaaacttatgaattatatttctttagtttttgcacatattctttaaattttcaacgtaggtaggaaggcagaagtgggtcatttggtccaattttatttttaactgtagtgaaaggatatgtaatgagctctaaaactatggcattgtaataaatacatgaattataatgtcatatgcctaatcctaaaaatttataatagcatggatccattaatccaaaataattctagcagtggcaaaactaccttggaacgtgaattgaggtattacctgtgcaacttgaaacaggcttgcttagaaaaaaaaaaaactcaaaggatcaaaagagagtttcgcgcttgagaaaatttgaggctgtaccacgagaacaagtcctcctcgcagaataaatcaaattataaacgtgggctgcaggaa

SEQ ID NO: 61164 - DNA, 1633 bp, Oryza sativa
agtccctacccacacaaatggacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccatttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcgtttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatatatatatatatacatatatatatatgtatgcatatatatgtattgaaacatatatatgcatggtttatatatatatatatatatatatatatatatatatatatatatatatatatatatatatatatatatatatat

SEQ ID NO: 61165 - DNA, 1380 bp, Oryza sativa
cataacgggaagagagattcaagaaggtagaaaacacgtgcacctcatttagtactcgatcgtacaaccataacatttccactagtttttaactgtttcttcaaaacaaaataatatataccagcagaatttcaatccacttcatccattcgaaggcatagatcgatcagactaggaaagaaagaattatttgctttcaacaagtgtcattgccagaaaatagttaatctgttttgaacttgtgcatgcagtttaattagggaagagaagtacagattacacaaattctctgcatcatcctagctagtcaatcagtgcagccgtatcaacgcttaattgattcaagtttcaagagaatgaccccaaatatccatgagttcactattcttcaattgacaatgtgcttgattgaccatcaaaatggcaaatggcaagtactatcggtacaaagatgaccataattatcgctggctcaactcgggtcagagaaatttgcaatcaagttggtaccgtacgtgacaaaaaggaaactgtagagtaaccagatgctgcctataaatagcatcagataatgaagaactttcaagccaagagttagccaagaacgtccataaagaagagatggcatccagggtttccactgtcatctttcttgctgccatcattctcccattcttgtcattcgccgaagcccaacaacctcaaactcctccaagaagaaatccaccacgtgcaccgccatcaccaaggagagcaccgtcaccatcggtgactgcagaaccaacaccggcaccggtcatagcaccatcaccaccaccagttgtagcacctagccagccgctagtcgtagcacccacacagccaccaacaccatctggtggtagtcaatgcctaagagaaaatgtaattgcacttaatgtatgcggacaacttgatttgtccacgttgctcaacaacccgactaaggctatgcaagactgttgtccaccaatcaacaatctctcaagcaccattgccgcaggttgtctatgtgaggctgtgaagattaacctcggtgtcaccgccgatgtcctcttccttaaggcagtgctccgcgtgtgtggcaaggctgagctcggcaacctcggctgcttcctctgagctttcatgaacatcttctgctattctattagtatattaatatgaaagaaagcaaggcaacaaataagtaatacctgagctatgcacagagctagagctctatgagatgttactgatagaataaataaagttgtcattttataaatgtgcctgcatgatgcatgcctagttgtatgtgctactgcaagatgttgcatgtactaatatacaaaataattcgatctgagtgttacatggaag

SEQ ID NO: 61166 - DNA, 2256 bp, Oryza sativa
cccccgtttattaacaaatggattgggtagacatgaggctaccctaaatacatggttttcttgagcctaatttgattgcatagtttgagagacaatccatcagtgaacatttcatttagagtatgtgcaaggctcgacatagcctagtgtgaatattattggatggctaaatataattgtctaataattattttgataaatgcgatgtatcatgaatagacggttgtctacaatatgtaggaagggggccaagggaatggtgaaggtgtaggggatttgcttttttctatataagtagatcaaatggtggaaaataatgtaccggttcaaatgataagggattgcaagatgtttttctattttttttatttttttatgattttctctaatttattagaatgccacgtgatggcttatgagtgtttgtatggataacgcgtggccgctttatattaaaaagaagccatcatttaaaatcgattacatgttatataaaatatagtttaaagcacttacatgcatgaatgattattagctttatttcgattatttgaacatattaattcaaaaaataaaatctcgaactaagcggattgttttctctaagtaaaggcaccatatttttctatagaatagcataaactctgaggtagttctttttttccttataaattgtatatctaatttagcaatgtatgtttgcaaaaacaatgtatgatgatgcaacctgtcccgtgtttgttgaactatttcgtattttttgtggcatttctgatgacatgtatgtaaaagggcattagtgtttgtccctccagatatatttttatgtagtggcttcagcagttcagttattcatattttcttatgtacggaatatataatttagttatgcatgtttgtaaaacaatttatgatggtgcaatgtatgttgttaaattatttcatcgttgttattgtcattttttaatgattagttttacattcaagattattttataaaaaatgaatatatatatattattttatcttgaattgttttagataataaaaatcgattaaacatgatgtaaagtgcgcttaaatcacctcgtgtcatgttttcaatgttaaaaaaaattcaaagaaaacaagaaacatactccctctgtccaaaaaaatccaacttctggagtttgaattttgtcccacaaaaaccaacttctaccatgctatctatcctcggcacataaaacgagaagttttctcccttaaataccctttatctacccatcaacattactatgggctttttataggacaaagggtgtaccattctccacttaaataatgaacccgttattttaaacattagatctattccagaaaatcataaactgctgcatgacatgtcttatattaaaataaaatctgagaaatctgaggaaaaaacaaatcattggttttcactttgatcgttcgaaatttttttttaaaaaaaaaacaaactccccaccacccacccctcccgttgtatacacacacaaccttgtccaccctccaccccctaccatttttatgctatttatgtctctttggtccctccctccttatttttagctagcaaactaaaagaaacaatcaataaatgtgtgtaattttaagctacatgtatgatttctaatctaactattgctttatttgtaattaaaccaataatataacatccatataatctaagatcccataagaaataataaaagctatgaagttatagttgtttgaaatttgttataaacattatctccactattataaaaattaaagatatttccgctcaaaattttgatgtcaccttatttcggtatgatgtaggtttcatccgtcctctccgagatttaaataaaaggtcccacgcaatccatcgtcccctttttgctgcagatgaaattttcttcccaagtattagtcagaccaagacaagtgaacccgaatcgaactcccacatgacgtctcatttgatccgctctgcaaccgaaaacaaaagccggaagaggagagcagccgctggacctagaccacacatcgacaattccctcctcgtcgccttcctgcttgctgcctcatccccaattgatctttcttccaaaaacaccaaaaacagaatcctccatgtacgggaacacatgatgctacctcattcctatccattatcaaatcagattgatcagtcccatgccagacatcattctggttctacatagggaagggctgcaggaa

SEQ ID NO: 61167 - DNA, 3424 bp, Oryza sativa
aagattttcttgttaatctcacatcataaaccaacacccatctgaccatcttgtgcgctctctccgtggtcaagctccaggaggaagcagagcagtatggcactgtgtaattgtgacgaggactccctggccggttgtcgaaacatgaattcggcaataataaaacggggtagcgcacaagacctaaagtggatggatgcagagacaaaggatttagacaggttcaggccctctcaatgagaggtaataccctactcctgtttggggatttgaatccgccgggtgtagtatagatctgacgatcaggttgtctcatgccccctagagggcctcctgcccaccttatatagggtggggggcaggattacaagatagaaaccttaaccaatacggtatcggtttcctaaatctactttacaatattatcaaaccagaactttaggctgttccgtaatatataaggaaacgtaatacccgagtcatgatctgttacatattccatatatatatgttatcccctattactagtcggataaccatgccgcatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatatggttaattgaataaaccaagcatatagtcaaggaataaataatccaaccaaccgagtggttttgataatcgtaatcaaccaagtgacttgatatcaatatatagcatatgcggtatgaatcctccaaataacatgatccgagtgatataccaactgctttgtaaaatatgatgagtgatatagcaaaatagctataaagaaacttgtatattgtgaataaagaaatttccaaagtattgggcatacgccatgcgcacactgctttaacagatgtgcttaagtctctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaacgatattgtatccaatcagttgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaaaaacgtgacaggccacacctgaaatatgggctgcagacatattaggcctaggccaaaacatatgccctcgacaccctttaaaggatgacgcatataacatgctcccgagtaataaatcttccgggtaatatagaccaagcgtagctcatatgaatagcttctgatctgagtgattatcccttatgggatactccaaaatagatgtaacaattgaatcccgactggcgcaagtattcggttgatagcccttacggggaataataattggtccagtctttgagcatagaaaatagactcatgacaatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcagcgacagacagatcaactaacaatgaagattaaaagcgatgaccaaatccatccatcatgaagatgaagaaaatagttgacgacgacaaacgcaaccgacatgatgaagataacgatgtcggtgatccagtcaatagcagtgtagcaaccaatgataatgacaaagacgctcatcaacatttgcatagtaggtcaaccgtgaaggtgaaataataagtcggtgaagacataatcatccattagcaacaacggagatgtcagggccgatgaagcaaaggtgctggtgatgatgtcagtgacaataatccatcaaattaatgttatagctgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactatagcctcttgtcgtcgaataattattgcttgattgaagatatgtgttgaagatgtccaagtagaaatcatgaatgttgaagagccacttgttgtagtaaaataacacggcatcgcatgccgagatgttgagattcacaacaacgtcatggttggtgatgtagcaaaacttgtgaagtagcagcaatagagtttgctggtaccgaagataataaagatgaagtcgctccaccatgatgacaaagttgtgttgccgtgatgaagtgaacacgagtcggcggtacgaggcggtagtgaagacgcgcagttgtgaagataaaagcactagtcggcggcggcataaccagtcggcaacggaagacgatgatgtccatcagtagtggtagctgtctaaaccagacgtagaggtgagggcactagtcagcagcagatgtagacagcttgcgttgaagatgatgatgcttattagcggtgatggtgatgtagccagccgtgaagaagatagcatcagttggcgtcataacaggccagccgtgcaggcggtgacaccagtcggcggcggacgaggcagccggtcggtgaaagcgtagacgcccaacaacggcagcataataggccagccgtgcaggcggaaacaccagtcggcggcggacgaggcggccggtcggcgaagacgtagacgcccaacaacagcggcataataggccagccgtgcaggcggaaacaccagtcggcggcggtcgaggcggccggtcggtgaagacgtagacgcccaacaacggcggcataataagtacccgtgcaggcggtgccaccagtcgg

SEQ ID NO: 61168 - DNA, 1143 bp, Oryza sativa
aaggagacaacatccttgcctccgtatccttttatcctcgcctcacccacgctcacctcctcgtttcacgccctcacggttgcccccacgattctcgcgcccacggttgtctcttcgtttcccgcgtcaactcatcacgtcgcccattgaatccacgccctgcatttagtgcgcctatcagcggcacactcggagtagggcgcacaacggtcacggacacaacctgagtgaaccgtcaccactaccgccgcatgagtagcgggcaagagaatcgaggcgtggcctgaccgaccccccgattttcacgccttaaacatccccatcatcagcgtggtcagtggcggcaaactgctgccgtggttaatatgccaacctggccactcggcgacatttccttagattccctgtcgggcccacaaccccagcttgggaagtcgtgaggcaccacatcagaccgacctcaggaggtcagtgtccaatatggtgccaggggctactgtcggagatgggcctgggggtatgcgaagtgggggaaagttacctttccatccagccgcgtggctctacagcctagccctactcccgcgcctcgcgagtcacaaaagcggccggggggcctcggggtgccatgtcgtgcccctcgggctctcccgctgccttgtcccgaggccctcgcccagctaccatgtggcggggggagcgagcaggaagggggccgaggctgaacagccatcaatgcgcagcgcctcaactgtccctcaccgcatttaatgcggtaagggcagatgtgcggtgccgcctagctgacccacgtcaatcggatgtaaccagtctgtgaccggcctgttgccggtcacatccgattgaacgggcggccgtgcccccacgtcgcttctgtaacaggcggagtggaagtaggtatgacccgtcccatcagggcataattcggggttccctccatgagagaaggaccaccacaagtcttcacccatttataagggaatgacagggctgtcccccgtgtcaggcggggggtggcgctgggtcccacttaggacgggctgctgcttaacttctgagcgaaggcacggatcatggcccggtcaaggtaaggtgggtccccctcccagggaaggataggta

SEQ ID NO: 61169 - DNA, 885 bp, Oryza sativa
ttactaatggtatcaatatcatatccaaaatacaatatgctcggtaatttatacgaaagtacatgtagtttagtggtttgtagtgatctaatcgaatagcacctcaaggtcatatgttgaaatcttcatgagagcgaatttcacattgagttgtttgaggggctaagttcccaatttaaatgacaccacacaccgccgtgacgtgtggtgtccctcatcgagcgcctcggtcgtcgtgcgcattggacggaggcggctcttgcggctgccatggaggcgggtcaccggcgcctgcccctatagcgtgaaactgcccatgtcgccgagctcaaggagaggatattccacaagtacctcgtgccagcggagaagacgaccaactcaaggaaacagatggccgcttgagaactgatcttcgtgtgcttattaaatctttgtaaagcatttgtgaaatactgcccctgtttttgtattgtatgaattttggacgtaatattttactattcatcttattttatttttttaaaaaaattttcattaaaggcatttacgcatgacttatatgatttcactaaaatatgttgaataagtggaatgaaaaaacattatatattagagtaaattttagagaacctcattatggtcaaaattgtaaaaaaaaatacagatattatgacgcgtggcacataactattgatattgatattttggtgtatatatatatatatatatatatatatatatatatatatatatatgtttcgtaaaatcacacctttattaaaatctttattaattatagcatatttgaaacaatttttcaaagtacagaagagataaactatcaccattagttaagaacttaataattaaaatttttatata

SEQ ID NO: 61170 - DNA, 805 bp, Oryza sativa
gaggccaacacaagacctcgccgagacgccggatacggagggaaaaggaagaagacaccggatcaggaggaagaggaaggagtgagaagggaagaatgcaacctcgccgccacccttctcttctccaccatcaccgagctggcgagatggttgtcgtggtgctgccgagcttgccgtccttggaggtgccgtcgccggccatcccgccggtggccgactcctccgcctccccctccctcccatagttggcaagaaaagagaagaaagaataggctaatttgtgggccccatatcttttttttaactagtatgccacgtcaacgaaaccagataactatggccgtgtttagttcacccccaactaccacaaactttcaactttccatcacatcacatcacatccaaaactttcctatacacaaacttccaactttttttctgaacttccaacttttttcaggaacttaacacagcctatactattataggacctaaattgcacggtttgtatagtttaggagtgatgatttctggtgttgggagacaagggatgtcaaataaactcgacgtaaagttgagggatgattagtagacttaatccgccaaccaaaggcaatcttaattacaaaccagtcgatttagcccattgccatccagcccattagcaggcccggcaccatcatggtctccaattaacgtcagacactgctcctccttgtaataacaaccacacaccacaatttttcaggcaatttttggccaagcttttggttcataatactactactactactgggctgcagga

SEQ ID NO: 61171 - DNA, 756 bp, Oryza sativa
  unsure (1)..(756): unsure at all n locations
cggaaacaccagtcggcggcggtcgaggcggccggtccgtgaaaaagtagacgcccaccaccggcggcttattaggttcacccgtccaggcggtgaccccagtcggcggcggacaaagcagccggtcggtgaagacgtagacgcccaacaacagcggcataataggccacccgtgcaggcggaaacaccagtcggcggcggcgaaggcaagccggtcggtgaagacgtagacgcccaacaacggcggcataataagtcagccgtgcaggcggaagcaccagtcggcggcggacgaggcggccggtcggtgaagacgtagacgcccaacaacggcggcataataggccagccgtgcaggcggaaacaccagtcggcggcggtcgaggcggccggtcggtgaagacgtagacgcccaacaacggcggcataatacgtcagccgtgcaggcggaagcaccagtcggcggcggacgaggcggccggtcggtgaagacgtagacgcccaacaacagcggcataataggccagccgtgcaggcggaaacaccagtcggcggcggtcgaggcggccggtcggtgaaaacgtagacgcccaacaacagcggcataataggccagccgtgcaggcggaaacaccagtcggcggcggcgaaggcaagccggtggtgatgttctgactgatccattcctggagcgtaagagatnnnnnnnnnnnnnnnnnnnnnnnnnnnnnnnnnnnnnnnnnnnnnnnnnnnnnn

SEQ ID NO: 61172 - DNA, 732 bp, Oryza sativa
  unsure (1)..(732): unsure at all n locations
agccctactatttttccaccaatcacctcccatttaaattctctttattttgatatctaattactctcttttccttaacaatatcaataacacatatataccagttttaccaacaaattattatttggttgcttacatgctattttatagcttaacgtgtagtggtagaaatgaaaataacaaggtacctaattgttcctcgattgaatttttctctgttcgttgcttctcgctttcgtcatctttctctgaaggagcaaaaaagaaagagaataatttgaattcgatatcttgtagtaggtaaaaggatatgtcgtaattgttgtcgcttgattagtatgctctctggaatgacgtagctgacgtttaccttgacgttggcctgttgatcgttccgtgtgtgtactagctacctnctncctgtggccttccttcagtcctctgctcccatcttctacagacttcacaatttcagcaaagaaaaggaacgggattatctaacagcaattcttaatcatgtaaaggctgatatataccttgcatgcttgattcccttgatatgttgtagcaggaatcgatcagtttactagttgtgcttggcctaaataagctgcggcaaggaaatcangacatgaacctcatgtggaaagatgacacatgaatctcatgtgtgctacttagacttctgagtttcaggcaacaaaggagatgatatagcagccatatgagaaa

SEQ ID NO: 61173 - DNA, 1221 bp, Oryza sativa
ccatttgctctagttcataatcatgcattgaaacaatactgagtaaagtgccgaattgaactatgcttcacaacccggggaaaagacatcattgaaatcaatacctggaatcttgctataaccttagcaactacctgtgctgtgcacatcgcctcaccatgaggagatacacacccttctcttgaaagacctatgcacagcgaaagaggtctcttctcttggcacattttcacaaattcccaagtatgattctttacaagtgactccatctcatcatgcatagcagttatccatctatggcaatcatcagaaccaatagcctcagaatatgtagaaggttctgcattaccttcaatttcttctgccacactcaaagcataagcaactatgttcgcttcttcaatatatctttgaggaggtttagtacttcttttgggcttttcttttgcaatagaacgttttggagactgctgaacagtagaagaatttgtatcttcaataacaggtgcatcttggtgaacagtagtgaacccttttccatagactttgaggcgaatcctcgtcaaagctgcaccttgtgatcttcccatggctcgcgttcggccacgtgctcccttacctagagctcgcagagcgcgtggcatcgcgtggccaccgcgtgtccttcgtctctacaccacgcaacatcgcgcgcctcctgccggtgagccccgccgtggcaccgcgtgtcgacctcgtggtgctgccgctcccgcacgtcgatgtctctcgtttggtgccgagtgcaccaacgacgttccctccgacaagttcgagcttctctggaaggccttcgacgccctggcgccgccgttcgccgagttcttgggcgccgcatgtgtgggaacccgagcccttccggcaggtggtgacgttcatgaaaaagcggcttgtccccctcggccttctgctgccgtcgcccgacggaggacgccgccgcaccgcggagatggtcgacgacgccaccatgcagtggctggacgcgcagccgccagattcagtggtgtacgtcgcgctggggagcgaggtgccgctgcgcgtgaagctggtgcacgagctggctctcaggctagagctcgccgggacacgttttctcttggcgctgagaaagccctgtggcgttgatgactcggatgtgcttcctctcggctttctagaacagacgcatgggcatggacatgt

SEQ ID NO: 61174 - DNA, 737 bp, Oryza sativa
gtatgcagaaaatgctcaggcaagagcatgtcgatcgcttccaaatcaataatttcagaaagtaacagtctcctcacgaagacatgaagtatggaacgattatttgcatcaccatcatgcatgattgtattttgttctgaatgtttggtaaatcatgtgcagaagaactagaacaatagttttttctccatgttcattatccactttcacgaaaggatgctaattggtgcaattattctgggtattattgatcagcctgatttcactcttgacagcgggagcatagtagtctgactacaaggaattgatagacaattctcgttgctgcaagattgttaacttttctgagatgctgcaagctaagctggttttaaacaagctaattatcaggggcggatgatctatggatcagtttgtcgttaaggtaacttcaattcttcatggttcatgtcatgtctgaaatttgccatgataaattactttgatccttttatgtgttcattgagccatgtttttttttaaaaaaatatgcttgtttatctctagaagaattgagtatagtttcatgacacttgcaatttaagctcgtcatcttaggtaggtatctgtgttatcaagaatttaagatgtgtcataaaaaaaaaccggcatccgaatgtttaaactatgatggttcagctggaaatttgttgatatactttgaaattttgctaaccatgaatacaatgttcacttga

SEQ ID NO: 61175 - DNA, 5249 bp, Oryza sativa
  unsure (1)..(5249): unsure at all n locations
caccgccgcctgtcccacgccctcatctgcccggccgcctcactgaagaagagagctgacttgtgggtcccacgtactttttaaattttttttgttgactaggatgccacgtcagcaaaactgggcaaaaatactgccgagggacctccggtaaacggtttgagagagtttaggggtacacatttctggttttgtggttaagggacctcaaaaaatctcgttgttaagttggggatctctggtgaacttattccgagaataaatggtgaaacaaggcccaagatgagtagtttaaagcttctttaattttttgaatacatatatgaagtatagagtacatatacgtattttttgtccaaaaatcttgggtatacatctgaatatccttgaatcactagtgggcccacccctgctaatatgtagaatgagatctgttttattcaaatagcaatgtttcatagaaaattggtttaacgatttcgtaagcttttgaaataatttatttttggatggtacgctttaagcacagtttctgcaatccagtcctcaagaaaaactttagactgtaactaaaattgaatctcatcacagcttactttggaagggatttgtttttgaagaactttgaaaacaaaacttgaaagaaatcttttagtttgtaatctgtataacgaaattccagtaaaactatttgaggtgggttttgttatagtctctaaagctcacttttgaaaatagttctctttttacaagcagcaaaaagatataaacccttttttggagggatattccgaagaaacacctgaatcatttttcacactttggttttggtaggttaatttggaatagcatttgaaatcattttctcatgagaaagcacacgtttcgccgaactcacagagttaagttggagatagcgaccgcccgtccggaactcagcaaggtaacgggacgtcttctccatcaactcgttcatctggcaagctgtgtcggatggattgcctgaagtttctacaatgggtatagtacacttttctcagaaaaagcaaagaaagaagaaaatacatcaagagaaagcaaaggagaatatgacctctattaggagtctaatcatccttaccttcttgatgcttttgagtcgaggatcccggagctgaagcggcatcagccgccggcatcaccggagaagagcggacaggagcattagcagccggcacaactgaaggtacatcgtcaataggtaccggagcaacatcggaagaggcagtagctttaagtccacccaatgcagttgcctgctctatagtatcctgagttgcaagtatgttctaagagacaggttatcaaaccactatgacaaagaattttaagagaaaaaaaaagaattggggaaacacggataccttgctagtgccatcagaagaagaagaagaggaggaggagtcactcaactggacagcatcaagctccgtgtcgggaaccacagagcggcggcggcggcgacgatcatcgcttgaagactccgtggatgataccctctcataaactacggggttttttcctcgcttctcacgcatggtgcggtccagctcggggtgtggagaatcttcaatacgcagaccctttttagaagatttcggcaatggaagtctgttaggacgagcagttctctccttcttatgacgccagtcacgcaggaattcgattgactcgccgtggcgtttgtatcctcctcgatcatctctatggaccgggatcttcgtgatatgctgggaagggtcgtcacccttggtctccttctgttgcttgccgccggatcctcccgggcgcttatcttcgacagtgtgtctatctcctgccgagcgcctgtctcatgttactcgcctgtcccccgttctccgcccgtctcgtgggacacgctctccgccgccccggtcgctggcgccacgctcgcctgcaaccctggatactccgtcttccctggccctctcaagatggttgcctgatgaaaaagtacaggatgatcaagaagcatcctaattccggtggctaaagaatcgacaatggatatatacctgcgatggagttaaacacctgaggcgccatattgcataatcgatgcacaggcatgaccagcaatatataggcttcatccaaattactcgtaactgccaaggatttggagtcctggccgatgacggtctagctttgtttttctttcaacgcacggccggagataagcttcaacatgggagtcctttcgtcgcatgactaaactctaccggacatgtatcgcatgagccgacacgacaccaagttaatttcgctcgctccacgatcaaaatttacttggtggggggcatgtgtttgatggtattttggcgattatatgtgtacacaagacttactcatgatggacaaagcaaacaagcagtttgtaagttggctagcttatcatttctacacaatgctcggccatgtatatacacgcaaataaatgcatgcacaggcagctgggaatatatatacttggattagtatatgtgcatgtataattaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcatgggctcggcccatggccgaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagtagagaaacaaagcgaattacaaatcagatatttgacgctaggagaagctaagagataaaatcaaagaaggatatgaacaaatacaaattgatcgatcaagccttatctacaacgaacttgacgcggagcaaacggcgtgcggacgtggcgagcacagacctcagacccctatataaggcgtcgacccctcggcagctaggggcattcacgaactcatccacacattcattcaccaacgcatctagcatccacaagccacccatcatcaacgcatctacccatccagcatcaacacatccatccatcaactctcatcggcgatccatccatcgacgacacgcaccggcggcggcgagcgacttcggccggagtcccggcgtccggcaggagagggcacgcgcggtgatccgatcatcagcaagcgcaggagaggagcttgatggctagtccaggtaaaagctagcaagattgtttcgttttctttcatctacagcacgcacaaatccatgcatagggatccatctgcgcgtatcgtcgtcgccggggaacttgcggtggccgattcatctacgcgtcacagaagcctcatcgatgccggcgtctgttcaagccgacgtagtgctacttgtccctagactcgacgctgctaattcaagccgctggtgatgcatctacccgaagctgcgacctcgccgagataccagacatccttgatttgcaagcttcaccgcactggagcgggctaaccatggaggaggtcgtcgggaagccgccctgccggagcgcgccgaggatcgccggagctgccgccgactgccaagacttctatcagttctcatgccggaggtcaagcatcacgcatagcgtcgaaaccagcggatgacgatggaggcaagtatggctgcagtacagaggaaggacgacgggaggacggtgagccagtgctgttggatggcaacaagctagctaatgcatgttgattaagtaaattattgtggcaacgtggccaaccaattggaggatgacatgtcatcgctgctacagtgccatgcacaaaccaatgcgtgggctgaagaagtcctgttggtttttcttatttgtcccaaatgagatgccgagctttgattaaatccggccgccgtctatatcaaccatcttcaataattcctccctgattcttctctaatctaatctcgacgcaactgctgtgacgtcaagtcgttcaagctatgcaactccatgcatgtcttcaccaacaatctacgtcgacacgttgttcaagaccgacgaggctagacgacggagggtgggcgaccaacaccagcgcacggaccgacgaggccatggatcgctgccggcgcttacacacacacacacacatctacatcatcatcacaaccatgcatggagaacgtgaagcggagacgacgagacgaccacaagcagcttaatcggaggttctcttgcaggcctagacctacggaggtaattaactgggagcttctcgaggccccaggaatcaggagaccatatcgcacaagtcagatctgtccaatgacagattatggagcgcgcatacatatatattacattgggaatttgtatttatgatcatttaagattaataaagagcatgttccctatgttttgtttacattgtgtatttaggtacactggcacgcccgcacatatatgtatctctaaacaaacgagatctcagatgttattttccaccctaaacagcatggtgatggggactttgggagttgcggcagatagtggcaccggtggtggggacttgggagctatatgccacctgttaatatttgttaatattgtggggatgggattccgtcaaataacattcgcttataatttattggaaacaagaagtgatatatctccaaccctctaccttctaagcaagtaaaatgacaaacaatttgttgagttatataatcacacaaaggcaggggccaatacaccataagctatgctgatttcgttaagaaccaatatgtagccactatacaatgtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61176 - DNA, 1002 bp, Oryza sativa
  unsure (1)..(1002): unsure at all n locations
taatacattcatccttcggacccatcatttcacttattcatggaataagtcaaacggcatatttgcaaacgaaaataatttataaataaaacttatatatatatatatatatatatatatatatatatatatatgttcttagcgatctaaaagcaaaggctgaaaaataaacttctatgaaaaaaccttaaaatcagctccaaatttaatgttgaaaattcaaagtttagccgataagcataagcataagcaaaaatatgagatcttttatcagttagactcacatgtcaaccaccgctgtgggtgaaaagttacgattttctgactcaattgtttgctattgttctagttttgtgaaaatagtagcacttaacagtgaaatttggtaagcctcgaagtcatcattagtctatagtcagtatcagcttcagagtcctggaattagccgatgggaattatcaaggtgcaaatagtcggattcttaccatatctagaatagaccgagttcaagggagatgcagcatgacagtttatctattaattaggaatagtacattagtttcctgttatctttaggaaagtgtgtttagtgtctgatatgcactttatgttttccatttatccttaggaaagtttctttcttgtataaggacaagtatctatccataggtataaatatgtacatccgaggtcattgaaaattatctctcgatcaatacaactactctcggcgcatcaccaccctctttttcgaggtttttagttatcatcggcggaacatcgcacctgacgcagggctgcattggctttcgatcactacaacaaattgggcttctatgacgattacctgatgacagaacacatatctgtcataaacagaggctgtttatgacgactgttcacaggatgacaactgtttatgatcaaaccgtgtctctgtcataatcatcgnnnnnnnnnnnnnnnnnnnnnnnnnnnnnnnnnnnnnnnnnnnnnnnnnnn

SEQ ID NO: 61177 - DNA, 1162 bp, Oryza sativa
ggcgaattcgagctcggtaccctactagccaaatcactcggattaatccctaccgtccatccgcgtgcacgggttcgccaccgcatatactaatataaaaaggaggggttgtacccctccaatcctactagccaaatcactcggattaatccctaccgtccatccgcgcgcacgaatttaccaccgcacgattccacacgcaaacttcgctcctcctccacacgcgaagacttcgctcctcctcctccacgcgtggacttcgcttctcctcctgcatgtagcgccgccgcatcctcgccgtcgccggagctcctccccgcgcgtactgccaccgcatcctcgccggagccgctgcccacgccgacatcttctgctgccgccgccagatccggcttcttccctaccgttgcggccggatccgacctcggccccatccgccgccgccgccgaggtcggcccctcccgtccctgccgccggagtacatccatgtttccctcctcgctgtcgtccacaggctccgccaatgcaatggcctctaccttccctcgaccaccgtcttctggacaaaaaacattctttaagacctgtcaatatgaaaagtacttgccattgatgttctcattttttacaaccaccaaactataacagacaatgagaacccagaaacgacttaacataattttctgttctctgcactacgtcactaatgtgcacacataattaaataaacaacttgaagcaacttgttggagtcccaattaataagtgcggaactcactaccgatttcatatatatgcagcatttccgatcccttccttgctcatggcaaatctcatatactactcattgctcatcattcttcctttcctactcctgattaatttctacaaagctatgttcagctcccgcaagcaagccggacggcttccaccgtgcccatggcagctccctatcatgggtagtatacaccatttgatcggtgatctcccacaccgctccttacatgatctatcacgacggtatgggcctgtcatgttactcaagtttggacaggtaccattcattattgtttcttccccggaggctgccaaggatatcatgaagactcatgacagcatatttgcgatgagaccgcaaagcgagataatgaagatcattac

SEQ ID NO: 61178 - DNA, 1735 bp, Oryza sativa
caatgtcaagtgatgggctatgacgtgccaaagggaacaaaatttttactaaatctgtggtcgaactcaagagatccgacttattgggatgatccagaaacattcaaacctgagagattcaagaatgatgcaagatatttcaaaggaaatgactaggaattcattccatttggtgctgggagaaagtatgtcatttggtatgaattatatgatcgccaatatatgagctggctatgcaaaccttttattttattttgactgaagtcttcccgacggagttctacccaccgaattgaacattacaaaaaactttggatttactgtccagaagaaagaagatctcttgttgcatgcttctctatatgcacaactttcttgctgattatttccatggtgaataattcaatggttgtaattttaatgatttattattttgtcagtatcctcattgtttgaggctttgatgttgtggttttcttaagcagaatatacatctgctgcatatagtatgtttaaaaactaatatctgcaacagttcccatccgtccaaaatataagcatctttagtttagtttttttatggagattaaagtgaagtgaaaaaattacaatacatttaattaaaatacacacatatcattattataaagcccatctataacaggtcaaaagataaggacaagatttccttatagcctccacaaggagtatattcgactcggagaaacattcttaattaaaatggtcagtgtgttaggataaggacaagatctctttgtttgaagattgcactttgcaacagccgacacaccttgtggagtatttttcagatctttctcccagtcatttgtgatgttcatatgatgactttagactgaaattagagtgcccagatggtattattgaagcccctcaatgagaagtgataaaggaatggaaatgcgtttttgtttataatacttgacttgcagcaaccatggacgactgcagctcccataatgtgtttttattaaaatatttgatttgacttgcagcaaacattcacaaaactgcagtttaattgactgcaaaagaggcaaacctaaaccaagtgggagtccatctagttaatttggactacttaggtgaagtccttcatgtttgccgcaaattttatgggtagcctgttaatgtgtacatggacaggataaacttcctgtttttctaccatgtgacccatttgtacaaaacaagcattatgatggttttcataggactcattcattactaaagtacatgcatgcgccatgtcctcagggtatcgcaagtagagtggaaaattcaccacaaaaaatgattttcgatcacagttgattgggagtagatttatctcgtttttagcgcgcaagcttcccgaactactaaacggtacgttgtttgtaaaaattttctatatggaagttgttttaaaaatcatatatattatccaccttttacatttgaaataattaatactcaactaatcatgagctaatgtctcagctcattttgcgtagcttctgatcaatcttcttgttttcccttctctcaaacaatctattaaaactatacaggtggtttatgaggaacccatgcagtacgccaggtgccgtgtcaccgtttgcatgtgaaaatagccctactttcatcatctcgggtgactgcatccaaaaatattttggaagctgagaagcataagtcaactgcctagaaaata

SEQ ID NO: 61179 - DNA, 869 bp, Oryza sativa
aaaatattgctgagagacgtctggtgaacggtttgagtgagtttaggggtaaacatttctggttttgtggttaagtaaccttaaaaaatctcgctgttaagttgagggacctctggtgaacttattcatttattctctattaggcccaaatttcccactcccctccccctttcatctcagcccgtactcagtttgggccgcaactcagcccatttttcctccccggctaacccaaatccccaaaccggccaaccctagacctagaggaatgagggggagaggggttggagcggggaggcgggcggcggtggccggcgattcgcggctttcacacggcgtgtggcggtggcgactgcggcgcggctcgtcggcgcgggcgtggcttggcgccagtgcggcaggaggcggcacgtcggcggcagctgcggcgtgcgcgtcggcggctggaggcggcgcgtcggcggctgcggcgtgcagttgccgacctgccgccgagatcagacaccgaccccgatcacgaccagaggtaggagcaggaccggtgggcgcgctagtccaccgaccactccttcagcatcaatgaccgcgaggagctccgtttcgtcctccttccccagctttcccacctcctctcttcctttctctcttgccaattgccaattggacataaggatctctcggtagagctaaacagaggaaacctgttgtgtggtgaaatggatctatgactgggaaggaaaacaaattgtcagggggaaattagtggccgattgacactggctaaaataataaatcttcggtttagacctcttggcatcactgtcacggacacctgtgaattgcattcttatcttcatacttgcaatgaa

SEQ ID NO: 61180 - DNA, 41444 bp, Oryza sativa
tcgagaatatattttagagtcgttttgggacgcgacaaacctaccccccttaaacggaatctcgaccccgagattcggaagaactggcgaagagatcgggatgggctgctttcagctcgtcttcacgctcccaggtagcttcttcttcggcgtggttgctccattggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttgcccaaggaggcgggcagctccaactggtaagcgacttctccgcgtcgagcaatgatacggaaaggacccacgaaccgaggtgcgagcttcccttttgtctgaaacctgtgtacaccccgcaatggcgtgacccgaaggtacacaaaatcgtccactgcgaattccaggtcacggcgacggttatctgcataacttttctgccgggattgtgccacctttagattatcccgaatggttctgaccttcgcttcagcctctctcaggatatcagtcccgaacacttggctttccccaacttggtcccactatagcggtgtccggcacttgcgcccatacaacgcttcatagggtgccatttgtatgctggcttgatagctgttattgtaggagaactcggcataggggagactcttatcccaggtcttcccgaaatctaggacgcatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagccaccttggttaatcgatccacaactacccatatagaatcatatccaccttgggtttttggaagtccggtgatgaaatccatcccaatttcatcccatttccattctggtacttggagaggttggagaagtccggccggccgttggtgttctgccttgacacgctggcacacatcacacagggccacgaactctgcaatttcccgcttcatactaacccaccagtatttcttcttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagtggctttaccctgtttcatattcttgaggagtccacgcatgtccggatcattcttctgagcctcgcggatttgatcgagcaaggtaggcttggcttccaacgcagccaagaatccacgacccactatgcttagattcagggcttccatctgttggttaagttcgagtggaatgccacggacgttaagagtgttgcaatggctctttcgacttagagcgtcggcgaccacgttggccttaccaggatgatagtgaattcccacatcataatccttgatgagttctaaccatctcctttgccgaagattcagatccgactgggtgaagatgtatttcaaactcttatgatcagtatatatttcacagcaattcccaatgagatagtgccgccagatttttagagcatgaaccacagcggctaactccaaatcatgggtagggtaattgccttcatgaggccgtagctggcgtgaggcataggccaccacatgaccgtcctgcatgagcacgcaccccaatccttggcgcgcagcatcacaatacaccataaaatccttgcgagtatctggcaagattaacactggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgacggtcttgggttgcctccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgtttgtgagtataccagaatgtcatcaatgaaaaccacaacaaacttatccaagtattccatgaacactttgttcattaagttcatgaagaaggcaggtgcattggttaaaccgaacgacatcaccgtgaattcatacagtccgtatcgcgtggtgaatgcggtcttcggaatatcttcttcgcggatacgtaactggtgatatccggaacgaagatcaatcttggagaataccgtggcacctttaagctgatcaaacagatcatcgatccgaggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttgacttcagcgagttcatttgctgccatacggtagggtcgcttgtacagaggagtggttcctggagcaagatctatccggaactcaatctctcgtttgggtggcataccgggtagttcttccggaaacacgtctccgaactccctgacgatggggatttctgacagtcctatctgatgaagttctgaactactgacagaggttgggggtgcaaagaatacaaccggttgttccggccctcggtacagagtgacagtgcgtctcgcgcaatccactactccttggaattgagccaaccaattcatcccaaggatcacatccaagttcttggtgtctagcagaatcagatccgagggaaaaggaatcccctgaatttctatagggacggcaggactataatactttgctgtcataacccctccaggggtggtgatgaggagagggttcctaagccgttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcgggccttgagcgtccctgcggccttgaccaggctgcacagttggcgtagaaggacggggcgcacgagtcccttgctgactctgctgttgctggggctgtgggacgcgcaccacgaattgaggtcggggcgcggagcgaggttgttgctgctgttgctgctgcgaggacgatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgaacttctcttgcttctcctcatcttcccgcacatcctccggggcgtaacgggccaggttgttgaactcatgcaaatactccatcacggagaggttgccttgcttcaactctcggaattcccttttcttaagggccacgactccagcgggcacatgggttctccggaaagcggcggtgaagcgagcccaagtaataggctgcccctctggctgcgtagcctggaaatggtaccaccatagagatgcgggcccctgcagctggtgggcggcgaagatgactttctcctcatcgctgcactgcacagtgtctagctttttccccacggcatgcaaccaatccaacgcatccacggggttgttggagctagagaaggtgggtggacgaatgcggaggaactcggcgagcttaaagtgttgtgggggtggtggtggagcattctgttgtagcggatttgggagtgggggaggaaacagtcatcatgttggcctgctgggcgaggatttgggtgagaatggcgttggtatctggtggtggtggtgaacacgaaggagaaggtggaggtggcctgccatggttgttgtggttgctgccctcgggtttggttgccatcaccggtattaacacttctcctggtcgtcaccatctgaaaaccccacacataaccagcaaacagagagagctgacaattaaagctaaccaccccgactaccataattcttaaatttattactgctattaaattggttcattaaagttcaaattgcttaggcaaattaaataaagacaggctccgacacaattataccacacaccggcataaccatgccccacacgactccaacaagaagacaaacgagaaagaacacacgcgcaagcctactaacagctcgtctaccgctgcgacgggccagggcggaaggtgagcaacagcgcatcctccgtgctaccaacgccggaggcttccccctcctggggaaccatgggcgcgggctcggcacgaggggtctccatgaagcaggtccacgccagggactgacgaacaagctcgggcctggaggtgctcttgcgggcggtgatcttctggctgcggcagacgcggcggcgcttggggcgacagacctctccctgggcgatcttgagctgatgcagctgcgcctccaccgcgtctaggtccttcttcagctgcagattctcctgacgcagctccaggatcttcatgttgttctcgaccatcccacggcgcaccatctgatggaagtcgatacgagccgcgtcgtacgcctccaccatgcacgctaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggaatctccacccgcggtgactgccaacgaagtccgctcgggagagccagtgaggatcactgcagtaacctcccaagcagcgtggggctctgcatcgtcaccctcctgctccggaagcggcctggcctggtagtccactccatgcggataccccaggacaacgcacatgccccgcagctccaagacgaagccagtcatgtccaaaccacgacggctgacgctgccggccatctacaaacaaaaacaaaaagaaaaacaacattttaaaggtcagattttggcgataaatgaagcagcaagacagagagagactagaggattttcacaaatacaaaggatttttatttttgaagatattgctaaggcttgggatctacggctcgtcctagggtcaagggtggctctgataccaacttgtcacgaccggaaataacccaacgggcgttcctgacgtgcgtgcattaatccttgtcccaggaggcaaggtacaccaaaggttgatacaattcagagtttaacaagcggaagcgtaaatagttaattcattacatgggcgacgaaggcccaacacacacaaagacaaacgagaagcaacggaagactagggcgaccaccacaggcgcttgacggcaggcacgagctagacaccaaagccttcatcttcaaggggatcctcttctgggttgggaaaaattgagcaagactgagtacaaccaccgtactcaacaagacacacccacaagtgcataataaatgcaagggagaacaaaggagttacaatataaagggttagggttgtggtaaacagcatttaaagatatttagttgctcaaagctatttggtaaacacgattctagaactatacaatattatttatcaaggccgtgaacccacacaaacctgccttaacccaaggcctacgatgattcagaccgaactggcaacccgacccagggtcccagctcgtcccaagccaacccaggccaaccattccacattttagttgttaagcaggtttttagaattaaaacactaacttgggtacattgctcggcttgtccataaccgagggcgcggctattcgaatagattatactctgatcagaggtgtatatctttacccacaagacacatcttcctcacgtgtagccacgtgccacataccaccacggtatacagacggaagacgtgacatagtttccaacccatcctagctatagacaagagtaccgacccaatcccacctacggccgtaacccccgggacaggcaggcaggactgagcccctagcagcaggacaccggccctgtgccatgacatctcgactaccgagccgcagctcgtgtagccttcatttgccctggagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccctgagcccagcctaaaatcattttggggattttgaatagagggggcggtgtgaagccagttccacaataaaccaacaattccaaagtgtccaggtgttatgaacattcccaaagtctagagttgtaaaaccgcctaatgttacctaattaaattgcgaagcatctacctaaaattatactagtggtactatgagtagagtgtccactagttggggttttgtttaatctagggtgaacaaggtaataataacaataacaataataaggtcataacaaaggtaaatgggcatggctagataaaacagtgataacgcgagaatttaaataaagcgataatgcaataatttaaagcaacataattttataaactgggattcaatatgttcaaagatgatgtgacttgccttgctcgctttcccaaacgtcggcttcgacttccacgaagagcggatcttccgaagctgcagcgtctacacgaccaacagaaaagaaaaagcttttactctaataaactccatataacaagcagaaacaaagcacaaaaatgggttcttgacttcttaaggaaaaattagagacttgaacggtccaattccgagttcaaatggccaagttatgcccatttgaaggttatatgctctttaaatggatatttgcgaatttcttcatttaaattttaatttaaaattagatttattgcgtcagccgaggggaggggcgcgcggaccgggtccacgggagtggggcccacgcggcagcctcacggtccacggtggaccgggtgcacccggctcacaccggccggcgccgtgggtcccatgcgtcagccgcacccgagggcgcgggcggctgacggccgggccccacatggcagccgtgggacgcgcccgaaggcggccacgccggcacagccgacgggaggcggcgcgcccgcgcccctatggtcgccggcggcggccataggcacggcggagcggcggccgagagaggggagggaagggggaaacgaaacggcggtccacggctcaccccgggtcgacggcgacgacgggaacggcgaccggagcggagaaaggcggcggtgcggcacgggtcgacggggacggcggcgttccggtggtcggcgaccgaaacggagaggtggacgaggtcggcggggatgcggcgaagccgaaggaggcgacgccgaagcgggagaaggtccggggcgacgacggcggcggaccggagctcggcggtgacggcagagagagagagcgacggcgcgagctcgattccggcggagagagagagagcggcgagtggcgaaaacggcggagggaggcacggggagtgtttatatagggttgggagggggagagagcggccggatgagggggaaacgagcgcggaagatccggccgccattgatgcgccggcgaggtttagggggaaagatttcgaacgaatccgagggagagagagagggaaaaatggggggaaagagggagggaatcacggggaatatttcccccctcttgattgcacgcgggacggacgggagcggcgggattcgcggcggcggcgacgctagggcacgggcgaggcggcgggagcgacgggaggtaggggatgacgggtgggccccacccgtcagcgagggtggcgggcgggcccgcccgtcagcggcgcgcgcgcggggaggaagccggatgggccgcgggggagaggggagagagggagagagatgggccgagacggcccaagaggggggggaaaagactttttagggtttttctttttataaaaccattttaactttgtttatttcttcttaattatcattggtgctctgaaaattccactaaaatttatttacgcattttaggcttttgggaaatatacaaaaatcctccaagccttatttgacttttaacttagcacattttaattgttggaggctttcacatggattttacttattctatgcataatttcgagaatgtattttagagtcgtttcgggacgcgacacccatgatgctgcaagaaggacctcgtgaagcactttgtgactacagatgctacatcagcacccgagaccagtcaaagatgatttgaaccatggtgctatatcaaaccaagattacagaactaaatatgtaatggcaaatttgctacatgacacttaaaaagtatggtttttgctgctagacaccacaagaacgtgaatttgctcgaggacacttcaaaagtatgtaatttaccatagaacaccaaacacattaaaatacaatatccatccaattaatgacagagaaaccatgtaaaaatgtcagttttgtcctcatctacttctcccttctcccttctcacgtaataagggatatttactgaaatcgaaacctacgtataaaccttttaccgatttgtcttaaaccatagcagttctattactgttttatgcgtaactcataaaccatctaacagaatgtggcaaccaatacaacttcggccatctagacaaaattgtcttcaactttcatgttgcgcaaagaatcagattatgcatctgttggtgtcagattaaggaaaaacgaactgttgtctttattttcagacccggcagcagtattattttttttttgttgtttctcctaaaccgtttgtaggattcgagcgatgactacaaacttcatttaggacaactaacctgaaacccgattgtttgctaccagttttgataatacagccagtgcataatcaaaaacctcaaaaaattgtacaaacgaccagcgaattaatttctattcaaatctcttacgtctagggactgaaaacaagttacccttgcaaaggaggaacactaacttgcaacaaatttccctaatttacgagatcgctgaattcctcaaagttgctctgccttttcctctccttcctcatgttcaactgcttcctggtctgctctctggacccttctctctgatcgatgcagcagcagcagcagcaaggccgaagagatcacatcagcagcagcagcaaaccatgcattagcagcagcagaaaggaatagatcagatcggcaacagcaggaaacggtagaagaagaagcagcagcagcagcaggaactcaccgggaaaaagcaaaacagaaagaaacaaccggttgcgatggatggcgacggctgcggcctccagctatggccgtggtggcggcggaaagacggcggcggcaaccaggacgacagtggccgcggccacagcacaggagtgtggcggctagggcaggctgtagcgttctctccttttttcccttttttttatataaagagactaaaaggagatctaacggtttcaatccccggaacatcgtttggactccgattactataaacttcgagtctattttgcagtactcaacaagttctatgcatccacggtttttgagattgcctattcgaacaacggtttaaacgttgaacttttctgtgtttgttccaattttcctcgaaatatactaatttgaaactcgggacattacaagtatagggctccaccaacatgtgtttaattccaagtcaaagtatgcaggtgagcatgcattaaattctccattaatcatgttatatataattaagagaatttcctaaattaaaataattttacaaattaacagagcgagtaagcagggtgtgtctttaaataatatgcaaaagccagtttattaagacaacaataggcagtttattaagacaacaagtaaatttagtaaagcaggtattaataaatacatatgtccaataacacatcagagatctaatggaccattagatagataattgtttttacaactcatgatctacttaactaaattatctaaaaggatggggactaaaagttaaatttgctaatttaattaaaactaacgttaacgaaaaggaagaaaacatgtaaaggggtggtgggccgaaatcaacatgatgcggcccaccaggctggttagggttagaaacgtaaccatcccgcggtttctccgccaccgccaccgtcaccacccattttcgctgccgccatcaagtccacttcgccaccgccgccgagtccaccaccgtcacaacccgtatccaccgccgcttccccttcgagtgcatcgccaccgctgttcgcatccactgtcgctccaccttcctccgctgcagcatcccccttttccgaaagcggcttgctggccgaagttaggccgatagcccccactcctcatcggagtcagagtccggtcagacctatacgctgttccccactccgtccggagcgtgcggctcgcagaaccatgaggaacaacgcggaggccggggcggtgtgctgcaatggctccggcattgacagcaagacgaggacggactgaagagtgccggctcccctgtgcacgtggctaggattccggtccagccgaaacccggtggcacgggagttggggaacaggcatcggattggcaactgtgtggtcattggagatggtggaggtgcagtcggtggtggcacggtgacgacaagcggaaccggtggctattccatctcttgcgggagggatcactactcatcggtgggcggcaccatcgcggttcatccatggtgagtacaaaactatacccctagacttggatgcggtggagcgcccccagcgaccggcgaggcaggggctggcggagaaggaggaggagtgaccggaattgcagcgacaagaattcagtgttgagggtggtggtggtggccaccaaccctagtccgacgcctgtcatgctgatggtggcaactcctcgtcgagcgatggtggagatggcgaagaaggcgatgaagaaggccaggaatggtgtcgatcatggaactgaaggtaggtataccttcttttcttcatcactttttctcgtgaagatcaaagtactgataacgtgttgaaaaggcaattgagattgtaagagtgagagaatataacgttgtgtgctttattgattaactagaaaatttgcgtgccagttggcacgcccaacttttatagcccgtaatatcgtttgaagggcttttaaatttgggtttaaaatactgatgatcacacaaaaaatttgctggcagagctgttggtattttctgtcctgagaaaattcaattaatatgagtactttataaaaaccatacattccacgaaacccttcaacaggttttacttttgtgtttgcaaaaaggttgtggaaaaagtagtaacatacgttagctaggggatatcgagttaataagtaaaatgttttttaataaaattgcacgttcacgtttttatgttttagcactcggaatctgtggatttgttttattcaaaaaatgaacgatttttttaggaagaaatatatatattccaacatgaattcattttggaattgcattttttttaaacgcctaacaatgcaccactaatcttaagatcagcactcttctttccattcttcccacattcagatgggcttggatgggccattggagctgcatgtcacctgctgcatgcctgcatggcccatgatgctgcacgagcatattgcaagcaagcaaccgcgtagagccgtgtatgcgccgtggggaaaaaggtacactgaaggtccctcaatttgtcatcgagttccaagatcatcccccaaccataaaacctgatacaacgtatcccccaacttacaaaaccagtgcaaacttaatctcttagtggttttgacccggttttatctgacgtggcgactgtgtcagcgtgggacccacgtgagccccacatgtcaggatgccacgtctgcacgctagcctctcccttcctctcttatcatttctcctttcttctcaccacacagcaccgggcggagcagaacagcgagctcgccggccctgcctcatccctcttcgtgcgtcgctgccggcctccccgccttcctcgccggcctcaccgtctcctccctcttcgcgcgttatatgcagctgaagacaaagcgagagagagagatgcagcgggtggaagttgaagcggctactcaacatcggggaggagcggaagctccgcgacgtcatccgtctcgtttctgccagtaatgccggcaggtctaaccgcgttcttcttgctcctttccaaccatcccgaggtggctgccgcaatccgggacgaagtcttccgcgtcgccagaggcagggaccctacggctaagggtgtaagttgctaacctgcgaaacccacttacaagctaaaataagccgcgagcccgcttattttgacctataagtgggttcgcggctgacccacttacacacctacccacgaccgcggaccgcctccttcgaattcgaaaagctaaagttcgaccccactgccgcttggagtatgccaacttcctcgagagggttgagatccagttcgagttgggtcggcgccgagtcccagtgcagcggatgatgcctgccagccgcatgggtatccgggaaggtcgacgccttctggccggggctgagcttgagccttgagctagctagctctcgtcaccattcattcaggttgacgccgctcgaggactcgacgtcgtcgtcaaccgcgacgtgatcccgtttggtttgttttctgacgaattccaatttaaccagacgggttgttcgtcctggtcctgaatcctggttggctagtcgatcgatatatgcaatgtgacatgccgattgaaattcttttcaacaccatgcatgacaaatttatcatttcttttggtctggggagtgtgcgccggcgacctccactccctccgccaccgcatgcgctcccacagcttcccctacccttcacctacttctacgctactaaggtctcctccggttcaagcggcggcggtacgtagaggctgcgtgcctcggtggcgcctccggagttcatgggcaagccggtgacggagcagtcgtgctcgttcgtcggggcgctcgagagtacatggccccaaaggtggcgagcgacagcgtgcatggtgtcgccgtggaccactgctcgcccgctccgaccggcgcagtgtggcgaggagaaaagagcagagaggagaatgagaatgagtatgacatgagggtcctatatgaagccattattttttaattattatctagtgtaactgacacatgggtccctatggtattttttcccaatcgaattgccacgtaagcgcaacgtcaataccatataggacgaatacctagctaaaggagccacgtagacatcacgtcagctaaaaccagagacaataccaccaaaagatcttgtttgtactagttttacaagttggaggatgcgctgtatccgattttgcggttcaagcacgaagacaagtctctgtctatggtactttttccgcgccgtggtgtttgctcgaagcttcgccttagcgtaacacgcgtcaaaaactgatttcgccatctggaccaatcggcagccgacggaaccgccagcatgagaatattagatgcgattagagcaaccataggcgcgatggcaacccatcgcgcctgttgccgaggagtgtcgagaggatctgttgccaagtatcgagaggatgagaaggggcggggcacggtacaatcgccatgccaaaccttcggttaccaatctgagattgatcatctatttatttcataacaccataaatggacaaatacatgcaaaaaaattcgataaaacatatgcattctcttatcggtaacaataatattatacattctagatgctacaaatacgtacgcaaaataagatgaactcttctattacacgtgtattctcttaattatgtggtagccttctcaaaaaaagaaaactaaatccttttctgtacagaaaattgaaaaggagtgacgagggtaagccagccggggagggtgaggaagtgaagcgaagcagctacttgtagtgccacggcggccggaacatctggaacgacggcttgtgcgacgccaacaccagcagcaccgccaccaccgccgcgacggcccacggcgacgcgccgccgccgtcgtccccgctactaccaccgtagccgccgccccaccgccacgacaccggcacggcgaccctccctccggcgtccaccagcgcgtggctcccgagcaggaccagtgccaccgccccgagcaccagcagcacccacagcccggcctgcgtgcgccgccgtagctgctcctcgtactcgtccatctgccacgtcaggtagaggaagaaccccacgatggcggagaccgccaccaccggcgccggcggcaggccgacggcgagccatccctgccgccactggaggtcactcgactcatccatgtgagcgagctacaaacgtgtgtatgtgtctgcttcatcgatcgctggtcgtatatattttggaggcaatcatgcaagcgaaggaggtggtattggaagcgatgtgagatttggtcttgtggttgcggatgagtggtgggtggtagatgcttgtggaagatgacacggcgcgacgcgtgtcgtgggtaggagtgaacgagtgatggcgttggagtggccggcgctttcagcatcgctgtggaatgctactcggcagtctgccatcggttgctctgccttgcagatcgctttaaggattttcctagatctttttctttgacctggaattggactttctagtgctacgtcaacaaaaatcactatctgcattgaaagccggatgctgatgatttagtagtattattaaaggtatataaaccagaaaacgtaactaatgttaaactagtttaaagacaaaataaattaaaacaaaatagattataatcatataattttcataatatgagaaatgatcgaacgaactataaaagatcaataacttcatacaacaaaaagaagaagaaagagtatgtgatttcttcgttataaactattttagactcatacatgtatatacttattgtttgtatattatatattcaaatggtgataaatattttttttagaaaacattaacaataaagattaatatgtgatatatcacttcacaaatacacaaggtcattgtcatggttatggataccacatacctaatagtagttgagtaaacttggcatggccaaccatataccatgtcttatacggaaacaaacctcgtatatagaacgagttccggataagaaaggacaaatagagttctatattgaaccaacaaggattactcggattgtatccatctttatctccctagtcttacttggacaaggtgccatctatggatataaatacaagccctcctaggacgagaggggacacgccacaaagccacaagccaacacacgccgccgcatatcaatatcagagataagcctagacataccccatccggtgcctacagatgccggcaagatggatctagcgccatatctgatctcgatgagttcatactcaaggaggaagactaccctgtcgtcgactacgagttggtgttcatgccgccaagtcgacgatggctagataggttatttcaattgttgtgctatgtggttttctatattaatcccatataaacaggatgtagggctattacctatcatataagggacctgaacctgtataaaatctttgtcttcatttcttttacttcaatctcgcatataccctggtaccaacgatccccataccatccaaataccgtagccgtgataccaaattaatgtcgacaatggcgcgtcagatagggaaattttggtgctttaaggttttcgacgagatgggttcaacacgtggatttttcaactactcaacgtcttttgactgtgggagttacaatcccatcgatgtgcgttctccaaccagatcaaaatcatcatcgccaactgttttatctatcacgatcgagcaagcttcaaggcattgtcatcgcagatacccgacaaattccggagttgatccggtaccaattccttcacatgtacgacatcaaccggcgcgaggacgcagcactgaacccaactcggcaacaacgcaagcagtctggatcggcttacttatattaaacgtactcgatcaggactgtcactgaccaaaccgattcatgcacgtgtacacatatagagcctaccgtgtccctgtgcaacagacaaacaatcggactactacatcaagcaagcacgtgcacacgtggacacaaagcagaactaatgcacaagcagtgtcattacacatgtacacaacaaaggtaattggtggattagtttcttaaattatctactaattttggcatgtatctacaaagatacgcaatattttatatacaatttaccgtatctatatttagactgtaaaatattgtcagatttataatttattatgtttacctagagcatgttttttatacaatattattgtgcaagtgtttccggtgttaggccgactacggtctaatatttatacaaatcatgcttatttacggtttacacaatgtctaatatttaatctgctcgttatatccattcgcgcagtcttttaagtacatactcgatattctctactatatatcttgtcttctagaaaatatttttcaggaacaattgagcactcttgtaggatgcggtcgagtacaccgctttattgagaacgttcttgaaaaatgctgagttgtcacacccaacctaccaacgaagactgacgacttatctcatgtatagcgccggctgcggctggactatttgagaaaatgttgttaacggataattcctcgtgaacgttgtcggcttgatcacccgacatgattgcgaatagacatccacggatggactatttgagaaaatgttgttaacggataattcctcgtgaacgttgtcggcttgatcacccgacatgattgcgaatagacatgcggatatgctaaaagttggttatgtgagtcatgctagccacgtgagatacacatgtaatcaccaactctagcgcctctccaggtgatcaagatacgtctacacctggtccttggccaatagatagtagcgatctctcaccaactaaaaattcatattcaggtgattgagatacgcctactcctggtccttgaccaatcggttacagcaatatctcgacatctaacgcaacagccaacattgtcgtggtagcgacaaccaagacccactagatcatcgttgtcaccaggacgacaacgtccaggattaacgacatcaggacgacaacagacaaggttaacgacatcacgacatcacacgacgacgacgaaactcgagatccccagacttctagagggcccgaggatgaggtagtaggtccaggagccgaacctctgactacggtaattcttcattgccttcgtcatcatcaggaggcagttctcgaagtcacaagaacgtcgtctatctattactctggattcccttcaaatggtcgaggtacgactacgactagtcttctactagcaacgtagcgatcctcgtaccacgacttctaatggtcgagttacgactacggctggtccccgaccagcagcgtagcggttctcgtacctcaattttctagtggtcgagttatgactacaataggtctttgaccagcggtgtagcgattctcccactacttttgcgatttgttgagtataactatacacctggtcttcacccggtgtggaagtcgtctcatcacgtcttatacgtcaacttctgtaagtgtttatatgtgcaatattcgtccgatgatcctcttttcttatattgccttcgtcctgaagtcggtcctactatccctttacactgttcatgtaagagtgctcaatggacgcgtattaaccaagccgtgtagttggaaaatgatttttccaacttcactactgggagctaggatttgtcaagcttctgcatggtttgttataagatacaagctgtctttgtggaaaatggcttttccataaaaacagctgggggctaggaagggtaccaaactccgattgctgagggcgactctagcgagagtactcttttattgtaacatgcagattcaatttattttcaatttttctatacatatcatgtcatgttacccttgagcgttcgctcggggggctatttcaacattgttgaagactccctgtctctacgattctataccgggatcgactaagcgagtacggcaaatgttctgagtattgatttcaggaaaatcagacatcagaacaatcaagtcagatttcaaggctttgtcgcagactctacgcctactcgattactcgagaacggttgatggggctcgacaaggaatatgaaacaaagcgatggtgtacccgccgagatggaatttcttgacttcaatccaaattctcgattacagcaaggcgggagacttagtcacatgctccatatcttctcgcttgacatcggagattaacctagacaaacctaataaagtgcctacaaaggccgatgagatctagccttatttctgaacacaccgagaacggtcaagcgagcacggcaatagttgttccaacgtcttcgatcgagaaccttaactcgttcatttgctgatgaacccagagttccactcgacactcaaggctgttgttggcccgatctttcggtgagttgtagctaactatgatttgggagaaacgttgacgatctgattacaaccgtacgagacgttgtgttgcgccttagcgatcgatacacctctccgtgggttgttgaacttgctgatgcaaatcaaccttattcctgtaaacaaatcaaagaaacaagcaataacaagataaaagcaatctgaattgcaaataggaatgaatacacgagataagttggggtttcgaatacaagcagacggacggtctagccgacacgcgcgctgtaaggaagtagcaatggctaaactttcatctaaacaaaacccgagaaaccctaaaggggtacctaactatttatggaggtgggaggatgacctaggggtgcctaggttcgtgctccacctagttggggcgcaccccacatgagccccacttgggccggggtcccaaacgaagttacaaacccattggcccaatataggtgacccaagaacttgtttctgtaattgcggccaaacgacatggaatttggcgatgaaactagatctgttggaaagagggctctgagatctttccatcaagtactcacgggccgaaaacgaaggtcgtatgcagattcagcgaccgtttgaatacagtagtgtagcatgtggccgcatcggattctagcacttggaggacttgatctctatatcttcttgttcatccatgatgtgagcaatggttgcatccatggtagccttggtcacatcatcctccccttcttcacggaaaaccatcctcgatttttccatatgatgctgtttgcatagtccatttacaacaacctatttctactaatcaaaacaaggcaaattcgagacaatttggttagcaataacatttctctctagcttgcatgttttatacacatgtacaggaagctctaaatccgagcaaatgtaaactctatgcacgaaatatattccaagatcattatatttaccaaagatgtaaaatataacattggttggacatggcaaatcagacttagcaaataatttcttcttcaaattattgagctcacaaaaatcatcacactgaacatagcccaaagtatttaaagaagatgttaattcacgttcctctacttcattagcaatgtgaataacacgcttaaaatcatcacataaagaactaacattagaaaatagcatgttcattcactagttgagacattgatataagtgaagcattatcacacaactctgctttatcacaaggaacaacaaacaaatcaacttgtgacaaaggaatctcagtagttggttccactaatggttgctctaccatagcataaaaagtggacaaattcaattcattaacaacacacccaccttaattaatttcagcaccattaagtttacctttgatgccctcttcagatgatggaggtgcctcgactttgagtgtgaacaatgggactatcggctctttcatgtctctctcctccatttcatgattatgcacttcctgcaaatggttagtaatagaagacaaaaacatagcatgttgcttcttcatgacctcctctattttactttcagcattgcaagcaagttgtaacaaatgagaaagagatgtatatctttgacaatcaagcatgtcctaaatttctttgttaagcccacgtaaaaacctcaattctgtagtttctttgcattcatctaaaccacaacgtaataaacaagatgtttcgttgaacattgcggtttgttgaacaagatgtttcgttgaacaacgtaataaagagatgtattctgtagcttctgtaacttcttgttttaaacattgcagtttgttgaacaaaatatcagcataatacataggaacataaatatctctcaaatatcgttttaggtctttccaatattgaggtattttattatggttacaaagatgtttccaatcattagaagcttgattaattaaaacactagaggcacacataaccttttgtttctcagacaagccatgctttttaaatttgctatcaactgctagctcccaattaatgtaaacatgaggattataatttccttcgaaataaggtagtccatatttgatctttccaagaacaatgtcacttacctcatcttggtcatgttgatcattcctcatgactcgacgaagatgtcgatgttgagcatgatggtcgcgtattcccttgcttaatcctgccatggttagtagtaaacaagaaacacacacaagaatatgtacgctcctatcaactactaggtagtgatagctcaaatatcacacacactcaaacttttaaccaaattcttataagatcttaccgaggcaagcggaatggtgacatacaccgactcaactaagcaccccaatggaggttggatatatcgatgcctgtcgtaggctcttcggaccttccattatatttgagagatgaagtgaataattcaagtcatcaaacaagcataatgaaacatccgacgcctcgagagaggaatattggagacattgttaggcccttagcctgccagtcaacttcagcctgagatgtgcctgtcaaccactcgaaggcggcgaccagatgtgttacacattcaggagacttgacaaaaatagctaaagatctacaacctctcaaatattcctaactcatactcatgtgaatctagttcccaggatgtgcactagatccatactttcatcttaagcatgattatacatagcaaacacaagtaagatgaaagaaacttaagacttacaacaacttaataattacataggctgatcggccaaatggatttattagagaatagcggaagcttgactacccaatcacaagcacaccaactaggggtttaccccattaagttctcatcctagaagaagcaatcggaacccgcatcactcaaaaactaagtctaaacttgcaaacaaaaggttatatcaacagcaagagtcagtacattaaacaagttaacgtactggcaagcacaagtcaatcctaccatactacatgtaaggcatatattcaaatgaaggcaatatgtagttcaatttcagcataaagcaagttttgtttcgcaattctttagtaaaagagttgatgcttcaattaacaaaacaaattttaagtttcaatattaagttcatcataattccatcataatcaatctcttgctgtcatcctttgacaacaagtcataatatgtcacctcacacacacaactcaacacatttatcaatttcaaactaatgtcacatgaccacattttaaaacataaagtctatactcatgacacatcaccaaaacgctcatgaccgacggctaatcgattagtttaaagaactctgcagagtttgtacacctttacccacatgatgtgatagaagcccggaggctacactctaggtggttcagtgccggccaagcaccccacactctacattatgagtgcggactagaggtcacaacgaagcctttacactacttagagcctagccttgcaccagcacgatacgtgttactccatcctaagccgtacacgttatatgacctagaaccgttaagtggcgggcccacgccttaaacttaacgccgtggtggcggacacaacgggaacccaccacgtggcacaataccgttgtattggacacgcttagtcacctaaactaccacttcggggtaaataggaagctcctctgaattatttgaactcatacacaccggcctaccagaatgcaaggctagtcctaaatagattaatcagcttaggccatcccatactagcacatgtggatgtacgaatatctttaaatgggtgacacaagttcggtccttatggacttgggcaaatactccccctatcggtatgcaactaacaccatatgcacaccacttgccgcccaagtataaaatcacattttacacattgtagttcgcaaatacccatcatattcattttattccagcaaaggttcatgtatgaaaatcacattttaattatagatggaatgagcatttgcatagttctaagtatggctaagcaagtagttgcacatagagcatatataaacccatttgagcacaaagagtgcactctaaccatttctaagtgttcaaatagcaagaagatcaattattcaaggtggggcaaataggtcataactaccttaacccaattttaaatactgatataatctaagttcacatgcaactttgcaaacaaatattttcattcctcaaatcatgggattcaatgtgttcaaaggatgggaggagaaaacttgccttgatcagagaaatgttagcacctaatccactccttcaccaattatgcaattatctagataaaggacacgttatgcaattaaacaccaaaagagctgaaaatccaaaatgctctaaaatgcatgatttatgcacagtgattaggtactggtctaaaattaatttaggtgaaagaatttttattttatcttatttcattagggagttatgaattttataagttttatcggttatagtattatagtcttaggtagtgttatgaaatacttttgtaaagttatttttattatattagacttcacagaggtgtagaggtgtgttttataagactaactcatttggtttcacaatttttggagttataatgattttcttatagattttacaagttacaacatgttttaggcatatagtgttttatatgtgcatgactctcaagttgtaggttcagaacatactacttcctgtttaagttgaataaaaggaataatttggttaactaaaacatttttagttcacatgtttatggtctttactactatggttcatattttataaactagagatgctctaatctaaactagcaatatattatattaacctagaaattgttatatgagctaagttcttctaagttttagtggatgaggatggaactatggcttcactggtcaattaagtttttatttaggtttaattagacctaaagtgtatatatacttatacatgtttatgtattacttaaacaacactatgtgtttaaattcttatttcactaggttaaggttttgatctatattctctacaaaaggtgccaaattttatttcactatgttgaagctaactatttgctggttctatagaaactttgttcatttcatttggactaaaaatgaattttctacaagttttacaaattaaaggctactctatgttagtaaatctttatatgaatatttagagacttttactacacagtaagtatataatcttatttcataaacatggaaatacatgttttggtgatcctacagaacttaagtttactcaaactgaagctaaattgggttctacatgaatttctaaactttagcttatctacactaatcattctagagataatagttttagaggcatttgatgcaaagtaagtaattacttttatttcacctaatcagagagtgcatgatgatgaatctgtagaatttgattttgtttcaaaatgagttgagatgaattttctatgtattttataagtttgtacatgttttatgtatgacctatcttagataaattctagaaacattatttgtatagtgagtgtcaagttttatatttctaaaatagagttcataactttaagaattctacagcaactagaatcatctcaaaatgagttatattttacaagtttgggtgttttcctgttaaacatttaatgttttagttatttttcctttgcattttcagatttttatacacatgggtccactgatcggtggctgaaccaatatacaaaaaggtccctgggctttatataaactgcatttaggtccataggtccacatgtaaacggctgaagttttatagtttgaaccctatgtttttaatcatttacaggacaaagtcctcatcttcaacctccagcagcccgatggactgggagcttggccatggctttggcgagctagtcggcgacgattggtggctcgattgggaatgaggtcaaaagataaaatgaagagaatgctctcacgattccattcctctagttttcttggctaggagacatcggagtagcgccgatggtgagggtgagcggaaggtatacatgagctgttactgcatgttgcctagggctttgattttgctagatgcatccatgcatgtgtttcctaagaggtccaggaggctcaccaagctgtaggaagaaatcgccgaagcttggatagcagcggctttggttggaacggttcgacggcagcgctcctcctcgggggaacggcgacggctcgaacaactcaaggacctgccatgcatgcatgtccaagatgttcgtgaggttatggagatggtgtatacgcgaggaatcgaacaatggctcaccgaggcagcggtaatcgacgatgatggcggaggcgatcctagatcggcgccgggaagcaaaggatgcgttctccgagtccttcacaactccggctagggttcttgaggcgtcttgaagaggtggtcgaggcgagattcttggcacagcggcttgcttcgggatggacaagaatggccggtcgacaacgatgtcgaagcggcggcgctccggtgcgtgctccagggcgtcattggcgtggtcacgttccggtggctgtgatgcacaaaacgagaggtggtcaacagagaagtggttcggcattgtgtggagagatggaaacgcgaaagagatagaggtgaccttgactcaaacggagatggcgatggtcgtcacctccatggccagtggtgaggtcgctggtgaaggagaggcagaggacctgctcccctcggcttcttcggctctgagtgatgagtgaggaatggcgactcagactggaggagaagagagcgagaaaaggaaagcccgaggtcgtcgacacgttgtggccacgcgtcggctcgctcgatctctccgtgtctgtgttcttggtcggctgagggtgaggcacaaagaaagggcgagctggagaggctgccaagtgggcccaggacgaagtgctctaggtggaagagagaggtgtgggtaagattctgggtgaacacggttttagacgaatttttagattattttctctcccctaactttgtagcttcataacttaatgtgtggaccaaattaattagtgttatttttctggaggtaaatgattacacctagattccattttctttggtttcactcaaaaataatggatagactgctcacagaaattaaacaaagattggctattagaaaggtagattgaatttttaagaagcctaaacagaggaggaaaattctagaaaaattatatttaggcatgacaaataatctagtatttgaataaattattttccatgttcacttatgtgcagttaaatgtacttttggatgaagtatggctttagccgattaaaatttaatttgatttcttttagttttttctgctttgactgattaatttgtggtattaaacttagttattaacttgtaccaagattatagtgaattgtttatgctaaacatagtttacataaatttttccatgatttcatcttgcatagattattttaaagaataagaataacctttctttgtatatgtgttcctactacataattgcacctaatattattatagggattacattaaacttcttttggactgagaaaaagataatagaatttaatattaagtccacatgttatactcatgagacctattataaaaagcgagaccaaaatccaaatacacaatggactcaagtctaggcatgcgttatgcacaagtatgctgtcacaccttgaagttcttttccaagcctaaattgaatttataaatcacctagagaaaatatcggtgtaaaagaaagagagaaaccctaataaattaatgcaaataataatcggaattggcatgtggaatttttcttgagttctatatgtcgaaatatgctaacaagatttttagtgaaatttttagagctctagaactaattttaagcaattaaaaatgagcacaagcaatatttaatcctaggaaaattcatttccttctttttctttttctttttcccctttttctttttcgaatgggccgccggcctattcttttcctcctccccctccccgctgggccggtcgaaggccacggcccagccggaggaggccggtctcccaactgccgctcccgcctctccctcgccttccgggccacgccgcccacgttgccgccctccccacgatccccgcgcccactccctctctcccccgcctgctcccgctctcgaaattcgaattcctcctctctctcctccccacttctccccactccgccggcgaatttgcggccatcccggccacgatcgacccccgcgggtctatataaagcgtccccgcctcctcttctctctttttcgttttgcaaccacccgctcccgtgccctccatcgcctagcgctgtcgccctcctctccgccgccgccgccaccgctccggtcgccgctagccgccgtgccaagccacgccgtcgatgccgtcacgctcaccgtcgtgcgggccgtcccgtccaactctcctccgtcagaatccgccattggaaccctctccgccccatgcgccagtgagcaccgccatggccgccgccttcggccggcgttctcacccctcccattttcctccctccctgtaacccctctcatctttttcgctaggtggttccggagaccgtccgccgttcgccgtcgtcccccggtcattcctcgccgcggttcgccgtcgtcccctcgtgccggccgaaccccggtcagcatctccccgtcgtctttccccctctccctcttagcgccgctgccttgctgctcggggccgcgccgccgcgcgccacggccgtcgggtcggcttgagccgtgcccgtgagcgcccgcccgcgagccgcctccgccgtccgatctattgggcggtagatcggggccgtccaaccccgccacccgcgtggctgccacgtggccgccacgtgtgcgctaagtcggcgccacgtgtgcaccatgtggtgcgccgctcctccccggtccatggacccggtccaccgtggaccgccccccccgagtcactgccaagtggggcccgcatgtcggcgccaccccctctctcccccggattttaattattacgcaataaatcaattttggatttttctgtttatagtaaaaacacagtgaatcttctaaaattcatatctaattcatccgagctccgtttaagcccattcaagtctcagaaaatcaagaaaaatgcatagaatccattaaaaatggttttgttctctgtttcagtaatcttatagcctgtttgtatcatttgctttgtatgtcgcttaaattccggctctcccgacgctccggtgtactttgaaatagtcgccgaggttcctccagcagtagagcaaggcaattcatgcttgtcacttgaacatgttgatctaaattgcaaatgctctaccgttttcccttaaatactgcattgttttataatgttactatgggatgtttacctactgttacagccatgctatttttgtaccttgttcctttgttagcttgaggatataacatgactagatattggactagggattgcttagccatgcttagttcaactagcacacaatgggggaaatcacattaatgcttagacttcaggttctagtgttggtgttggattaaagccaccgtcctggtgttagtcaattaaaatataacatatggtgggctgtgggtgcttggttttgatggtcgcacccatggcacttaaagaccggttcataggaaaccctggaagaattcctcgtacttgccacaagccagcgtgggcaacggctgggcttgtagtgtagcttttctctagctgacgcatccaggcaagggtgggcatgatggagtttggatgggccctgcgacggcctatgcggcttcctgattcacctaggcacgagaggggactgcccgctgccttgcgaggagtgggggtgaaacctgaggtgtggtgtgcttggttagagggggttatgcgaagggtcctgtcacggcctctatccggtatgtcgtggtggcatgtcggcgcacgggaacgtgtcgtggggctgtgtcttgtgggtacagttgtacacctctgatcagagtaaaactattcgaatagccgtgccctcggttatggacggtcaaccagattcaccgtgattagtctcactctagtcaagtctaatggaattgattagttcaggtggatggttgggcctgttgcaacgtggggtagcgttggacagtggatggataatattgagtaattaatacaactgttttactgctttcaactactatttttaaatgcttgatttatgcaaatgaaccgctctagctatcctttggttataccttgcatcataccctctattccggtatgacttgctgggtacggtggttgtactcagtcttgctctatttttcccaaaccccagagtttgagtatgcgtcagatggcggtttctccgaggagtaggcttcgtccgtgccgtcgaggatgcctgtggagtggtgttcccgctgcgctccaagtcaaggcttagctccagttatcttttaattttccgctgcatttatgtaagacttttatggtgtttgtaaggtgtggatctgtatgtcaactttgttgtttgtgtaccccggccacattctgcttggaattctattcgggaatttctgggcgtgacatatgctcaaatgcttgctgacatttctagtctaatgttgggaatgaaaatgttttattttgttctcaaattttaatcatgcaatggtttaagttggtcatcacctaaattaaaacggaaatttttggctctcaaaattggataagttaacctctaactattttgacaagaaattttaagtcctgaaattttgggtatgttataatgccttagcaaatactcgttgtacagctgcaatcaaatctgtggagctgtagatagccttaaatatgtagcaaatgaatagcaaatgctcaaatcagagaatgcaaagttgaatagttgttcaaagtcaagtaccgcgccggttctaggctagaatgtactagagatgtgagcctagagataaatgataccacaagataacacgagaaacaactcaagcacactgatatatcaaaattcagctcaaagatacaactgattttttttctttcttcttctttcttttcttcttcctttttttcttcttctttttttttgtgcggcttttcttttcttcttttttttacggacctttctgcctttttctctatttcttttcaacaaaaactgaatcaaggacctcaatgtaaggtcatagggactcaaatgtaaatttgaaaattgcagggactcaactgtaaaagtccaaaccaaaattaaaaattatacagaaatggaatgctgagtttataccggttctgtttttgcaaactgaactcgaaaccgacgcaaaacaaaaattcacaaaagtgtaatcgagacggtggaggtcgaaacctctaataggtaatcgatcgccatggtgatcggctagcgatcatgaggcgcccctctccctccacctggttttcttttttggcaccgcattactttcctattttagtaaatttatgcacctaaagtttatacacctcaagtttatacatctaaagtttagagaccaaaagtttataagtcaaaagtttatataaccgattcaaatttgaatttgaattcaaatattttttatatatagtatttctatacatctgtcaaaagtttatatacccgtttcaaatttgaatttgaactatatccgatttgaatttgaattcaaatatttttatatatagtatttatatacatctaaggtttatagacccaaagtttatagtcaaatgtttatatacccgtttcaaatttgaatttgaattatatccgatttaaatttgaatttaaattcaaatattttctatatatagtatttctatatatctaaagtttatacacctaaagtttatagatccaaagtttataagtcaaaagtttatatagccgattcaaatttgaatttgaatttcaattttttatatatagtattcctatacataaaattttctaactttttttttaaaaaaaatttgtggtgtactgtagtaggaagagaagagggaggaggaagggggagaggagggaggagtgtatctgaggagggagggggcggacgccattaggcgtgcctggtggaggtacggtggggaaggaaaccgaaaggtgagggagtcggactttggcctcggcaactgggcacgtaggacttactcacatggaaagaaacgcacacgtgggggtggagggagaggactcggccaaattggaaaggtcagccttggatggaaacaaaccaacctgattgatctaatctacaaacagacgcccccttccttcttcctttttcaggcgcaacagcacgaccacgggagagggttcaaacacacgacacaaaacctggatgcaactcatcaacttcaaaaccgaccaacaaaaatttatgaaaactacaaaattagaaccgtggcagcaagctgattccgtttttgtaggtccggacaacaatagagacacggtggcggtgacgactgtggtacaaaacgtaactagaactcgaaactctaaacggactagacactaaaaccagcaacttgattcgacgatgtaacgcaaaacacaacaaggcaaaaactgataagaacaatgcaatagcacaatatggctaggtaatagatgagtttatttatttttggttattttctgggaataggtagatgaaaactcaccgaccaacgaaagctctgataccacctgatgaaccctgagtttcactcgagattcaaggctgttgttggcctgatctttcggtgagttgtagataactacaatttgggagaaacatcaccgatccgactacaaccgtacgagacgttgtgttgcgccttagcgatcgacacacctcttcgtgggttgttgatcttgccgatgcaaatcaaccttattcctgcaagcaaatcgaagaaacaagcaagaacaagataaaagcaatctgaattgcaaatagaaatgaatacacgagataagttggggtttcgaatacaagcagacggacggtctagccgacacgtgctctgcaagaaagtagcaatggctaaactttcatctaaacaaaacccgagaaaccctgaaggggtacctaactatttatggaggtaggaggatgacctagggatgcctagggtcatgctccacctggttggggcacaccccacatgatccccacttgggccggggtcccaaacgatgttacaagcccattggcccaatataggtgacacaacaccttgtttctgtaattgcggccaaacgacatgtaatttggtgatgaagctggatccgttggaaagagggctctgagatctttccatcaagtactcacgggccgaaaacggaggtcgtatacagattcggcgaccgtttgaatacaacagtgtagcatgtggccgaatcagattccagcacttggaggacttgatctcgatatcttcttgttcatacatgatgtaaggaatggttgcatccatggtagcatggtcacatcatttgcattgaagtcgggggctactgtcatggttatggataccacatacctaatagtagtggactaaactccgcagggcccaccacataccatgtcttatacagaaacaaacctcgtatatagaaggagttccggataagaaaggacaaatagagttctatatggaaacgacaaggattactccaattgtgtccatttttatctccctagtcttacttggacaagggggcatccatgggtataaatacaagcccccctaggaggagtggtgacacgccacaaagccacaagccaacacacgccgccggatatcaacattagagataagcctagacataccccatccggtgcctacggaagtcggcaagagggatctagcgccatctctaatctcgacgagttcatactcgagaaggaaaactaccctgtcgttgactacgagttggtgttcacgccgccaagtcgacgatggctagataggttatcccaattgttgtacgctgtggttttctatatcaatcccatataaacaggatgtagggctattacctgtcagataaggggcccgaacctgtataaaaatccctgtcttcgtctcttttactttaatctcgcatatatcctggtaccaacgatcccataccatccaaataccgtagtcgcgataccaaacgtcgacagtcatgttgcaagaaaaaataaatttgattacggatatatcttagctagctataaacttgatgcctcttgttgtattggtttaatgtggtaacataaattctcaatttttttattttgctatcacatccacctcctagttccagatctagatctagatcttgtaatatatagagagagaataaaatttttaatttctatttatttggtgcaatcaaaaaataattatattagtttgtaattgatgtgaccatgactactacggatacaaccattgctcatatcatggatgaacaaggagatataaggatcaagtcctccaagtgctggaatccgattcggccacctgctacactgctgacttcaaacggccgccgaatctgcatacgacctccgttttcggccttgagtacttgatggaaagttctcggagccctctttccaacggatccagcctcttctccgaattccatctcgtgtggccagaatcacaggaacaaggtgttgcgtcacctataatgggcctatgggcttgtaactttgtttgggaccccggcccaagtggggcccatgtggggtgcgccccaagctagtggagcacgaccctaggaccctcttggtcattctcccacatcctataagtagctaggtaccccttcagggtttctcgggttttaatagattaaagtttagccattgctacttgcttgcagcgcgcgtgtcggctagaccgtccgtctgctggttcttcggaaccccaacttatcatttgtattaaattcctatttgcaatatcagattgcttttatcttgttcttgcttgtttcttcgatttgcttgcaggaatagggttgatctgcaccggcaagatcaataacccacggagaggtgtatcaatcgctaaggcgcaacacaacgtctcgtacggttgtagtcagatcgtcaacgtttcttccaaatcgtagttatcacaactcaccgaaagatcgggccaacaacagccttgagtgtcgagaggaactcagggtccatcaggtggtatcagagctttctttgctcggtgagtttttatctacccataaccagaaaatagccatacaaaaaaatttgtatcatttacctagccatattgtgccattgaattgttcatttctatttttgccttgttgaattttgtgttgcatcgtcacgtcgtcttgctggtcttagcatctagttcgtttagagtttcgagttctagtcacgttttataccacagtcgtcgtcgcctccgtgtctctgttgtcgtcgggacctacgaaatggaattggctcactgccacggttctatttttgtagttttcagaagtttttatcggtcagttttggagttgcatctagcttttgcttgagttttggtttgcccgtgaatagatcgctcgtgcttgttgccggcgctgagaggaggaagaagaatttccaaatttgtttttggaagtttgagagtttaatttggaaagaaatagtagatcagattgattgaagatcagtttccctttttctctcaccaaatccggactcctagagatgccgtatccatccacccgtcgcccactaccaccgtgaggagtccgattccctccctcttccgttggtttagatccataccgtgtcttcccgcatagcttggtgaaaattttcagtgtgtccgattgtagatccgtttggaaaaacggaaccagtataaatttagcattccatttttgtataattttaattttggatttgcacttttacagttgagtccctgtaatttttatatttacatttgagtccctatgaccttatattgaggtccttgagtcggtttttgttaaaaaaaaggcagaaaggtgcttaaaaaaaagaagaaaaaaaagccacaccaaaaaaagaaaagaaaagaaaaagaaaagaaaagcaggaaagacaaaaaaaaaaaagagaaagaaagaaagaagaaaaggagaaaatcattttgttatcattgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctgcacagttttgattacggccgtaccgcaagtgtttgccaaggcatcgatacacccaacctccattggggtgcttggttgagtcggtgtacattaccattccgcttgctttggtaagaacttgtaagagcttggttaaaagcttgattgtgtgtgatatttgagctgccactacctagtagttgataggagcgtgcatatttttgtgtgtttcttgtttgctactaaccatggcaggattgcgtaagggaatacgagaacatcaacttctacaccttcgacgagatatcacgacttctccacgtgatgcatatgaggtacatgactataattttgaacaagttgcatctaagttaccattctatgatgggaagtacgattctgttgcatacattgattgggagctagcagtagacaatgaatttgatatatatgatttttctgatactcaaatgattaaggctgctagtaataagtttacctcttctgcattattttggtggacttatgttagtaataaacctgaaacttgggatgaattgaaaaccatgatgagaaagcgctctgtgacatcttattacaaatgtactcttcgggagaaattagaacatctgaaacaaggtgatagaactgttagggagtacattcatgaatttaaggtctgtatcatctacagtggtctcaaagagtgcaatgaaaatacaatgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagatcagcacatccaagaaaaggagaatggtatacttgagaagaaagaggatgaagcacctgcgatgtctaaagaaagttcgcaaggtaaattaaatggtgctgagagaaatgaaggtgagtattctcaaggtgagctacacttgtccacttttcatgctatagtagagcaaccattagtagaatcaattgctgagttgcctttgtcacaagttgatttacttgctgttccttgtcataaagaatagttgtgcgataatgcttcacttatatccatgccacaactagtgaatgaacatgctattcctgttgttaatactaactgcgctgattttaagcatgttaccatggctactacggatacaaccattgctcacatcatggatgaacaaggagatataaggatcaagtcctccaagtgctggaatccgattcggccacctgctacactgctgacttcaaatggccgccgaatctgcatacgacctccgttttcggcccgtgagtacttgatggaaagttctcggaaccctctttccaacggatccagcttcttctccgaattccatctcgtgtggccagaatcacaggaataatgggcctatgggcttgtaactttgtttgggaccccggcccaagtggggcccatgtggggtgcgccccaagctagtggagcatgaccctaggaccctcttgatcattctcccacatcctataagtagctaggtaccccttcagggtttctcgggttttgatagattaaagtttagcaattgctacttgcttgcagcgcgcgtgtcggctagaccgtccgtctgcttgttcttcggaaccccaacttatcatttgtataaaattcctatttgcaatatcagattgcttttatcttgttcttgcttgtttcttcgatttgcttgtaggaatagggttgatctgcaccgacaagatcaataacccacggagaggtgtatcgatcgctaaggcgcaacacaacgtctcgtacggttgtagtcggattgtcaacgtttcttccaaatcgtagttatcataactcaccgaaagatcgggccaacaacagtcttgagtgtcgagaggaacttagggtccatcagtaatatgccgatgatatgattttgttagatttttctaatatactaatttggcatgtctgtgtaaaaaaattgaaataaactttgtttttttattaatttacaaataacctttagttaattagtttttaatagcgataagttttttcaataaaccctacaaatttggttttaattgtgcaaataatttatgttcattttttagagatatggaaagtcgggaatggatgtatcattggccgaggtttttgtctccatatagaaacgaagtgtctaaatttattgctattgccaaggcacacgctgagaagaacaatatgaggaagataatttgtccatgtgctgactgtaagaatgaaatagcctgggacttcgacgatgcttttaaagtgaaggagcgcttagtaactcgtggatttatggacaagtatgaaatatggacacgtcatggcgaagaacaagtggacgggcctgaaaatgtagttccgacacaagttgaagacatggtgcatgacgatggttctgttgaggacaaaatcgacctagaggaaatgttacgtcatgcagaacccgaggtgctgatggggtcggctagagctttacagaaggcagctaaggaagttttgtacgatgagtcaaagggctgtgacagtgagttcacaacactacggtcagttcttgaacttatgaggttaaaggcgaaacatggatggtctgataccagtttcgacagtctgttagaacttctgcagaaaatgctcctgaggcctaactcactaccatccagcacatatcaagcgaagaaactcatatgtcccctttcacttggtgtggaaaagattcatgtgtgcgttaatcactgcatactgtacaggaaagagtacgcttcttttgatgaatgtccaacatgcaatgctagccagtacaaatcgaatagcaatactggcctagaaccgtctgacacaactgagggaagacagagaaaaatcccgcagcttgtgatgtggtaccttcctgtcaaagaccgcattaaacggatatactcaaacccaagagatgcggaactaatgtgctggcatgaagaagggcacaagaaggatgggatgattcgacacccggcagatgctcgtcagtggataaactttgatgctcagtatagagagtttgctaaagacccacggaacattagatttgccctgagtattgatggagttaatccttttggagacatgagcagctcacatagtacttggccagtgctgtcaccatgtataatcttcctacctggctttgtcaaaagcgaaaatacgtactactctggatcctcatacagggaccccgtcaatctggtattgatattgacgtatttcttgaaccattgttggaagatattgctgatttatggaaagagggattgaaagtgtgggacgagtacttaagggaatacttcacgatgaaggccatcatcttcgtgaccattaacgattatccagcaatgttttcagtttcaggtcaaattaaaggtaaaacaggatgtgtgatctgcttgaatggaacatactattggtatctcccgggttccaacaagcttgtgtacatgcggcaccggcggttcctacgcacaaatcacaagtaccgcaagatgaaggcggagttcgagggcactgaagagattgatcctgcaccaaaacctacatcgggggaaaaagtgtgtgcaatgacagaaaattgtttgcgaatttggaaatgtgactaagaaaccatcaaaggggacaaagcgcaagaaacccgagaagactatgtgggatagtaagaagcaagatgatagttcgaagtcagatgataaactcccttccccattcaaaaagcattccatattctttaagtacctcccgtactggaaagatctggaggttcggcatgccatagacgtcatgcatctagagaagaatgtgtttgataacatagttggaacattgttagacatgccgaagaagactaaagatggtctgcaatcaaggatggacatagtcgagatgggaatcagggaagagttacaccctcagaaggagagaagaatggcaaagtatatcttccaccggcctgtttcacactgacacctgaggagaagaagtcattttgcaagtcactccgtgatgtcagagtgcccataggtttcttgtcaaacatcagtcgactagtttaaatgaaatatttgtcggtatctggttataattcacacgattgtcatgtcttgctcaccgtgtttcttgcaattacaataagggccataaaaccagagtatttaaaggttgctatcacaaggtagtgctactttttcaacgcagtgtcacagaaggtcattagtctcgaagagttaggaaatctccgtacattcgcacatgagacacagtgccaacttgagatgtgtttccctccgtcattttttgatatgatggagcacctcattgttcacatagtgccgcagatggttgcgcttggcccactgtacctacatcaaatgtggtcatacgagcgttacatggcggttttgaagggttacgtccgaaatcgtgcacatccagagggatcaatggttgagggttatagtactggagaggttgtcgagtgctgtatcgattacctcaaagatggatatgcaattggagtacctgtgccccgacacgagggcagattgagtggtaggggaacgataggaaagaagagattcgtcacccatgatcacaaatcattccaagaagctcacttcagtgtccttcatcagtttgctatcgttgagccttacatcgatcaacatatcgagctaatacgagctaacaataagggtcgcaccaccgagtggataatgaaagaacacaagcgtctcttcatagattggttgagagacctagacttacctaagggacaaactacagatgaaataactatgaaacggttggcttgtggtccatcaactacagtaaattcttggcaaggatatgacattaatggatactcgtttagtacaagagcccgagataataaaacctgtacgcaaaacatcggtgtccgtgtggaggcaattgatgaagccagggaaaaacaatcatacttcgggtttattgaagaaatatgggaaatcgactatgggcacacaatgcaattccccatatttaagtgccagtggcaaaaatacccgaacggggtcaatgttgataagttcggtcttattg

SEQ ID NO: 61181 - DNA, 9995 bp, Oryza sativa
  unsure (1)..(9995): unsure at all n locations
tgagcatggagaaatgcataacttgtccctataatgcacaagtaacaagaatcacctcagaaatgtagaactggcctctatcgtgaaggcttccgcagcctcccctattcagtaaaattaagcattttagtattgatcaatcgcctaactaacacaattcataagcccaatctatttttagatacctattatacttgccaaatttcataaatcagtataacgtagtcagataaaaaaaatgcaaatagacatggtacataccatttaccacataaacatactggagcgaagttactatacactgcaacaactacatgtatctcaatcccatgatacgaccactgatcagcaccttaatcttggaataccgccaatttgagtgtagatgtatgtcaacctagttttcccaaattgatccgtacttatatattgtccatgcttatcttacatgtggaatatttctgtaagaaacaatcaaaatctgccatatatataatccctctaacatgaatgaaaataacagaatgacaataaaaagcactatttagcctagtattaactacagaaagcaacagcctagtgaatacaaacctgaaagtcattaagctccacatcactgtgtgcttccctgtcatggtcacatagactaaatatctgctacaaagccctcacaaaccgtcgctttagagattgtgcctcttataaaacaatggagctattgggttaagcataaccttttcagcatagtagaagacctccggaacctgcaaatatccataaattatattatatagttaatccaagccttgcacaatatctggaattctatctcagggaaggcactggttaaaattatcaagtgcatagtacagtagatgtttgatcaggttacacaaaaaattatcaaggcagatatgggcaatacacgtagtacattgttagagatggacagcactgtgttctcaaactgagcatcaggaaaattagtgatccaaatttattactaaagccctgaaaatcaagtattaattccataagactacagagcatttcatcaagctgtagcaatcaagttgtgtacatcaaaatagcaggcaatgcaattaaccatgcataaatgcaacagtgggatttagcttgcacaacaacatgtatcttccatcacagtatcaacacagagtcaggaatgaaaaaaatgggatttaacttgcacaaccaaatcattatagcttcatgtgccaactctttccccttagccttctatgtaacacatgattggaaatatgtgtaaatagaaaaaaaaaatgtcttataccaaggaattttagtgcaagtattttttttacaaaaatgtggagtaggaagcattcctttccttccaaatcacagaaaaaatatacactctcctgctgaggattttatacatgaaggaatacaaaggaatgttagaaatattaacaaatataatgccgagttgatgccaggagtgtatcgatcttagaactgctttgatatatcgggttcccacccacctagtacgcgacaactgtttagaaattagaagagtatcaaggtttgacatccaccgagaattttgaaaacaaattacaattacagttgatagaaaatattagcctacaggatatcaattattaactattcactcttgagagtagttcaaaaaatatttgcttaatctcctgtcttagcactttgtcgagcacttggccggcagaatgtactcaagcaattcatcaagtcctgcaaggaagaatcaagcaattcgtgaagcacgtaccaataatcaaggcggcccggcccgttgccgatcacgatcatgtcctgcacgatgtcatcccattggtcccgtggccgcccgtcaccaccaaccaatgacctgggcgaagcaactgagggcgtcgagcagcaggtgttcggggacgaacgccgccaccaccaagcacgccgccgcagcacggccgccccgggtcttcgcccgacaccgcccaagcacacgggcgtccgacggcgcccagccagccgccagcctcaccgctagccacgccggctcttcggccggtgtcatcaaccgctgccacccgcgtcccaccagccagccacgccatcgcccgcgtctcccgtcggccgtctctcccgccaaacgccgccgtcctcacgacacctgccgccgtcgtccgctccgtcagctcaccggccagatccggtggtgacgggccggatccagccacggaagggccggatccgacagcggcggcggcggatccgcagccacgcgccgcgccgctgcgaggccttcccggcgcactgtgccgcctcctcgcgccggagacgggccgtcgccgccatcccagcgtccacgcggtttccggcggcggcgaggcggtgagaggaggggagggtggcggcggccgggggctcgcccgcacgtggacgaccgaaggcgcgtgaagcaaaatttcagtgttccttcatacaagaatgtctcggtcgtcttctttgcctgcaggcgtcggcgtcggcctccttgttcttcttattcctccttcgcgtcagcagtagggtctcgacagtcgacggcggggcgaggagatcatggcgaaactggggtgggggtgaggtaggcgcggatgcggtgcggggagaggcggatctgggagggaggtgagagaggcgcagatgcgcaaatccagtggtgccgtcggatgtaatttgtcgtatgattttgcaccgttggatatgtgatatgataaatgatgaatgagtaaaaccatttgttgaactatatggtagataatgtaatatgattcatcccattaatgagctaatgtttctaagcatggctaagcaattatatataaagcatttagttgaaccaaaccaatatataaagttcaagctaatcaatttattacccataggaaaataaagtcatctttggccattaattaattgggaaaggcccaccacccgatgacattcaaaattaatgcataagttgaaataaaacattaactttaaacaagttcaacatgctcaaagggttgtttgggatctgtgtgactttccttgagcttcttcaaatgcttttgaaccttcctcaacgtaaacgctctcctccggaacgtcggaaactaaagcaaataaacaaaatcaacaaaacagtaaaaaacaagcataaacagtatatgtggatatttttaacatgtagatctcgattttagatgaatttagcaactcgaaccacttgaatctgagttacgatgatttagttatgaatttctgaagtttaatcagattttcatctaatacagaaaattattactatttaaataaaggatttatgatgtcaggatgacatcatcgtagccatggcactggaccacgactccgccagcgatagagagctcgggcgactaaaccgaaggcacctacacaaagaggacgacgagacgaactcaccgaagcaaagaactacgacaaacgacggcgaacgaagaccgacgacgaacttgacggcggcacggctcggctcgatgttgacggcgacgctccggcgaattgcagcagcggcgaaggagcggacgggacgctcctccacctggcgaacctgacggtggcgacggaaagcggcagcgacgaccacagcggcaacgcggcgcggccgaagcggctacggcggcgacggcactagggtttacgcggtggcagcggcgctataggcgacggctgcagcttggacttgaggcaaacggaagaggacgactaggggatgctttaaataggcatggttgagggagatcggactccaatcgagaggatttgagccggaaaaatccgatggttagtttggagagataaactcgaaaacgaatccaaattcgcatcgaactcaaagggataagatcggatttttgggggaagggagagaagaggataagggaaacaaatccactcaactaattttagaaatgcacgagaggaaaggccagatttggaggggaaaaaccgagccaattcggcctcaggtcggctgcctgaggtttgaagaagaacagtgcacagggaagcaaagtaaactttcagtcttgggccggctgaaaatataatagagaaagaaagagaagggggaagctcggctgtgctaactgggctgcacaaccgtgctcccaaaagagggagatgggctaaaatcagtccaacggcttatgggaagattaaaaactttttcaattaaaataattcgtaaaatgatgtttcatttattaaaaatactttccttgctcaaataattcacagaaaaatctagaaaatagataaacaagcaaagtatttaatgaaattttatctaactcagttttatgttgctatttttcctagattattagagtttaacttgtaagcctttaaaataatttctaaaaatgtgttacagaatgaattattaaattaggcgattttcagggcgtgacaagcctacccctcttaaacggaatctcgtcctcgagattcagaagaactagcaaaaagatgagaatgagctgacttcaattcatcttctcgctcccaagtggcttcttcttctgaatgattgctccactgaaccttacagaaccgtatgatgcgattcctggtgtttctcttattcaccacaagaattcggactggcttctcaacataagttaaatctttttgaagctctatatgctcaggatctgcttcctccgtaggtacacgcaaacatttcttcaactgcgacacatggaacacgtcatgtattcccgccattgacggaggcaactctagttgataagctacttcacctctccgactcacaatcttaaaaggtcccacaaatcgcggtgccaatttccctttggtctgaaaacgatgaactccccgcagcagcgtaacccgtaggtatacataatctccttcttcgaaagtcaaatccctacgacgattgtctgcatagctcttctaacgtgactgggcaatacgcaacctttcttggataatcttcactttttcttctgcctctcgcaatatatctgtcccaaaaacttgacgctcaccggtttgatcccaaatggagcggtgtacgacactttcgaccatacaatgcttcatatggagccatttgaagactagcttgataactgttgatataaccgaattcggcgtacggcatattcttatcccaacttccaccgaaatctagaacacaggctctcaacatgtcttctaaaatttgattcactctttttgtctggccatcagtttgagggtgataagtagtactgaaattcaaacgagtacgcatctcttcttgtagtttccgccaaaacatcgaagtaaactgactacctctgtctgacactattttcttgggaacaccatgtaaacatacaactcttgccatatataactctgcaagcttatttcccgagtaggttgttttgacaggtataaaatgagcaactttagtaagcctatcaaccactacccaaatagaatcttgtcctgccgacgttctgggtagaccggtgatataatccattcctatttcctcccatttccactctagaatcttcaacggttgcagctgacaggctggcttctgatgctccgccttgactcgctgacacacatcacatagagccacatattccgctatctctcatcgcatgctagcccaccagaattgttgcttcaggtcttgatacatcttagtgctcccaggatgaatggaatacaaagtttcatgagcttctttcatgatagttgttaacagtgaaatttggtaatcggcaaagacgtcatcggcttagaatcattatcggttgtagcatctcggaatcagccgatgggagttatcaagtcgccaataatcggattcctgctatattcggttaaggaaatcaatctactaaaggaagcttatccctaagtgaccgagtttagagaggatgcggcatggcagtttatatattaattaggaatagtttgttagtttccttttatctttaggaaagtgtgtttagtgtccgataaggacttcatattttccttttatctttaggtgagtttctttcttgtccgacaaggacttgtatcaacccatggttataaatatgtacacccggggtctatgtaatctatctctacgatcaatacaattcggctcatcgccaccctttttacttctacttttgttttttacgttccggcggaacttggcacccgacgcggggctgcatcgtcttcgatctccggcgaagggataagtccaatgttccgtcggcccaggcaattgtctcatctacgtcggcgtcgttcaaggctgcatcagtatattcgacctcttggattgctctggtttgaatgatatatttgtctacctatttattatatgtctctgttaatctagtcttagcatatcaatttagctctatcggctgcttctcgttttagggtttctgccggtatcggctaaatcgcgttgctagattagattagcttagatatctaccaccctgaaaatcagtcaacggcttgattgtctagatattgtgtttcttttcatacttagtgctgcatcagttaagtttgatctactaagtcgtgcttagaaccataatctctagcctgcttcttgattgccaataggggttgggtttcagccgatgagttatctggatgttgcatcggctcataaggatttcatatacatataagttggatttagccgatgacaacaaaagtttcattgtttaatctaatcttgtggatttcatggcatcggaccaccagccgatgtgtgctttaaccttcggatcgatgcttatctatcatataaatgctagccgattggtttatactggactatattattgttatattttattatcagtagccgattgcctttatatcatcatctacattggacatatagccgattgcttaaaccctatcgctatcggctggtatcggcatcggctattatcggctatcggctggaactactccatcggcttgtcagccgatcggncttgtcagccgatcggcttgttttgatcctactatttngcatatcttgtcagttgcaggatcaaactgactagcacgcccgcatctcatcaatctttggacttgcactggagctaagcagatctcccaggccggtgtgtccgatttttttttgtcaacaatagtatccttcaactccttattatggggcacgcaaattttttctcctagccacacagttccttgctcatcttctaataaccgatggtttttcctcttctcatgttcttttcaatttcttagatatcaagatcattcacttgagcctctctaacttgatcaaaaagagtaggttgagcttctaaagcggcaacaaaacctttattgactattcccaagttcaacttttccaattcctggcataactcccaaggtaggtgtcgtccttctgacatattacagtagcttttcctgctgagagcatctgctacaacatttgctttacctggatgataatgaatttccatgtcataatccttgatcaactctaaccatcttcgttgacgcatgttcagattaggttgagtgaaaatgtactttaaacatttatgatccgtatacatctccgtacggttatcaaaaaggtaatgacgccaaatcttcaattcatgaaccacagctgccaactctacatcatgtgttggatagttattctcatgagggcgtaactgcctagatgtataggcaaccaccttcccatcttgcatcaaaacacaacccaaaccatgtctagatgcatcacaatacacctgaaaacctttccttggatcaggcaagactaacattggcgcagtcactagccttttcttcaattcttgaaaactctgctcacactcttccgtccacttatacttcacatccttctgaagcagtcgagacattggtctagcgatctttgagaagttctcaataaacctgcggtagtaccccgcagaccaaggaaactacgaatctctgagaccatcttaggttgcttccaatttagcactcactccacattgcttggatccacgacaactcctccagctgagatgacatgactaaggaacttcacttcgggcaaccaaattcacatttactaaacttggcatagagctgatgctcacgtagtttctctaaagcaagacgaagatgctcttcatgctcttcttttgtcttggagtaaataaggatgtcatcaataaacaccacgacaaacttatctagatattccataaacacgttgttcatcaagttcatgaaataagccggggcattagtgagtccaaacgacataacgggactttcaaacaaaccataccgtgttgtaaaggcgatctttggtatatcctcctcacggattcaaaggtggtgatatccggaacaaagatctttcttggagaagactgtggcaccttccaattgatcaaacaagtcatcaatcctaggtagaggatacttattcttgatagtgacctcattcaacgctcgataatccacacacattctttggggatgaactttcttctccacaaagatgactggtgctccccacggcgaagtactgggtctgatatatcctttctgaagcaaatcatccacctgtctctttacctctgctaactcaatagctggcattctgtaaggtcttttatggatagggttggtttcaggtactaagtttatccggaactctatgtctctcttaggtggcatacctggcaaatccctttggaacacatctggatagtcttgtactattgggatctcttgcaaagcaacttgatttaatgtcaaaccatgagatctaggggaggacacaaagaaagacactgtttacccattgctacttgttaaagtcaccttacggttagcacaatctataactcctctgtgatgggttagccaatccacccttaagataacatcaagatctttggattctagcaagataagtgtggatgggaaaggaatttcttgtatttctgtagtaatggaaggacagtactgcgttgaggatacttgattgcctggggtattaactagtaaaggcctcccaagactaataacttccattccatgattgctcgcaaaacttttagacaaaaaggaatgtgtagcaccgaaatcaaaaagcacagttgcgggtatagagttaacaggaaacgtacccaaaaccacatcaggtgcattctaggcttctgcagctgcaacgtgattaacacgagccttcggtgctggagcattggagttgttctggacaggagcattcttcacacgccgaggctttggacacttatcagcataatgtcctggatcaccacaattgaagcacacccctggcttgattccctgttccttcctgacaggctgattttgagttggagctgctacaggacgagtgaccacattacgattgtcgttgctgtgattaccagtgttgttgttgtagaactggcgttgagggcgagcaactgaagaggatcctccctatgggtatggtgcagcttgaggtcccaaagcaatgcgcggcctctggctattaccctattgagccttgaaataagcagccctacgcttcttctgttccatcctattgtacttgtcttcttggcgaatcgccttgtccaccaactgctggaaattccggtattctatagccatcaatgcataagacaactcatcattcagtccctctaaaaacttctcctgacgttcttcatcagtgcgaacatcatctgggacataatgagctaggcgattaaagtcatggaggtactctgtgacagaacaggatccctgattgagtgctctgaaatctctcttcttaagtgccacaacacctgatggtatatgtgtcttcttgaaagtagcagtaaactcccgccaagtgataggctcttcagcag

SEQ ID NO: 61182 - DNA, 1635 bp, Oryza sativa
catcccaccaatgatgtaagcaacacgcaaaacccacacacgcacaagcaaactaacacatcgaactatggcaacggtctaactaggcaactaatcccgccttgcatcggaacgaagagatggatcttcttcctctggagtagctggctctctttcttctgggtcttcctcctcttcatcattacttaagacatggatgataggttcagcatgatcaggcacaacatctcccaccacacgagtcttcgaagccaactggatacgaggtggtggacgggttctcttccttgcggtgaggcgaagtttgggtgctggcggtggtgcttctcccttaagctcggccagttccttctgcagacggtacaccttgctctccaacttgcaaatcctgccacggttccagttttccctgtcatcagctgttttctcccgctccacgcctactgcatccatggcgctaagcatatacacagcatgcttcagagtggtgctatcttcatcttcagggcagtggtaaactccatagtcttgaccatgaggcttgtgtggatgatactggaaagctgatgactctaactcctcatcaaagcgatgacgtagctctccaatggccaccaaggctacctcctgacaagcatgactatactttcttcccccagcttcaaactttatcgacagaaggtcttctcgatcactagtcaacgtcacgcgaacacgacacttctcctcgttggggtcatagggaatctggcgatactcaggggcaacgtcgtagcctacttcaaatgccatcattctcagctccctgacgaatcctaccgcattgatcaagctttccggcggatggggcggcgtctaaaggagcacagaaagaaggaattaatgcatatatttaagttagctgcacaaactagacttaattaatttgacccaaaaagaaaaataaaagaaaaggagcaaacagaactaatttttttatttttttaattaaatttcgaatttttcttatctggccgaaacataaatttttagaaaccaattcgttttattttttcagaatttttttcgaaaatttttatttatacaggggcatagactttggaactaaacaaaaagaagcaaatatattttcttcctgtacagtactcgtgggaacagaattaaacaaagttttgtttggaaaatgaaatcaactttggacagacacaaattgctttacacaaatgaataaaataaaactaaaatacttagtatctaccataagaacggtacagtgtcaccattatatattttcttcctgtacagtactcgtgggaacagaattaaacaaagttttatttggaaaatgaaatcaattttggacagagacaaattgctttagacaaatgaagaaaataaaactaaaatacttagtatctaccataagaacggtacagtctcaccattaacaaggatgagtagtactggtgctatcttgattgaatcgataccataatagatgataatagatgtacagtgccggctaaccaatgaaattcataaaatcaaactacttaacaccatgaacagtaaagttttttttttaaaaaagaaaagacacaggtttctgttttggtaaagtaggatttagtaaat

SEQ ID NO: 61183 - DNA, 1732 bp, Oryza sativa
  unsure (1)..(1732): unsure at all n locations
nnnnnnnnnnnnnnnnnnnnnnnnnnnnnnnnnnnnnnnnnnnnnnnnnnnnnnnncgccccctctattcaaaatccctaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgttgctgggggctcagtcctgcctgcctatcccgggggttccggccgtaggtgggattgggtcggtactcttgtctatggctaggatgggttggaaactatgtcacgtcttccgtctgtataccgtggtggtatgtggcacgtggctacacgtgaggaagatgtgtcttgtgggtaaagatgtacacctctgatcagagtataatctattcgaatagccgcgccctcggttatgggcaagccgagcaatgtacccaagttagtgttttaattcttaaaacttgcttatcaactaaaatgtggaatggttggcctcggttggcttgggacgagctgggacccagggtcgggttgccagttcggtctgaatcatcgtaggccttgggttaaggcaggtccgtgtgggttcacggccttgattaataacattgtatagttctagaatcgtgtttacaaaatagctttggagcaactaaatatctttaaatgctgtttactgcaaccctaaccctctatagtataattcccttgtactcccttgcatttattctgcacttgcgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcccgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtcaggaacgcccgttgggttatttccggtcgtgacaattatcatagtacgattaaccatcatgagctaccagtaaaaataaccataaataataatgtagtatgattcatcccattaatgagctaatgtttctaagcatggctaagcaattatatataaagcatttagctgaaccaagtcaatatataaggtccaagctaatcaatttattacccataggaaaataaagtcatcttcggccattaattaattgggaacggctcaccacccgatgacattcgaaaataatgcataagttgaaataaaacattagatttaaacgggttcaacatgcaaaaatggttgtttgggatctgtgtgacttgccttgagcttcttcaaatgcttctaaaccttcctcaacgtaaacgctctacttcagaacgtcggaaactaaagcaaatgaacaaaatcaacaaaacagtacaaaacaagcttaaacagtacatgaggatatttttaacatgtagatcttgactttagatgaatttagca

SEQ ID NO: 61184 - DNA, 4851 bp, Oryza sativa
atggcactgaaccacaactccgccggtgatagagagctcgggcgacgaaaccgaaggcacctacacgaagaggacgacgagacgaactcaccgaagacaagaactacgacgaatgacggcgaacgaagaccgacgacgaacttgacgacggcacggctcggctctatgtcgacggcgattctccggcggattgcagcagcagcgaaggggcggacgggatgctcctccacctggcgaacccggcggtggtgacggaaggcagcggcgacgaccacagcggtggcgcaaagcggctgaagcgtctacggcggcgacggcgctagggtttacgcggcggcggcgccataggcgacggctgtggcttggacttgaggcaaatggaagaggacgactagggaatgctatatataggcatgggtgagggagatcggtctccaaacgaaaggatttgagccggaaaatccgatggttagtttggagagataaactcgaaaacgaatccaaattcgcatcgaactcaaagggataaaatcggatttttgggggaagggatagaagaggataagggaaacaaatcccctcaactaattctagaaatgcacgagacgaaaggccggatttggagggggaaaaccgagccaattcggtctcaggtcggctggcagagcttgaagaagtacagtgcacagggaagcaaagtagactttcagcaataggccggactgagaaaaggcagctcagctgggctgactgggctgcacagccgtgcacacaaagaagggagatttaaaaactttttcagttaaaataatttgtgaaatgatgtttcatttattaaaaatacttcccttgctcaaataattcccagaaaattccaggaaacagataaacaagcaaagtatttaatgaaattttatctagcttaattttatgttgcactttttcctagattattacagtttaacttgtaagcttttaaaataatttctaaaaaagtattaaagaatgaattattaaattaagcgactttcagggcgtgacaaactcggatatgccaaacacaacatactgtgaggctagcaccagggtctgaccagctggagggtaagactccaaaagagattgctaaatacaagaagggcttgcacaaggagaaattgattattgtcgcacagaacattggacgaggcttcttgcactttcaaaacaagagagtcgtcatggctgcttataattttaagtaagtctggtacatttatcttgtacacatatatcttattttagctggtactaactaactatactgttgttaatatgtagcgatcaattatatctgtttactcatccaccctaaagacggaaccgtggtagtcttggaccctctcgattacggtcacaagcaatacaaagaatttctagcaatcttacggtagtaagtgattatgactcttgcatttttatatgaatgtattataaataaatatcctccttaatgtgaaacggtacgacatccatacaatgcgtaccaatactacaagttcaagggtggagaatagacccgaacaagggagaagctgctagcacgtaccttttggccggtaatactccactcacttaatgttttccaattgttttactaattgcaaattttaactattcttttctatgatatgtcctgaagagtcacaagtaaccgcgaggaatggtcctttgcgggtattatgtgtgtgaatttcttagggttaatgggaggtacaagattaacgcggaggatgtaagtctctatactatgtactagacagcttcacatatttatgatactaatatattgattaacttcaatgcatgcagttgccaagattagaacgtcgaacaagctttgacgatacagacatcacaaatgtccagcgtgatctgtgccatttcatccaccatgagtgctgtcatgtgaaaggagatttcttcgacccagagggtgccctagcgacaagtgacgaattcaaggatctttgggagtggaacactgctatgccataatgtaactagacggcgttatttgaagtgacaatgtaaaaaaatattgtaatatatatatatatatatatatatatatatattggcaacactttagatttctcagtactataccaaatgctcgataatcttctaatatatgtacataataatctacctagaagaatttctattaatgggcaaattattattaaattttaatattttctacctattttcgcaggcggattttttttttgcaggcggccgattcctattttcacaggcggaccggacaagccaacgtccacctgcgaaaattatcttcgcaggtggacggccgccctgtctgcgaatatcggcgatcttcttcacagtcgttggcttataggcggacggctgccccacctgcgaagaccgttttggcccgcttgcgataatgcttttcctagtagtgggcagccccatgcacggccaccttgaagttgtcgtgctcatctaagctgtcgatgtgctcctgcgccgtcttcacaaaatcgctcaccacgccgcctccaaagtgcctagccaatacatcctcgtgtggcgcgcacaatgctctcgccgcgaacgccgccttgttctttgactgggaggagctgctgcgctgctgcccggcatggtcacgaagagctcccgatacacaatctcgaaggagccctcggcgctgactgcctccaccacctcctctgagcaaggctcgtaaatgggcagattgaacatctcgagcttctccttgtcaaccattccctgattagacatgtatcgtaccattacatcgaaatgaaatatggagatcatggaggtacctctattttttaacgttgttcatagtcatatgaaaatatatataagtcatgtctaaaatatttttatgataaaaaagtcaaatatttttaatatattttttttaaaaaaataaaacgaatgatcacatattattttacctgagctgccattttattgaggatgatggagatgtgatcccacatacgtgtgtctccgcttctgaggttgtctatacatttcctcccttttacggagattaccagccatcctcccgggatgatctccttgcctcgtgactcgagaaacaatgtgaagtcgttcataaactgtagagcgtatgcgtcacatacttccggtgaacatattttgcccgcacatatgccctccttgtttgtcagcttgccgatatgcacttcttcagggacctaaatcagtaatcacgattaatttcaagaataagtttctctgaaatcattgtttcttctgtgacagtaattaagtctctgaatatcctgaggacggcaacaaatgtgttaggaacgactcctaacttaataccatctgcgttacaaaaataattgacattttggggatagcaaaatggtcaccaggatactattttgattattagttactcgtaaaaagattattgttggcatcgaaaatcatttcagcaccaacatatagagatcatatagctcccttctgtaagcgtcacaccaagaagtgtaaaatcaaatgtgtttttgattattattctgtgatgaacaattgggcattggagattattggttttgttatttgtaatttattcacgaagtggttttggagatgattggatttcacaggtgaatatacaggaactgctgtggttttatgtggaccggtcagaccgggctctggtagccggtcagaccggcgtgtaatgcacggtcagaccggcgcagcccgtggtctgaccggccgatactgtgttggtttcggtttcgggttgtttatttggatatccgagtttatttcatgattatgacttctggatggatactatacgtatgtaatactattgtttgctgctaatgagtcaagttggagatagcttggtctcggaatatggtttctttgtttgttccatgtgtaggttactcgatgtctcgggagagtatttgcggtgatggaccgggagtcggcttggggataagacgacgtccgtggtggtcagagatcatgcggaatacttaggctagagttgttgcacgtggttgatggagattccatatggcatacgatggaggaattgtgtgcgtatgggatgcggagtcgaatttggaaggagtccaaatttggtacgtttggttatgtaaagtttatttcttcgatttgtgtttcaccgggtttcggcggtctaaccggcggcgcaccggcggtcagaccggcagcgcaccggcggtcagaccggcggcatctcggcggttcgaccggcgggcacacggcggtcagaccggtggctacaggagtcagcaacaggcattttcggcggttcgaccgatcgatctacatcggtcagaccgacgttcatcaggcggtcagaccggcgcaactacttcggttagaccgtgatccatcgatttcgagggtaacttttattttcgctaaaagtttttgatttttgggtataccaaccattcacccccctctggttggcttagttcctgtgattcgatcctacaagtggtatcagagcctcgttttcttctttggatttttatcgatctaaagtttttttgccatggctactcccgctaggttttcaactaagcctcatgttttcgatggaacggatttttcttattggtgtagtaggatgcaatcttacattatgtctgaaaattatgatatttggaggaaagtttctcatccttatgtgattcctgaagccattaatactgatgctttaaaaactgaatttgaaaataattgcaaagctcgtaatattcttttgagtgggatttc

SEQ ID NO: 61185 - DNA, 932 bp, Oryza sativa
  unsure (1)..(932): unsure at all n locations
aggaaagtttctcatccttatgtgattcctgaagccattaatactgatgctttaaaaactgaatttgaaaataattgcaaagctcgtaatattcttttgagtgggatttctcgttctgaatatgatcgtgttgcacatcttgaaactgctcatgagatttggaatgctttgagaaattttcatcaaggaacaaataacattaaagagcttcgtcgagatctttttaaaaaggagtacattaaatttgagatgaaatctggaaaggctttggataactatctttctagatttaataaaattttgagtgatcttagatctgttgattcttcttatgatgttaattatccacaatctgagatttctcgtcactttttgaatggtctcgacatgtctatttgggagatgaaagttacatctattgaggagtctgttaatatgtctactttgactttggattcactttatactaaattgaaaacacatgagatgaatattctttctcgcaaagttgattctaaatcgagtgttttggtttcttcttcttcttctttgattgttgatgcttcttcatctatgccttcttttcttgctgcttttaatgccacatccgattatcaactcgaacaaatcgaggaggaggatttggctttggttgctaacagaattgctcgagctatgaataatgtcaggaacaggaaaagaggtggtccaaatcgttgctttgaatgtggttcaattgattatcttcgttcgcattgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61186 - DNA, 1625 bp, Oryza sativa
agaaaagcagtcctatttttcaaaaaattttgaaggctacttaaggtttaccatttggcttgtcctaaggtcaaggtggctctggtaccaacttgtcacgcccgaaatttctatccaaaattccaaacgcttacatgtgcttaaatcctcgtccaggaatcagccgaggcacacaataacaaattgataatagagtactatcaaactactaattaatattcgcaaaataataaattattacagagatggatagttcctctcaaaagaataaaattctacgcagcgaaaaaacacaataacaaattgataatagagtactatcaaactactaattaatatttgcaaaataataaattattacagaggtggatagttcctctcaaaagaataaaattctacgcagcgaaaaaaaaacaaaagactaaacagctatggcgactccactccgcaagcaacttgacccaaacaaagcctactcctcctgatcatcaccttcactgaagtactcctcctctgaagaatgaatattgcaagaatgagcatatgacatactcaacaagccacacagcaaatatgcaactgcacaggatagcaaaggatggcataataaagctcatttgcacaaacaacacttaacaaatatttgagagaatagtcaaacagttaaataattaagcaatattaaataaacactatacaacacacccgtgttgcataggcccaacctcatctgaacaaccaaccccggttgtacaaatccaacctccataccaggaatataccattccaaaccaggagtcaatttaattatcacaggttatcaccaataatgagtaatgtgagactaatcacgaaaaacattgttagacccgcccataaccgccggcacggctattcgaatagttttactctggctagagatgtaccactgtacccacaaggcacagctccacaacatgtcaccatgcgcctcaataccatcacggtacctcggaaaggaactgtgataataccccttgcacaacacaactcaccatagtgcaccatacctggatcatcatcaacccctctacaaccagaggcatggactccctagcgaccccatggacttctcgccgcttctcagtctggcaccccgtaatgaaccatgctatacaaaaggtaaagccgttgcccacgctggcttgtggttggcacggtaaatgtttcacaatagtagctcgcgaaccggtccttaattgtcatgagcacgaccatccaaaccatgtgctcacaacccacctttaatcaggttttaattatcaagtaattattgtcgcgtcccaaaacgactctaaaatacatcctcaaaattgtgccgagaataattaaaatccatgtgaaagcctccaacaattaaaatgtgcaaatttaaaagtcaaataaggcttggaggatttttgtatatttcctaaaagcctaaaatgtgtaaataaattttagtggaattttcagagcacaaataataattgagaagaaataaacaaagttaaaaaggttttataaaaagaaaaaccctaaaagtcttcttttcccccccttcccttcttgggccggctcggcccagttcttttccccccttttct

SEQ ID NO: 61187 - DNA, 1278 bp, Oryza sativa
ccgtggaccgcccctttcgcttcccccttccctcatctctctcgggtgccgctccgccgcgccgttggtcgccggcggcgaccatcggggcgcgggtgcgccgcctcctgtcggccgtgccggagaggccgccttcgggcgcgccccgcggctgccaggtgggcccggccgtcagccgcccgcgcccgcgggtgcggctgacgcgtgggacccacggcgccgaccggcgccagccgcgtgcacccggtccaccgtggaccgttcggctgacgcaataaatccgatttttaattaaaatttaaatgaagaaattcgcaaatatccatttaaagagcatataaacttcaaatggccataacttggccatttgaactcggaattggaccgttcaagtctctaatttttccttataaagccaagaacccatttttgtgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccctatgattgttattgttattattaccttgttcaccctagaataaacaaaacctcaactagtggacactctactcatggcatcactagtttaattttaggtagatgcttcgcaatttaattaggtaacattaggtggtttttcaattttagactttgggaaatattcatatcacctggatactctggaatggtctggttattgtggaattggcttcacaccgctccctcttttcaaaacccccaaaatggttttaggctgggctcggggtgcatggttttgatagtagcacctcggccatataaggaccggtcttcgggcctctgttgcaaagcactaccgtacttccacatgtctagtgggtaaggcttagtttatggctcagtctggttataaacaaaagtacacagattggagatggatgaagtcgggggtcgatggacattctccagggcaaatgaaggctacacgagctgcggcccggtagtcgagatgtcatggcacagggccggtgtcctgttgctgggggctcattcctgcctgcctatcccgggggttccggccgtaggtgggat

SEQ ID NO: 61188 - DNA, 7419 bp, Oryza sativa
tcggtctgaatcatcgtaggccttgggttaaggtaggtttgtgtgggttcacggccttgataaataatattgtatagttctagaatcgtgtttaccaaatagctttgagcaactaaatatctttaaatgctgtttaccgcaaccctaaccctttatattgtaactcctttgttctcccttgcatttattatgcacttgtgggtgtgtcttgttgagtacggtggttgtactcagtcttgctcaatttttcctaacccagaagaggatccccttgaagatgaaggctttggtgtctagctcgtgcctgccgtcaagcgcctgtggtggtcgccctagtcttccgttgcttctcgtttgtctttgtgtgtgctgggccttcgtcgcccatgtaataaattaactatttacgcttccgcttgttaaactctgaattgtatcaacctttggtgtaccttgcctcctgggacaaggattaatgcacgcacatcaggaacgcccgttgggttatttccggtcgtgacaatggggaccgtatcgatggtattccggccttctctcctccggcaacttgaaggtgacgtgttgtttagggaagccatgagtggtgatggcacacttcgctgcttccctcccctcccctctctggccacaccccgcacaaccctacctcgctgtcacaccctcccctcactaagggaacgggttagggacaagggtagctatgaaggaggttaaaatgcacatttgttgaaacggtgggtcagctagggaggtggccaaagttggtttggatcatgagtgctacattgaaccaagattatgaatctaaatttacgatttacaatatcaccaacataaatgacatcactgtccgtgtttaagaaccgtccatgtttttttttctgttttttagattaaatttcacaaaacttttaaatgtcgtatgaaaactatcaatttgcaagaataagtactggagggaaattctgtgttggttccaacctggatattgcctaatttggaaccggtactacgttagtgctactaaggcctagtttttttcgacttcctcattttccgttagcacacttttgaaactattaaatggtatgtttcttgcaaatagtttctacataaaagttgtttaaaaaataaaataaatttatttttcaagtttataataattaatatttaattaatcatgtgctaatgatctttcttgtttctcgtgcggtaaacgcgagaacattgataaatataaccacaatgaatagatcaagaagtaatgcatcggatcaactgtaattatcatcaaaactcaaggcaatgacattatttcctcacaaaacggatctagaagaaaagaccgacgagagcggatgtagatgtgggtgatgcaagtgagccaccccggcactgctgaagaggagggagccaccactgtatcggtgaaggggaaaaggccatgttgttgaatggggaaacaaaccgtggccatggttgggtcgggggagagaaccgccacagtcaaacagggtacactggctagatccggtcacccccaagctcattgcaaccagatctgactactcacgacctcttggtggctagatctggcagtccctaagctctagattgcttccacaacatgggagtggataggaggtgccaccaaagttgatatcgcgatgaggatgtggggggtggtgaggatgatggccggcggagccacaatggtaggagggggactagtggttgttgactgtcgttaagtaccaaattcgaacgtcaattaccttaataaatagaagagaactagcatttcttatgcgcatattagttacaaataatgtagttccacttatccttggagaatacattgaatgcagggattatacaataaagtgtaggagaatatgtgccagcatgcaacacctccggtgaatcacgtgaaagcacatggactgaagggcccaaaagcgagaccaaaccaacatattttgggtgaacccaacgtgcaccatcataaggacccatgatgaggacacaactagctcggatataaccatgactaccctatgtattaatcaaccaaagatgcatatgttctacattagatttacttgttatatatttgaacaaacgttactacataatgagttttgtgtgtttgtttgcagaggtacttgcttggacgaaggaaaagaggccgagcataacgaatgcttggatgatcaaagaagttgattgaggaccaaaccaagaccttctccatgtcttttgtatctcaccacgtcacttttggtccatagaagacaagagataaagttctacacgttttggattcggattcgggcctcctgatagcatcaacttcaaacggacctagccgctgatctagaaagaatttcgaggcccatgagtacttgttggaaagcttatgtagctgactttcagatggttttattactacatcaaaattcctactgagtttccaggaatctgaaaaacaagccacgtatctcatccagtccgaatctgatttgggtttgggccttgtaattgtgtcgtgggcttagcccatcagggtgtgcaccctagggcaaccataggatgtccctaataatacttaaccaatagccgtcatcgcttagagtcgggttttgcttagattactctgtcaagaacagtttcgctgctagatcggtttgtggaacccaaattcgagtgcttaatcattcataagcaatttggttgcaatctatcttgttcttgcatgtgttcttcgattcgcatgcagggattagccttctcggcgaggtcaaccgggtttcagcacggttgataaccagaggagacgtggtgctgcaattgcggggcttagtagcgtgttcgtttataagccggatcgagttgtgtcgcgactctgcccaaatcgtctgtttatcaatacctatcggaagatcggaacctagcatccctcatcagttggtatcaaagcgtggttgcccgttaggtaagttatcttcccataaccagaaaattgccacacaaaaatatttattctttacctagacaatttgagccgttgcgttgttctattagattttgctttgttgaattctggattgcatcatcgtgtcgagtgctggtttagttttagatttcatttttagttttgagtattgcatctgttcatcacttaggtctaggactcatcactcaagtctgtgagttgtacgtcagttttgaatttagtttttcatcccgtcggttgttgccgggaccttgaagaattgaatcgtctcgatggttggtttccgttttcgtagtttggagaagttaatatccaacggttttggagttgctcgatttttagagttactgtgttggggagttagtgcgcatgtgaggggagaggacgagccccaactcttccgtaagtagtttctctccatcgagtattgaaagtgttaaagttccagatttgagagatatttttgtaaaaacggaacctacatgatacattccatttttgaggagatctaatttagttttacactttgcatttgagtccctgtaattttcatatttacatttgagtccctattcgaggccagcgatcagtttttgttaaaaaatagtaaaaaataaaaaagaaagaaaaggcagaaaggtgcaaagaaaaagaaagaaaaagttgcacctaaaaaaagaaaaaaaaaagggcagaaaaggtgcttaaaaaacccgcaccaagaaagaaaaaaaaatcattcattctttgagtatgttttcataatgcagagttgtgcattgattcatatctagtccttagtgttgtcaggtgcttgcttgagctagagttgagtctaggctaggccagcacattgactagtacttttaactattattcaactttgcattttctgattagcacaattgcgttcctttgctaatatatatcatgcctcccaagctgcacgtatatacttctggtcagcatcgctttgatccttgcaatcgccacatcacgtccttcaaggtgacatgaactagccaccggttgtaccgtccttagcattgctgataagacacttgtaagagcttgataaggtgctccatttgcctaagttgttgagaggcaccactacaccgtgtagcagagtttttatgtttgcaatgataggtatgagtggcgctcaaaatcagcgataccaacaaggtgacataatcgtgtgcccgaagatccttatgctaaggttaagtttaaaataccatctttttcaggttattatgatgctgagaaatattttgattgggagatgatagtagagaaaaaaattagtacccaccttgtgcccgagcaacatagagttcgacaagctactagtgagtttaaagagtttgcttatatttggtggactaggttagatgtatggagacctttacctactactaggaaagaacttaatgtagctatgcgtgatacatttgttcctccatcttatcttagagatttaaacaagaaactgaagcgtttagaacaaggggataaatctgtacatgattactatggtgagctacaaaagggattgaagcgatgtagcgatggagcgattgcaatctatcttgttcttgcttgtgttcttcgattcgcatgcagggattagccttctcggcgaggtcaaccgggtttctgcacggttgataactagaggagacgtggtgcttcgattgcggggctcagtagcgtgttcgttcagaagccggatcgagttgtgtcacgactccgcccaaattgactgtttatcaatacctatcggaagatcgagacctaacatccctcatcaacccacatgtcagcctataggggaaagccagtggagaagggtggtgcccctggttgggccggaacaaggtttggcaaaacagactgaccatacgtcatctccaccttccacgtggtgactcatcaaccctccctgccgatggtcacagataaaccgaccttcgcaaccgccattggatgatttaaaatggagggtgcattctccctttacaacacacactcaagaagcaatctctctattttatacttatatactctctagattagttagtttaggctttgaatagttctttgtttcctagtcgtgttggagatgcgggtatgtcttcattaatttgctctctttgtaagactatgagcttagtaatgaaattatcttctttatttaattgtgttcgttgttcatactttgtcaattgtatgacctatcattagtttatagttctttcatgaaatataaatgtttaggctagtcgatctatgccaaggcatcggtccaacaaacttaacggattgtactagttctaacttgtccatctgaagggtaggagtcagggggaattattgatattattaagcaatataaacatggtgcttagattcattaaatgccattagataccggtatgccccacggaatgtgaattagatgacaggtggtgattgccatgtccgtcttttgtattccaccacgttcggatatgacgtaagagttcgtaaaatgccttaaccacactggcaaactaacaggaagtagtatctcggtagtacttgggtgtctacaattaagttctagccatgtatatgtatatgattattgtaacgattaagcatgataaatatataagtacatattaaatcgtagctttcctttgtctttctccacttgctagtttatttatagattttaattttctgggtgccacactacccaagtatcattatttttatcacttttctctgttagactatggcatattaattatagcgtaattagaatatatcggtctatattttacactgtcgccttccatgtagaaaaacaaataaagacacccatggaatactcttaaatgaaatgctacagtgctatccacgtgcttgcagatttatctattaccgtatcaaatagcaatatgggtggaggttccgctggtgaggaggatgacaggcagtggtgtagcagggagggagagagagggagacgtaggaaggatcaagagagatgaaagagagccatggaaggacactccgtaaaaaggaaagagatgagagacaaccgagagggaccatgagagcgagccagcccgattaggtattcttaatgggcatcagtgctctttttaagaaaaagtagcattgaaatttgaccagcgtgggcctaagaaggcaagaaatggctcatagatgaacaacacatatgaggtttcacatatttggggttttgttgtagtcaacgtggtgatgaaaaatcggcgctcggccgatagtgccggaactgtgttggtacaaactaagttgacaatagcaatagcctgggatatctgcttagctccaatgtaggtcctagaattgatgagatgggggcgtgcctgtcagtttgatcctgcaactgacaagatatgtaaacaacagatcaaataaccaattggctgacaagcttatggagcaattccagctgatgccgatagggttataagcaatcaactatatttccaatgtatattatgatacttgagtaaataatgatatatagacaatcggctgataataatgtaattaagcaacaatataatctagtagaaatcaatcggctaataacgatatgatagaataagcaacgatccgaatgttaaagcatacatcggctgaaggtccgatgtcattaaatccaaacgattagataagtaatgaaacctttgttgcaatcggctaaacccaacttgtatataatctctataagccgatacaacgtccatataactcatcggctaaaaccccgatgaaacccttattggcaatcaatggcatgttagtttttatggttataagcacgactaaggtcaatgcaactaggagtttgcaaacaaacataaagtctaaacaatcaagcctttgactgatttttaagagtggtagataccttagctaatctaatctagtaaagtgatttagtcgataccgacaaaaaccctaaagtagatcccagccaatacaagtaaatcgagcaatcaaactagattaactaagatacatgataggcaggtcggcaaatatatcaatcaaaccagagcgatccaagaggtcgaagcgatgcagccttaaacagcaccaatatagttgacataattgccaggcccggtggaatgtaggacttaccccttcgccggagatccactacaggaattctgggcttctgtgacgattacattatgacgataacagcctgtttctcgtcactgcctggctgcaataacgaaatggctgtcatcacagaaggtgggtcactatccagcttctgtgaccaccagaggacatcgtcattgatactgtgacgatagttctcc

SEQ ID NO: 61189 - DNA, 1485 bp, Oryza sativa
tggctgcaataacgaaatggctgtcatcacagaaggtgggtcactatccagcttctgtgaccaccagaggacatcgtcattgatactgtgacgatagttctcctgtcattgatgaatgacgagacaaattcgtcataacaaattgaaccgaataacgccacgtgtatgatgacatctaatgttactgatgacaaggcggatgatgtggcaaatgacatggcaattcacattcagcccatatagcgtgggcttttttattttcaattacaatcagcccaattggcccaaatatgtttttgacccagctacaaatttgcttttacgtttttttcactatagcccaacaatacaattctagcccatattatgggccagcccaattaaaaagcaatcacaaaatataaaccacaaccatttgcataattatattataatcacattccagccataattaattttctagcccatacaaaagcaagttccaaaatacagtttccaacatatttccatacaaaagcacaaaacatgaatacaaaatgatccatccaccatccaactacacaagtcccagctgactacaaagttcctacaggtagtgccaagttcctgcaccaaaaaattccacctagcagccactaagtttcggcggcgtgcatcttgccagtagccagcaaaaaaattccaccaagcagccgctgcacttccggcctgcatcctgccagcagtcagcaactagtgccaaaaaatcctgcgttccagcaaccaacgcaaaaaaaaatactctggccactaaaagtgccaacctgcaagcaaccaacagatatcacatttggtttttggcacatttgtcctgcacatgacgcagttacatagcataagtaatagaaccactatgcatctgtcatttccttgcaacgccattttcatttgttttcagtggtcactattacattaaaaatgcaaatagagctgatccaaacagagctataaactggattatggaataattattttaccacctgagaatatcaaatttatgttgatgtatcttaggaagctatgtggttaaataactcaggaagattacatgaattatcttatagtcaatctgaaaactgctataataaatctagaattatcagatgtagctggcatgttccaattcctcctgacagaatcaaaagatctcaaatgtacctcatatccaatatgtatatacctagccaaacatgaatttgtgctcgaatcaaagtaataagctcacacaaaatgaaatctgctaaacatcacctgcctcacctactaaacttttttaagataatggatcaagttagtggcacaaggttttgtgaacattttgattacatcactgtaggtttaaaggtaatcaagcccaatatatcattaaccaacaattcccaattacccaacaaggcagctgaaactgtgaaatacaaccataaaaaacaatatagaaacattgtg

SEQ ID NO: 61190 - DNA, 1512 bp, Oryza sativa
tcgcctgcaaagcaaacaaatacagccataagcatgaaattcagctggcacactcataattttgaactataactaatctttctacttgttagataaatcaaaatatttatatcctatgagttacacatgttctacagctgaaattattatatggtccttttactaattcagagatgctcttgttcatattctaatggatgagaatgcaactcccaactcctacacatactagtatatgcatcacacaagaatcatgccaggatatgatttcaatttcattttaatctcctgattacctaccatgattttagagtggctgatatatggttactttctctggtcctgcagccgctcctctggacttagtttcaaggattctcctgatgagacagcttcagcctaaatcaatttgaatgtatcagtattttctgcagagtttttaagtactaatagagaacacgatactattttatcttagtcaatgcttacttaggttttcatatagtaatacgctacagcatacaggagcaaaccacccacacattgcaagaacaagtgtgcacaacatatgcatctgcagacccaaaaaaaattcttgtggaaccaatgtagagagaacacgatattgtttttatcttagtcaatgcttacttaggttttcatatagtaatacgctacagcatacaggagcaaaccaccctcacattgcaatcacaagtgtgcacaacatatgcatctgcagaccaaaaaaaaattttcttgtggaaccaatgcagacaaaatcagtcaatagaatcactattgaagaagcaatttttactacactaaatcccactacaaacatcactaagcaaaaataatctgcatctaaaatgttattctctattttcagaatatgcactgcatcacaaactaatcagccaccaaatctcacatcacatccattcattagcatcagatctaaacaaaaataagattcagtctctacctccacggctccacccacaagtctccatcccatctgccccatcagaaaagaacaagaacaaccaggtgcccatcccctttgcccccatctgcaaaaaaatgcacacaagaagaagaagcgttaggggaggggaggggaagaggaaggagagaggggcaagacaacctcgtacttctgcttccttgaaatctagaatcccaggtggaggttgatgtggtcagaagggatgatggcggcgttcctcaggggagctatgtgcaggacccgggttagatggctggagggctggaggtagcgtggatgtaccagtagagggctggaggcagcgtgatcgtggatgctagggaggagaataacaaggagcaggaggaggcgggggcggcgtcgatgaccgcagaagcagccacacccacccacccctcatcctcccagtcccagatctagcgcggcggcgagctgctgcgtgctggtggtggtgggcgagagcgtagccgaatccatggcggcgctagggtttaggcgac

SEQ ID NO: 61191 - DNA, 1782 bp, Oryza sativa
aaaagggagggagagagacagcgagagagagagagagagagagcgttgggagagagccgcgagaggtcgagaggggaggggctcggctgaggtggtgggaatggaggtgcagttcccggccgttcccggagaaggacgacgacggcgtggtaggcggcggcgtgagtgtggggaaagagaaggtgaaggagatggtgatgagcagcggcggccgcggcggcgggtgggaggaggaggaggaggaggaggaaggggacggtggtggcggcggagtggatactgtggatggagtttaggctagggtttggagaacaaggtatatatggataagaagcattccgacgcgaatttaccaaactgtccctggtgtgttctcagtagttacaaaattgtatggtcaaaatgggcatttcaccttaaattaatgagaactttaaatttaattttaggctgatttttatgtttcaaatgcaaaaatcataaacaataaaattgtaggactcatcgagatctacaactattgtattgctcctttttacaaataagttcatttgaacaattcaaattttgaattttcaaaatttgacaacttcaaacaaaaattgggttaataaatgatttcaaatggaaaagttgtcagaaccaaagttgtagaactcatcgagatgcaaaatttttattttggtcatttctccgtctgactctatttgaatagtttgaaatttaaaattcaaagtttgagaacttcaaatagaattttttattagtgaacgacttcaacttaaaaagtcatcaacaacaaatttgtataatccatctagatctataatttttattttggtcatttgttcatccgacaaagtgatagtaacattgttcataaaatttacatatctcttatagtttataaccaaaataaatgttttagatattgatgagttatacaactttgttgttgatgacattttcagttgaaatcatttattatttgaaaatgttggttgaagttgtcataatttgaaattcaaattttatataggtcagtcaaactcagatggagaaataaccaaaataaatttggtacatctcaataagttatacaattttgtttttgacaactttttcacgtaagttcgtttagtatgataaaattcgattcgaagtttaatattttgaaattaattgaaaggagggatgtaatatgaacttttcggtgaggaattagcaaaagggctggcccataataggcctagtttcagtccacctctgtttaaccttttttttatttttattttattgtagcattgtgaagtaacacacaaaaaatcatataaatgaacttatttgaaaaggttgtcaaaaacaaagttgtataacttattgagatctaccaatgttattttggttatttctccatttgagttttattgacctatataaaatttgaatttcaaattataacaacttcaaacaacattttcaaatactaaataatttcaaatgaaaaagtcaccaataacaaagttgtataactcatcaatatctataacttttatttaggtcattttacaatatgactttgtttcaataatttgaatttgaatttcaaattatgacaacttcaaacaatatttttaaatatcaaatgatttcaactgaaaaagtcatcaacaagaaagttgtataactcatcaatatctataacttttattttgatcatttcttcatccgaaaaagtgatagtaacattgttcacaaaatttacatatctctcttatagtt

SEQ ID NO: 61192 - DNA, 8893 bp, Oryza sativa
ccaaaccaacgccactgctccacccttcgtgcaaatacgcagccgcacaaaacagcaagcgagagcacggcaaatttctgctcgcctgcatgtatgtgatcatcagcccggccagaagcttgtcgactatagcaaattaatctccacttgcaaccagctgcatgagtcttcacctctctgatctctatctgcatgctaatgcaaatagtacttattaacgcaaaaaccttccttgactatggttaagatcagctaatccataatatttccattccatgataaatgctaaccctccctagccagccgcgcgcacacatttaatcggctctcaaaccaaccactccaaatcatgacagctaaactaaataatctggcttacccaaataaaacaaactattagccaaattatgctacaaacacatgcccccctgttttcggtataagtagaacgtgtaacttttgctttaccgaaaacaccataaaactaaccaacctaaaccacaaccgtcatctcagaacgatactccacacacggtatcggtcctgagcccatccacagttgtcctctcaaaacgatactccacacatggtatcagttctaagcccatccacagtcgtcctcttaaaacgatactcaaataagtactcgttttgagacaatcaagtttcctgtagtacataatgataataacctttcaaatatttctcatgtagtacaaatttcaccactaattcggttgtccctaatgtccacctaaccgaattagcttgattcttaacatttcttagattcaaaatatcttaaaaataacacatctaaacttcgatactgttaaaaataactcatcttatagctcggcaatataattcatcatccaataaagcatatcttaaaacttgtcgccgaacttttctatctctcatttaactcgggtttttacataatcaacgaatggatccctccaatcacttggcttaaactttcctattgactcggttgtccctgatgacctccgtaccgaatcttctaaaccctgctcggccttttctgtgctcaaccgaccagccagcagtttgtatatgaacactactaccatcaactgcagcatgcgtgaccccagccaaataaaaatatagaccatcaggaacgccgccgtgaaacataacattaacacattgctaccaccacacacatgatgcaccacagtaccttcaccattaaacaaaccggcttgcatagatttattatccgaacaaacactgctaattatagccggtttatccactataaaacacacctcaagtcagccatatgatggacaattaagacatctagcaatttaattaaatctaaacattggtcgaaataactatttaacagtccaccgaaacactaaaacttcctattactctatcggactattaaaagtaaatcatcaaaagctacatccctcacaccaacatcgactaaactttccaaaccgaataatagagcatctactcggtctaaagtgcaagcatgctctaaatggactgatagggaccgatgtgtcataagcaatattacttagtaaaattaaaacagcaccagctccttgccaactcacacaaactatatacgaccgaaataatttctaaagagttataaaaaatcacggttatttctagcacctaaatatttcggtctctaaaagtgataacaacacctacaactaatagtcaatgtgtaaaactatacggtaaaatccctccataatataaagacccatatgatatccaaggataagaataaaaccatgagggataaacatgcatacctgagaattgattccatgacataggtatcggtggcataggtgaagaatatgtataatatggtggcgaaagaacctgatgattagatgcaaaccgttgatttggcgcacacctcttaactcccttctcattttttgcccccactccaactttaacatctgtttcattctgtacctgaacacttgctttaagaacccatgccatacctctctccctcagcttttctgcacttagcttgtggagctgcttctttcgccaatttgacaagccatgtgagtgtctcagttggctgccattgccccccgagctcttcggcggattctgacttgttactaactctgccgaagatgcctctcgcttcatattcatatggtgtacatttcctaactgttgtatacgcgcatgccccccaggttcaatagcctttttctgaactgaagcattttgtacactcacatgtgcaccagcagctaagctcttttcttgacctctagacttcggcacccagatttgcttccttgttgaactaccttccgcctgtgccgaagacttcctactagaccacctagaccgatttcttttatcaaaacggtcatccttggcatatgactttcttggagttgcaaaacgcaatcagccttcattaatagccgattgtattttctgacgaaaaatattacaatcactagtacaatgatcggatgaattgtgccacttacaataaattcattcttttaaatctggaagcggttgcatgacatagtgatcaagcaatttaatataaccattttttagcaaatcatcaaaaatatgatcgcacatagtccaatcaaaagtatacttcttttcctttaaccgacacatctgcggagatggttttaaagctaagcaaacaaatggttcagattttccatcaacccattcggctacataattgcttatatttcccttatccattgatttagaactatccactatattagcatcaacctcattaatattttccaattttagttttgtgcttctagctctagatttattataagcaaaccatgtagacataaactttggcaaagatgatatggaaaatctaagcactttactattgccaataagaacattaacctccccaatcgatcccttggagttattcatgatgatattactgatgcaggtatgattttcagataaatgatcaaattgggaaataactacattacctgcagactttacctgatctgatttgttggagaagcattctaattttttcacctgagcgatgtctaggttcgttctttgatggctctccaatattttcaccttgtcgtcatgatttcgtgctccatcgtcaagatgttcatcatcttccttagcacgaaattcagctggcaaaacaaaaggtcctatgtttccagagaaatcaagcatagctacctccttttcattagccgataaatctaaatttatcagcttccattgttgattaaaaattggttttgatcccttgcttaagatatatgcattcattttctcctccacatctctatatatttcttcaataaggttatctatcttggaactaaaatcatccacaaattgccccccaaccgaacttgctaatttggtatcatttgttctatgcgtgtcttcggctttatgcgttgtcgactgcacaaatgacccattttgttgaaaattattaacacttggtttcggcaatggaatatgctcgatgccgaaactctgtggctgtgcaggggacaaactatatgttgtggaattatatggaggtaaatgcttgcttgctgaattttcactaattcggccataatcattaacatcacatgaagccgaattataactactagacactgtataaggtgaaccataagcatgaacatgagcatgagaagtaatctctgatttagcagtatttgacatggcatgtaatgtattaatagaattagtaggataattgccataactatacatgtcattcatcggcatagttagtggtgtagtgacaggtggtgaaataattgccgatgaattaaaaggtgtgtgtacatattgtatattgctagcattactaaaatttaaagtatgtgaagtactttgcataggcagtgacatattattttcgtaattcaaagagctcgaataattatttgaataatcactaccaaatgcaatatgtccattaaaaataggtctagcaatatttatatgagaattcactgtactagcaaaataatttgaaggaacaggcaaagtatttgcagattgtacctcgcaattgacgtaatgaggcagcggtgtagcactcctgtatgactccatgtattttccagcaagtcttttttttttgtgcaattgatctgtacatcaaccaaattttatcaaaataaaacgcagacaagcactgacctgatggcttctttcttcccttctgttaatgcaagtgtgctgctgttgtgtttctagattagcgtacactttatctcaagcggtgactgggcggctagcagaattccagatcggcgtggctccaccgctccagcacggcaatgaccaaccgcgtcagattgatcagataaccgtcagcgcgcgcatgagaagaatagcagatagattatggccgaaagattctacgacaaaaaccaaatagtagatcaaaatattcggccgaactacagccaaatagatcgatggtacaggattgatttccgtcaaattaatatgcccgaaattctcgtccccagtggagtcgccaaaatatgtcgacgctttttcgtggccaacacaagatcacctaacgatttgcggtgtaaacaatagagtcgccaaaatcgatatatcaaaatcggctagtgaaaccgatttcgagattaattcactttcgcggaatcacacgactaatttacaagcaaattagtaaagaagataaatatcgtacttacgtgacgacgaacgactagtttccgagcaaactagcaaaggataacctcctcgctttcgtggagaagcacgaccgtttttcaacgcaaaacggcaaagataaaccaaattctagggttgctagaactcagccataaaagcaaaatagaaaaaacaggaaaagtaaagaacgagaaaaatagtagattgataaattgtgatcggggtttcttcaatcgaccgtagacctgtatatatacagataccatggtccaaccgaaaaggaaactaactgataaaatagaaaatctatctatctcttatcttcctaacagccgtacgcgctaatcacgcctcatcatctccaaaccaacgccactgctccaaccttcgtgcaaatacgcagccgcacaaaacagccaagcgagagcacggcaaatttctgctcgcctgcatgtatgtgatcatcagcccggccagaagcttgtcgactatagcaaattaatctccacttgcaaccagctgcacgagtcttcacctctctgatctctatctgcatgctaatgcaaatagtacttattaacgcaaaaaccttccttgactatggttaagctcagctaatccataatatttccattccatgataaatgctaaccctccctagccagccgcgcacacaattaattggctctcaaaccaaccactccaaatcatgacagctaaactaaataatctggcttacccaaataaaacaaactattagccaaattatgctacaaacaggtcgttagttaaattaatcaatggtaccatcgatatctgcaaaacgccaacacacctactccaaagtatggtacagaatagggatttgggattcgctttgaaatgtctgaactctggatactactggcaaaactattgccgacgaggtgttacagttttcccaggtgaagaaaatgtggggtgagatggccgtccgtctgcgaagattaatcttcctagacagacgatataaggtgccacctggaaagatacatctttatagacggagctttaagaggtccagcaggggaaagattgaggatatttccaggtgaaccacttaagagttctgcctccgaagataattctttctaggtgacacctaacggtatgtgaccattacagttattcaccccctcgattatgatcatatgacgtacagaacaattcctaagaatgtaagtgattctgatctatgcatgtgtactaatgcaatgttcataattattacattctgttcattaatatgaatcataaatcctatacgtacagtgcgtacaactactacaaagtaaagtgcagggaacaaccgcaaacgagtgagaagttgcaagtgcatacatatatattggccggtactactctgcacacttctctatttaaattctttttcctgcaatgtataactaattccttctatatgtgtgttataatgaagtattacaagcaacctaaaggcagtgtcctttacggatagtacatatgcgaatttcatagggttaatgggaggtataggaccaataaagaggatgtaagtctcttgactgaacgtataactctaatagtggaatgcgcatatcaaattgatattgtattatattctcgtgctttcatgtatgcagttgtctacaatcgaacgtcgaactagctttcactacgaaggcattagaaacatacagtgggacctctaccacttcatctaccgtgagtgttgtcataaagatggatttttcttcgaccccgaaggtagcttagcgatgaacggagaatacaaatccatttggaagtggaactacgtgcttgtgtaattaacaatatagttagaaatgatagtattgtaaatattattgtatggccaacacatgatggccaatagtactgtaattagtgcatcaaacatatgtgtattatatccttgttagctgttggatgtatttatgtattgatgaattaattaattgcatcattattgattaaaaattaatattaataaatttgacatgaaaaattatattttggctcgaatattttctccggcggccatcctactcaaatgaaacccgaactacgtatttttgcaagcagcgtaatcatattttcgtaggtgatatgttctgactctgtcagcatggcaagaaatattttcgtaggcggacagcttaggttgtccgcctgcgaagattcatcttcctagatggaccggccggccgcctgcaaaaatgaaagatttcacaggtctttgtgtaaaggcagaccggccgttcgcctgcgaagaccatttatgtcactaaaaatagtattcctaatagtggaaattcagagaatttcatcaactacggtgagctccgagacaacatttaactcccatttcgtctggatttggttcatatggttactatttgatcaactttgtccaaatttttcgaaattcgttcatctcggtggagctcaaaatttttatgcaatcgggttgcaaaaccctgggactttttctattatgagtaaaatacatgagcaggacataaatttagattagggtgtcatctaggtttttgaatttgtgaactacacatatagataattaatcttggtttatcacccaagatttcaaatgtagatgatgtagctctgacggtgatgtggccatctacgttgatgagaattttgtatttaagcccctccactacattatgcctccagatcgactcccatcacgctcgtgaaagagggggcaaagggggtacccggaggacaacaaaagaaggtacttggagccgatattttttttagattataagaaatcaacggctctcctatatcccaagcaccttagaaaatctctttttttagatgggtatttcttttaccggctctatatccaaccggatatatgcagccttattaaactaggaactagcaaatagggaatttagcccataaataacccaatctaaaatttgcttctatggagatttgaacacaggaccttagagtgctactcaaatcactgcaacctgtgagctacttggagctgagatgggcgatacaacgtgtggtatcaccctcgtgctatcaggtcatccatccttgctccgaggacatcatatcaccgacgagatccaccgctgtaaacgcggtttctttgtctcctcttgaacaagcacactagcggactgagctgatcttggtcatgctatagcagagggcgccgctgaatgcgattttattccattgtggatggccaaattagcattgagctgtcaattgcattttggaccttacgtgatacattaaatcaagattagtcccatatatgtacactactacagaaacactaatataagtcggaactataggtactgaaagtggtaaaaaccagcccctacagtgccattcccgcccaccagcccgcccacacgccaaaacgagcaagaactggcacctttgtcacctaaaaggtaccagcaccttttactcctgtcagatatagaggccggttgtaaaaaaaaaactggcatcttttagaacccatcccatcggactagttggcacggggcccaccctagaacctgcatctctaccaagccgagccgatcgagcgccggccttacaatacaacgcgcgcatcagatccgtccttatcctctccgtctctctctctcgttctttccgtctctctctcgcctctctatctcgctcgttctctctcaccggtctaggcggcggccggcagagtggcggtggcagtggcccggtggaggcggcagcagcggtgatagcgccctcccgtctgcctgatgtagccagaggggaggcggcggacctcggcggctgccgggcaacggcccggcggaggcggcagaggcgtgggaaggccaccggcaccgtccctcctcctcttcgtcccaccaccttcctatcgatgctcgggcaaccagatccggcatgccccatcgccaccggcgctcagggacggccaaatccggcatcgcccctccccactggcgcttgggggaggccagatccgggggtggtggtcgaggaggctgggcacaggggacgttggctgtggtggaggccgggcgtggccggaggcttc

SEQ ID NO: 61193 - DNA, 976 bp, Oryza sativa
caatgcaagacacgcacttctcgggtctcacttgctagctaggcctaaaactctataaggacatgagttttcacatagccatgtgatttaggagcgggggcgaccacgaccgtgaaggcatgatgtgataaggatatgacctccacaatgcaccctcacaattctcttcctgcatgtcacacgccatcgtttcgccacgggagaacgagtgtcctattttggcttcgcgttcttcaccgggggacaacagaggccgatatggcgtgaaatattacgagccggatgccacgtagatatgcagtgaagatcctaggtaaaagaagtgttatttatatacataaataaccaatcatacttaaaaaaaagttaaacaaatgaacacaatttgttcaactttaagttactctacacgtaattgtcgatcctttttgtttttttcttttgcaattatcttattttattttttttcttttagaaacaagctagtatatctatatcactatatgaatataagtcacttagtcacgtgtaactggaattatttttcatatcaatagtacatgcctatcgtcgaataattaaagaaaatcttaagacccaatcattgtggtatctaaaataaataaataaaaacgagatatatgcacaatcaattttgtttggttcaccaaaccatactaataacgatctatccatcgaaaccactatcatttggtaataataactttaaaataaacaagtcaaactaaccaaaccgtggttgcatttaaacaatcatctcactgttctaacacactttgtttacgaatttcgttgcaaaatttgttaaatttttacacccaagtggattgttctgatttccgtgggccgacaaaaccaccccaaattggcccgaaagctgcaacatttttcctcctcctaaccaccgctccggcctctccatctcccgccgctcgccgtcgccgccgccgcccgc

SEQ ID NO: 61194 - DNA, 1712 bp, Oryza sativa
tacggatgttatacaatttatttatttattcagtggtttcttttgttttatcacccctattttcctacaaattgtttttctcatgacatttcccctcagacttgcattaggtgtgatctgataaggttatcagcacattaatgggcatcattttcattctgttttggcctgttgatgaatggtactactctttagcgtgttgcatctaaccttgatttggtccctttgtaccttttgtgtcactgttcagtttagttcattccactcctgcgtgatcgaactggactaatattttttccatgttgtataggaagctccagctgttattcagtcatactacaacaaaaggattgttggttgtcccggtggtgaaggaggtatagtacctgtgcatgctaatttccttgttttgacctataaagaagcttctaggatgaaatcttctcctgcatcttctctataaatattcatcgactaaccaccaatggaattaacttaaactgcaaattgcaatgattgatattttcagaggacgagcatgatgtcgtgtgttttggttggagaaaggcaagccacatgaatgccctgtctgcactcagtatttctcggtatgttggtactttctgttgacaaaatcgcttgccttgtgagagcaatttctgcatgagccactaaatcgcgcatatgttggtatgttgtcctgatgttcgctgagctatcaacttgcaactttatgttcacagcttgaggtgataggagaaggaggagatcctgatgggcatgacgatgacgacgatcaccaccatcattaaggttgcagaagtcacctctagcaataaaaacactggatatggccatatccatgtcaactctcaattcagatgacttggagcagcagtggattttggaaaaacaaagtttgtctttttagagatttgttcatgcaaataacaggattcagtaaacaatgatatgcaattctctttttcagcacaccttagtcgaattcaaaataggtatgtttgtttgtttgtcttgatggatgattccatgttcaatggccacctggaccatttattttggtgtatgatctgttatctgaacatttcacaaaccttggtcctgttcaattcagtttaaacaaatgaagtcagcattctgatgatccttctccctcctatccagttcagttatctttgattataaccaagcagttggatgaaacagtcaattgcttttgtaatttctttatatgatccttaatttcctactgcttacgtggtcaatttgttgctttgatgagtgagacagtgatgcattcaaacttggatttggccaaaccagcaccacacacttcaccactcactgatgtcattcacgtgaggatgcattcaaccaaagtgttaactttaccacacaaaataccgaaaattttggacggattcggcgtgacagaattccaatttgcactgcatttaatccactttattgatttgaaccattcctgatctccacacctacatatcttttcccttcatttttttttgatcaggtcagctccttactactgcaagataattagataaatccaatagtgatgcactaggcacaaacattagttgaaatgtagctatcactcttaagatttcagtgtgttttctcacatgtattaattgctaacccatcatgtcaaaatccgaaattaactcgcg

SEQ ID NO: 61195 - DNA, 756 bp, Oryza sativa
ttatactgcttacgccaatttggattaattattttaactttttaaattctttcagagatgatggccttcctagttggacttgatctaatgcaaactgtccattctgtacaccaaatcatctactagtcttaaattaattagctaatagcttagcttgttcttagcctcactgcaaggacctaattaaagaatagctagctttattgtccaggaagtcacgcctgcatatatatgtacctttcaacgtttttgatcaattcatagcaggaattgatgcgaacacgaacaattcaaactggcctgaccggaattcatttcgaattgtcaatgttggtacgtagccgaaatgaattgacttccgtagcaacaaagaaaatgagaagaaagtcttgtgttaggccaaagcaaaaatatttatttattttttgacctccgttctgaccctaaaatggcagaaaaattaaagctctgcaaaattttatcttgcagcgagattgactgtcaagaccttggagctagtggatccgtctctctccgggtttaggcgtttagggctcttttgaattggaggagattcataggactttttcaaaaaaaaaaagagatacagagattcgtaggaattttaattgtaagaattcatttcaactgtcaatgttagtacgtggccgaaatgaattgatttgtgtagcaacaactacaatgagaagaaagtcttctgttaggccaaggcttgtggacctccatttctgaccc

SEQ ID NO: 61196 - DNA, 1612 bp, Oryza sativa
tatatatttttaagatatatagttagattttgtattgatgtatattaagatagccactatataatacccaagcatggtcatggatgccatcttgtttgtaacatagattttagcgttgtttggttgtcaattgcagttttccatgcatgtatattaagactgaccaattcattatgtcttcttttgaaatgattaatcacatcatatataatatattgcagtatataactatagaacacatagagatctacaactaaccaagttgtaaaacgtacacatgcaggacgagagcacacaaaatcatggcaccttttactctagcttgttgatcatggcgcacatgttctgtgaacaagagccatccattttcatttctctctacaccagagccatccaattggtgggctaatgattacctacacaggcaacggctccgatttttttgtctaggtgaaaccagatggctactgagaatctaccatggatatcccattcaaaactggagccatgtcttcgcaatccaacaaaggcaagaggttctttttctttagtccagaaagcacaaatcttgcatagtcaaatacaagatataataaatatttatttcttttctcatacatggatggggaacaaactttcgagttccacacaattacacaaatgattgttgttggagtgatcttttagttgtaccctcatattcgtttgacccgagcagaagtactgcactcagattttaaaccccataaataaaaattctagtaatattccaccaagctgtactacatgcttccttttgcccttatataacaaaatcgatggttctgagttcaaattaattggcacaacatgaagagagcgtagttcagctggttagcttatggtgcacctacctatccgatctaattcgagtaatagacttgacaagggtgcttgtatttatggctaattattcttttaataatatatgacgtacttgtcgagtgagacgtttgtgatgacttcatcaatctaaaattaattatgccaatggtaacttcatcaatcttaaacattccagaccagcttctcagagatgctcatatggtcgattgtgtgtctgtatatttataggagtgagtctacacacatgaaaatgtgagcattgcatttgtactacgcttctaaacgaaaaatttgttggcacaacaaactgaacaaataaatattccatggagtactcgtgcttgtcactactatagaaaaggggattggtgccaattcagaactggccataggtgctagatttcccaattgacacccaacagacaatacatttgagattctaggaatgaaaaaaaaaacaaaaagtcggcattcgagccgaagcatcgagcagttgtccatcatcactaagatcaacatcatccccattaaccaaatgcaatcaaaatcatcactgacataccatcatcccatcaaccaagctcaatcacaaaattaacaaaatcgcaaacgcaaacacacagagaacgccaccgtcgccgtcatcaatccggacttctccatcgtcatggtggtgtcaatcagatggaaaggaggagtaggaaagaggggtggcggcgacacataa

SEQ ID NO: 61197 - DNA, 758 bp, Oryza sativa
cggtaccgaagcggtcccgcacttccattctgcgcgatcgagggtgcgccggcccggtcctgcggtacatagcgcacgcgcacagccatcgcgcgggaccgactcggttccgcaccttcggcctgcgcgatcgagccgatcccgcacatccagtatgcggcatcgcgttcccacgctgccacgccgcgctttcatcctgttcccgcgttcccaacgcgcggaggcggtatattttcgccaaatttccccacacatgtatataaatacaaattatgaaaaaataggtatatttttaaaatttattcaatgttagcataagcgttggttttttaaaaaatcataataatattataggcactgatttttttttatctaaaaccggcacccataagttcttaaaggtgccggtttttttaaaaaaataccccataatggtgggaaacggtcaatatgtgtcaattttaaatgaaccggcacccatgagctatcacctgttaagattttttagtagtgtgttatttttgtcgtgtaacatgtacaaacaaaaactttcgcatcctcaatagatagctggttcagatgcatggttaagtataaattcagggatattattgtgtggttaataaatcgcactaagtatggatggatttactttggaatttcttatcatccccagttggtagctggttcagaacttcagatggtcattcagagatattattgtgtggttaatacgtacatcggtacatggatggatt

SEQ ID NO: 61198 - DNA, 979 bp, Oryza sativa
ttcatttatcacaaaactacatatttattgtctaattttgtgagaatggagacactaaatctgtagttttgtgataaatgaagatattaaacctatagttttgtgaaacaagttcttacatctgtagttttgtgatatactattcaaaatacctgtagttttgtgataaatgaatacattgaatatatagttttgtgatagattatgcaaagtatatgtagttttatgaaatttactaaaaaaaattcaatatagtactggataatgaatctggacatcctaatacccttgtattttttactgtgcagggggctgcctataaaaatgctacccctcgcatacagtagaaaatagcactcctagaggactaaagggggctaccaggcagccctcccagcccttttgcaggtggccccctagagccaaaaatcgcctttgctatgtcctaaaaatcgcctacaaaatttcagcgccctcggtggcggccgttatgacagagcaaacagccgtctgccacgtcggaaaaaatgccctttggaccctcccagatgacgatgggcgactatttgtaaaatttttaaatcgaaaattatttctgtaaatattttaataaataaaatttaaaataaaaaaaatcggttgtaggcccacttatggctggttagcttgggctcagcaagccgcgacggaaaaggcgccaacgtaaccggttcagtgttctaacgggtcatgagggtggaactcaccttgtaaattgtaatttgtaataaaacagtaaatgaaccttctctcccaaccttcctatgtcccaaagaaaaaaaatataagagaaaaaaataattaggcagctgatatccatatagccttgttgtttaaaaattaaattacctaatttttcttcaagttaatagttttgttggtcgctttaacttacatgatagtttgtttggtacttataaataaactataagtaaattga

SEQ ID NO: 61199 - DNA, 1394 bp, Oryza sativa
  unsure (1)..(1394): unsure at all n locations
gtcagcactcaagggagttgtctccaaggatatgcatgtcagctcaccaagctctttcaaagatgattgatgtgaccctcacactcttaaggctgtgatgctgctcttctggtattgatctcagatctgcagaatgtgcaaaaatgaaacattctgcacgtaccgctgcattacntaggatgtgaaagggagaaattttaagtgacatttccaccacacaactactaattttcattcatagcagtaataatatatgaatggcaactcacagtcaggtagaaagtctccagagaaggtgcagcatgaatataagaagccagggacaaatagtcataggctgggaaatatccaataagggcaatgctcaagtgcctgaggcagaggaatttgctacacagcttcggtgcaaaggccgtctgcataaagaggtcaaattaattatgctacaacccataagacagaatctagtctcattcatgtgtcaggcaaaatttctcatacctctttgaatgacttcatggcaagagattcaagatttggcatgatggatggaagttcagcacgagcatgataaacataaccagagcgaaccatgcataggctcttcatttgcaaagtttctccaagtttcagttgcgttttgtccccttgaaatgcaaaaatggagacattaggagcttcattttctatcagtttcagattgtcgcacccaaacaccttcagggagatgagccgctgcagtaggcaaggtaccttcaggcaaacaatcctatcgcagtacctgatttccaactgctcccaatgcaagagaatgggaaagaaagcagcttaactcgttctccgtaatacgcacacaccagagatacaatctcgtcagacttcttaagccaccaagtgtgactgttgggtggaaggaacagttagaaaggtgaagatattggattgagtctccactcccattcgacagaagagagcatgggaaattgtactttgcctggaactgggtcagtgaaattatgagttcttcaatccctggtttaacaccaatctgaagccaattgttgagatatgaagagcccttcccactataatctgaatataccttaatcgtaagttttttcacgccgatgcctgagtgccttttgagaatgtggtcgactttgctgtagaaaagtccagccaattcttcctttccacatgcatttctattcaacccaaatgcttcactactgaaattgaggttgggatggcatctccaggaacttagaaaggaacgagacacacaggcagctcgggcagcagctcgcattggcatcaaggaatgtataagacgccagatgtcctgcttgcacaagcatatgggagagaagttaaacattgtactaattgtgaag

SEQ ID NO: 61200 - DNA, 1361 bp, Oryza sativa
tacgtcgcatttcgtttgatctgaaacggagggagtacgtacgtgtgcgacattataatattcttgactctgatggcattgcattgcatgcgtaagtttggtcaagaatgagtttgcttgtctatatcaacagtgactgagaaaaatcccaagaaagaaattaagatgcatacatagacatagaacgaaacgtcgtctcctaatagtcagcaaatgacaaatccagacacggaatgagacgtaatagtcatagccatattccatccacttgtcatacacttgtgtatgtagagtagactcttagccaccaaggaaatatatatgtgtgtataggagtatgtagtactccatccgttcttttatttttttaaaaaaataaaaagttttccaaccttcaaaatttattttaaaaaataatttatagtctctggcttatctactatcaattgacaaatcgatcgacaatcactaaagagtgttatcccttcgatatatcttatatatctgactagttagcaatactattttttttgttagcaagggtattttgattatttcttctcactactaaatttccatgaaatggcaaaaaattaagtctttttttgacacaatgagcatatgcgaactaattaattacttctttattctttattctaaaatataagacgcccataattttatacaagtcagcattaaactaataatatgtatgtctggtgttatgtatatgatacaaatactacaaaaattctgaagtattttcctttctaaaaaaatacctctaaaatgcatttctaatatctgtattaagctcctgtggttagttaggatggtactataagaatactgcagtctgcagaggtgctggaaaaccttgtagtaactttggcttacatttgcttttgctcaatccatgcatattaagtgcccaacagttaagccaagcaatctgataagcacacctatcttcttttcctagtaaaccttcaattaatctcacaggtcatacacagtaaataatgtactgcacagcccattttaaacttcagaaagaactcaatgacgcatgaatcatcttacatatatcaaacacagtagtgagcattgatgacttgattaattatctcaatatatccaaatgtcatcatcatcggcaaacaagattaggtgaaccgaagtagttggtgtaagtaaaagggagtgcatctgtttcttgactgcacactgaattaatttgtgtcctgtagtgcctgctgttctcagctctgaacctttgccaaacataaatgacgaccgtgtagaaccaaaatccaaattaatggagtataataagtacataaatgaccatatacaaatct

SEQ ID NO: 61201 - DNA, 1532 bp, Oryza sativa
  unsure (1)..(1532): unsure at all n locations
gttgttgcagggtacatccactattgacagtagacatcacatgagcaggttattggttgcagtttacagagtagaagacaaagatgtctgcagactgcagccatgtggtgctgcagaacggctgcatttctgttacaacagaaagatgaatggaatgagtagtgctgatttaagcccattctggcagtttcatgctaacttctttatggattgcanctgtgttgtaaaatgaaaaggccaacatggttaaatggatgtaatgctagcccataatcttatctgctgggtagtttcaaaagaagccgatgatcacaaccttcaagaaagagttaaaacaaacagcgatcctcttaggctgtcatcggttcgcctaatgctggttataagcagtacggtttatcaacaagaaaaacgataatttgtgggtaaaaattttatatatgtgtccacataatttatttcctactgtttgacgcggtccacagatttctgaaatctgaataatctaacacagaatttccaccaacatgacagggcagagcaggaaacagtccatccaaggatgcttctttatttccaaaggccattacattcatttgataaaataacctggaggtgaaggctaataggctgtgactttgagcaaaagcttagtaatggatgcgaaaatatcgcatcaaataattcaatgtcgacaaaaggaatgagcaatggggacataaaggtcaggttacataatagagggaacaaagctaggcttaacaatgacagaattctgtgccaaaagaaagacaaaaactacagctatgagttgtcgaaacttaggatgaagatctaatctaaaaagcataatgggaccatgggtcctagttctgaagcataaacgtttgcaagaagtggtgcagcttcaagaagaagttagatcgatggcccatactctgtaatcatgctctagtgtcaagggtgctttgatgctatatcaaaattccaaggtgacgataaaaccaaagctgtttatcctcaagcanngattcactatttcaccgtgcaggacatgaggtggtgtaagtgtctctcatgcatgcgaatctcagcatcaggtatcatgtgatctagaaattcctcggcgtcgctgaaaattggagagaacaagataaaaacattttagcatagtctactcctgctacatatcaagcaaaacaatgtagagtctaaaaacaaaaaagttgtcgctgtctgtggttacaaggaaagacatgaggaccactttggggaataaggacccacgcggttgtgcactgacatatactggatgcaagaacattgcatcaactagctcaccgtaggacatggaaagcgataggtctagtaaagctttagtaataattttcctttttgtaagaatatagcatcaatgtgaagttgtggatgtctaattaagactaaaagtttcacagggaaccacgtcactgacaacttcaaagtcctaggaaaccttgcaaaagaactaggactctacatatataagtaaa

SEQ ID NO: 61202 - DNA, 997 bp, Oryza sativa
tacttcctcggtttcatattataagactttctagcattatccacattcatatatatgttaatgaatctagacatatatatgtgtttaaattcattaacgtctgtatgaatgtgggcaatgctagaaagtcttataatatgaaacggagggagtatgtaacatgttctcttctaccacttagtgaagaccgggcatacaaaaagcaccaaagaagcagtcaagctcttcataattaaaaaaaggaacattatggaactaatctgaaactgcacaatattccatgtaagataagttggtgatattttttttcagaattccatgtgctgctgttactctggtactagattcattaagggggtttctaaagaaacactgtatgcttgaagatattgatcttttgaattatatatatatatataacagcaatattgtaccacccaatcaagcgatctcgttgaaagaagtcgacccgctgaagtaaagttccaataagatgacgcatgtaatcggaccaagaaaaaaccaggaatactaattagcgggcacgcgctagcaaaagaagtcacgcgcgttttccgaccgcgtcacgacaactagggttagggttagggttgccgggtggggtgggggaaggtggcgctgggagggcgggcggtgggccggtgatggtggcgggggcaaagcgaggcaaaggggagggggaggaggccggcggggtggggccgcgccggcacgttgacgcctttcggcgccggcacggtggcggtggagaaaagagctaacctgttaccgagggaggaggagcgtgctcgccggagcccgcaccggagggtagccgctccgctgcctcggacggactggaacaacgatggcgatgggaagagattaaaaaaaaaaaaaaacaccagttccgcaagaatctttacaaggcatgccacgagagggactccgggaagggatgggggagggtgatgcagggcaggaattctaccatgct

SEQ ID NO: 61203 - DNA, 915 bp, Oryza sativa
ctgcattagtgcacaattgcacataatgcataagtatgtgctgtatttacaaatctttatagctttggccttcaaagttcacaccaactagctaggggatgcatcatgcatgcatacagtcattagtaatttgtaatgcgctaacacatgttgtcagcgttcatacatagcattatgctgtttttatctttttcacttttttccctttgtcccggcaagaaaatgttctgaataaagggcagacaagacagcaaggaaatttcagaggaagttcagaacggagtgaaaaaaaaaacaaggtactagttctcactgatttcatcatcatcatcttcatcatcaaaactaattaattacattacaacttatagaaccattacacagcaagcacagccatattgtagtagtagcggtttatccaggcttccatcagtcactgtgaagttcagtgttcctcatggcctgaagaaggcagggtgagggtgcccggtgccctggaaggaggtgttcttgaggtgctcaggtgcgttctcgaaggagtgcctcctcgccagcgagaggatcttcttgtcggcggcgacgaagtatgccatcccggccgccgtgcagatgatcagcgcctgacccgtcgggttgatgttggctttcgcccatgacagcatcctcacgctcgccaattgaatttttttacagcagcagatttcatcgcaagatcagtacacaaggaaaaaactctgaaaatctgaatgtttcgttgtcagtttagctcaccgttgggacggcggatgccaccgtcgccaccgccgcagccttggctccggcgagcgtcgcctctgcaacaattcaaccaccaatgtaagaaccaagatacagtgactgaccgtcaggtaaatcacttataagcagcataaatgt

SEQ ID NO: 61204 - DNA, 803 bp, Oryza sativa
cagcccgttttccttaaagttctggtaggagtttatcgctacccggcgataaccacacggttaccaagaaaaacacgaggtttcagaaactaatattgacggagcgtggggctcctcaccgggagaccgcgcaggcccccctttaccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctctttttttgtggggacttacccccccccctttttcataaatggacggagatttgtatagttgccgtccgagtcaccttctgatgagacggcccacaactaccttcactttcgccgggagcaggtgcgacgtggaatcgtggctgtctactaacgacatgaccggtatcagaccagtcacgtcggtcattcttgccaccacgtgtcagcttagcaatctacatgctcgcccttcttcacacaacatcttgcctgtaatggttaggatgaagcctggcatatatctgaccaggactaacgtgccatctctaggaggtaacacgctagctccagctggggacgagcgcctagaagccctcgtcctgacgggatggg

SEQ ID NO: 61205 - DNA, 2719 bp, Oryza sativa
  unsure (1)..(2719): unsure at all n locations
ttggcacgggcaacaacgttgggctctttctacaatgaagatgatggccttctctttgacctcatctacgcccgtccaaccgtcgtcatgagcacctcccatcccaggggacaatagtgtcgctggaagcgatttggtaggatcaggatctgagcgagacctctctctcatcatgttgttggcatcttgggcatcgcctatctctcccatcaaccggatgcatgagtagaaggagaccaataccttctctttctgccgccaggagcagttccatcaccgtcgcactctgtcttcttgatccggtaaaataggggttgggtgtcgatagcgggaacagatgattatggtgcggtacaaatttccatataatatatattttaaaaaaagataccattcaacaattcaaaatagtatgctcatggagagcgataaagaagtagctaattcaaaagagacaaatctaatgaagcctaagagcaagttaatagcatagctaactactagctccaaatcatttatatccaatctaataatttattcatacaatagttatctataaatatatattataccattaatgactgatcctaccctctcatacacagacaacatcttaaaattcatgctatagctggctagaaatctcacttttcttcactctcttctcttacctttttacatattcttataaagttatagctgggttatagcatactattatacacaggggcggatctacagtatatgggccggtgccagacgacaccgacgacttttgacaaaagctatagcaaaactgcttatccatatattataacatcatgatctaagcataactagcatactatgacaccgatatatatgttatgacaccaatgaattgattttctagacctgccactgattatacatgctcagtcagaaaaatgtgcttcatgatcacggtttaaaccggttgtcacactactgaatcggtgatcataaagcctataaaccggctcagtgaccggttcttttttcccaatgtctcactcacggtgggcccacctttcactcctccaatgggcgtatggatgagcatggcatccagatccaagagaaaaaaaaaaaaagcaaaacaatcccgtagcttccatttccatggccacaaaaaccggcgacctcctccaccccgccatggcctgacgcccccgagaagctgctgcggcgggaggcgatgccaacgaggggaagaggcggaggaagaggagggaaggaggcgaaggggaaggtgatgggcccgctgttcccgcgggtccacgtcaacgacgcggccaagggcggaggcccgcgggcgccgccccggaacaagatggcgctctacgagcagttcaccgtgccctcgcatcgcttcaacggcggaggaggcggcggcggagtagaaggcagccccgcgcactcgacgtcggcggcgagccagagccagagccagagccaggtgactcgacgtcctgcccgtatgatcgattcgattgggggtagtgtgtgcgactgctaaattggtactagtaggcgacaattctgtgcaaatggagctaaacgccttgcaaatcgaatcgaattagaagcctaattggtaggcaattattctgtgcaatgaagctaaacttccttgcaaatcgaatagaactaaaagctgggaagataatttcgaggcacaaatggtgccctcgacgtcgacgagctaggtcagagggggcgtttcacgccttaccctttgtagttatctcggttgggatagatgaattgatgggcgaatttagtgcaacggagctaaacacatggaaaaattggataagattaaggccgagaagcccagtttgaggcacaaatgccatgttccttttgtgctgattaatctatcatgccgtcgacatgtgattcaattacttgcaaatatagtcatacaattgtggtaggagtaacatgcttgcacgttgtcatagtgtcattattgatctttctccgtgctgataactcacttgtgttgaaggcgaaagagcagaacaaaaccattatatgcagtttacatcagctcttccgagtaagttttggaagacggggcataggttcctgccaccaatatcggatattatagcttattgcaaatttgtatatggccagatatgctatgattgtgtntgctgaggtctggtgtttgtaatatacaacanaaaggtccacatgtgaanctgcatgtagcgcaggtggcaaagagtagccgtagtgctgctcaacgtactgtgttctattctccctgacgtgctcaccttccttaaatcattgacactaggttcctccttagtgtcttgcatttttgcctgccgaaaaaaaaaggtccacgtaaaaggggaatgataaaaatggtggttgatatgctttgattgtcaggcacacgttcaacctgtatgtgataaatatcaacggttttctaatactgttttcagcaaggatttaggagtggaaaatattctttagaacaaatctgcaatagcctcccacaacacatccaactaccttttgataatgggatagttatagacatgaagtgcgaatggcaaaagtccaagtcatagatttccaaatgaagaaatgtgaacaaaataagaaagaaagaagtccatttgcagtattatgtctcttttgcccttctttgggtcgaaaataaaataaaaaatcg

SEQ ID NO: 61206 - DNA, 992 bp, Oryza sativa
atgatttttcattagtgtggaggtttatattattcatgatttttcacataaaaacactacctgcaaataatgtttattcgttcataatagtttgaggtgaccattaacatagatgatatatatttgacaccagtgaataaaatccactttctcaatcttgagagcaatttgtaacttcatttattgaggtattgcaacaaagttcttatacaaaaaatttctcacaaatactagatttacatcagaacctgaactgaagataccacaattcatattatgcaagggtgatacaaccgtgaccctacatcaaaggtgagtagtggtcgactgcaatcatatatgcaccggcctgcacatttctgacacatgttaatctagtagctttcgcgccatcagttgtgacaggagcaccaagacaccatgataataacaacatatatttttcaatgataaggcaaatctatcacttacaaaatcaagtgaaatttccaaccatccatggactccattccataacctggccaagcttgctttctcccaaaggtgacctaggatgcatagctatgcggtagtaggatgcccaaaattttcttgcaaatcttgataaatattttgaataatgcagagagagagtaagaacatgtacaagtggaatatcaccaactgaatgcatatataacaccaattgttggccctaattgtggtgaagatgtgatattagaggccattggcaactgttggccagcaatgcaccttcaaatagatataagtggagaaaccaaaactagcaaatgctaattcagtagtagcacaagctgatttatgtgtttcctatgtttaaatctgtgttttttttctctgactcttcacgtgtgttgtgttcttggccggctagctacctgtacatagttgtgttcttttgtaggaaaagggtagctgtcgagttatctattaataatcctagcaaaaaaaaggagttatctattaataaa

SEQ ID NO: 61207 - DNA, 901 bp, Oryza sativa
accgtgatctggatgatcgatccatggttggtggccggccatggcgaatctgccgtcagttttgggcattttttgtggggcggcggaaaactgtgtggcgctcccagttttcggctggtttttagcctcgccgacgtcactcatgctcatgcctgtcttgcactctcactctgtgggctaccacccggccttgtctgctcactagcaatgcattgctgccccactcaaagtacggatcgcttatccatttctgatgcgatctgctccatttcagtctctcccatctcaccttatcatctcctgctagatccaaccaactttgctttactgctattctactgaaaaatactccatccgctctatttataagtgcaattgttataacgcagttgtggttgtttgtgtctaatgttttaccgtttatcttatttttaaaaaatataaaaaataatcgcataaagtactatttattttttatgtaataacaataaaaatactaatcataaaacatttaaataagatggacaatcaaattttgagcacagaaacctacaactttaattaaatgtttagaatcgttatattagaatgtgtcatttaatttaatttggttttttttaacggaaagtgagtagtatgaagggttcggtactgtgcgttagttgtccatccagttgggtttgtggtgatcatcagcaggcaactggttgattagatcaatcaatcactgcccacggtatagatcagatcaccatcctcctccatgtttttcactgtatccgtggccgctgccgttaaactttttcgaacggtcgctgccgttaaacttgaacagttgatatgcatttactctctcctctctctctctctctctgcatatatttatagacggcaaaatgaa

SEQ ID NO: 61208 - DNA, 1297 bp, Oryza sativa
  unsure (1)..(1297): unsure at all n locations
actgtagctccacattatcatatcaaggcgtaattaggctcaagagatccgtctcgcaatttacatgcaaactgtgtgattgatttttttcgtccacatttaatgctccatgcatatgtgtcagggttatagataccacatatttaatagtagttgactaaatctcggcaggacccaccacatactatgtcttatatggaaatatccttcagatataagaggagttccgcgtaaggaaggaagaatagagttttatatggaaacgacaaaaactactcgaattgtatccatattggtttccctagttctacatgaaaaatggaacacctatggatataaatacaagacaccttaggaggagaggggagagggaacaacagatcaagatacatatcaacatacaagccaatatacgccaagacgtgccgccggatatcgacatcagagatatgcctggactgaccctatccggtacctacagaggccggttgtagagatctagcgatgcctctgatctcgccgagcacggattcgaggagaaaaactaccctgttgtcgatacttcaatccactatgtcgacaacagttagataagttaccccaaatattgtactggtgtgatcatagtgaataagagcaacgaccggcttcagccaacaggagtagggttattatctgataattcaggggcccgaaactgtataaaaatcctcctctccgtctcttttacctaagtctcgcatatatcctagtaccaacgatccccatactatgcaaataccggaatcgcgacatcaaacgttgacaatatgtccaaatattttatgtgacgaaatttttaaaagtttgaatggaactanacacaaacacagcctaacttttaggaaatgcacttggtagcgttaattgtaagggatatgccaatttaatttcaactctaagatactattttcaattcctaaacaatttttttaagaaaagcatctggagaaacatttctttctacaaatctcttttttttcgaagttaagctataaaagaattcattctctataaaaccagcagcagtttagctggttgatttgggaaaacagaacttcgttcgtacatcaatcttggttactttggccatatattgagctggcgatatgctataccggcgaggtgacgtggcgtcgtcatgtatccgtaccagtctaccagatcactgtaccgttgctctgttactgtatatactagcagtactacattttctgaaggttcacatcacctttgctttgcattagtgcactctgaa

SEQ ID NO: 61209 - DNA, 2210 bp, Oryza sativa
ctaatttaaagtattaaatatagactaattacacagatagaggctaatttatgagataaatctattaatcctaattaatctataattaacacatatttaatttaatatttattttagcactgcattgtcaaataagttagttagacatggttaacttattatacatattagctcaagtagtataagctaataaataataagttagctataccattaaatttgctcttaaagataatcaggcaggctgacaaaccggccaatgtcacctgccacgtgccgctcagattcatttcgactctgaaaagtttttcttttggcagtaaaaccgataatactcttttctttttaactctgaaaatgttcaggatctactgaaaagaaggcatgtacggagcacatacatacgtacgtggagtggagaagtacgtcagagaaaacagggtgcgggaaactcttttaaatacttgggtgaacgtacatccgtttcttgcatgtcatttaaatagttatgaaaaattttaaaaaaaattgacatgataggttaatatataatatatcacttcacaaatatgtaagttcaaattcgacttctaaaaattataacaaaaataacaagacttctaaaaattataacaaaaataacaaatttgactgtgaatatacgtatactagttagagtttgatttgttatttttgttacaacttgtagaagtcgaatttgaacttgcatgtttgtgaagagatatattacatattaacctatcttgtgaatttttttagaattttttcataattatttaggtgacatgtaagaaacgggtgaacgtccacccgagagattagattagaatccatcctcaacagggggcagatcgagcacagtgccaccgaccactccagcatatgcaaccactcgtggttttcacctcaaaaccatgggtcgtctctcttcttggtgcgtgcgtgctcccccaccttgctggcttcgcatcatccgatgatcgcattctctcgcctataaatccagaccccctcctcttcaatctcatctcatctcatctcgctcagcactactgatccaaccagtaggcgattctctccacctcccagctacttcacttcaggactagtttcttctcagctccatcgatcttgctcgacaatgtcgacgacggtgacccgtgctcacctggagcagaggctcgccctcgccaagcgctgctcccggggtacgtacgcacgcacactaaaccaccatgtttaatctcgctttgtcttgcattccatggcgctaataactgaatatatacaaactgatgtatgcttcgtcgatctgcagaggcgaaccttgcaggggttaaggcggctgctgtcgcgaccatcgcctctgccgttccaaccgtgagtgtgctcagatgctactagcttcttctaattcctccttgtgttgattcttcagcagagagtaggtgtactaacttattagctgcatatgtgtgttgtttcatcgatcagctggcgagcgtgaggatgctgccatgggcgaaggccaacataaacctgacggggcaggcgctgatcatctgcacggcggccgggatggcatacttcgtcgccgcccacaagaagatcctcttcgcttggccaagaggcacttcttttgagaaccgcaacctgaacaaccttaaagaacaaccttctttcaagggcacctggctcgcccccaccctggctttcttcaggcccttgatcaaataattacaagaacacaacatatgctatattatatatacttctagctacctggctagctagctgcatatgatcagagtagtatctgtatcatgtagtagtagtagtagtagtaatacaatacaagtactacgcccctgcagagatcgaaccgtttacaacagctaggtgctcatcctggcctcttggcattaggcattatctagccacacctgaatatgaatacatgcatgtactcctatcttgtactaataacttcatgtaacactgctgcagtaataatgttcagaaatcacaacacaactagtattgttattgtactcttcctgttcagtgtattgtttgctcgtataaacagaaaattcgtgcgaaataatcaaattactgcaatggacaaatggtaagagataaaatgggtcatgtataattaaggattataagattagcattaagagcac

SEQ ID NO: 61210 - DNA, 936 bp, Oryza sativa
cttgtttaacatgcggaaaccaactaatactttggtaaaagaaatacattaaaaaccagcttataattagtattcactccaataaaaaagagttttctaaaatatttaaatggacacatacatagccctattcggaaagaaaaaaaacaagtgcagatatacaattcttaactttcataaatgtaattctaatttatatggtagattttaaaagttaaattggatctgatatacaactcttagcatatgttagatagatatattgatagatagatacactatctttattaaaaaagaatgcaattttagcaatgcacgtggacaaagatatgtccaagttcatagctaaaattatattctttttcgcatggcagtaatatataaacatataaatagatggatagagagatagatagttgaaattgttttttttctagggaggggggatggaggcactagtagatagatagatacattaattccaagatactattgaattttaattcctaatatacattttttgaagggaaaaaaagaagtttgaaaatgtgacacgcccaaatgtttgtttgggtagttctttatttaggtagtagcacagcttaagaggcacatgtgtcccaaattgcgaatctttgcagcccagtaataggggggctcacctaaattaaccccccaactcgcctcttaatcctgcacgcgccgcgcccgcgccttcttcttcctctcccgcgctttctcttcccgccatctccctataaatggcgccctttctcttccttcggccaacccctcaagcagccaaggcgcctcccttcctaatcctacctcgatcgccttcttcctctcgactcgatcgccatggttgtcaacaacaaggtggacagcctcttctacgacgtcgaggcgccaccggcgcaggcgccgacgaccccg

SEQ ID NO: 61211 - DNA, 1804 bp, Oryza sativa
ctcaccacacgccacatcgtaagctaatagctaccacaccttcctagtagcgtatcacctgcagagatgatgcatgctctcttgattgattagttaattattgcctgttcttcgctaatcgcgtggtgattagaaggtaatcagggggttaattgctattactatttatagaaagttccgcagaaatggctaggcgccaaaatagtaagggaaccacaattaatagccacacgtatgaaatgcgtggggatcagggatgcaagcatgtcgacccatgaacctgcgtacaggttatttaaatgttgcgcctaatagaacaatctagatatttagtgattcacaagtaaagtgattttatagttcttaagaaggtattagaagataccatattttttaatgtaaaatttgatacatcttgatatcttcgatactaatagataccaaaatttacactaaaataatcgatacctcttggtatctctcaaggatcgtaaaagctggcctgccttgcctgtataagtaaaaatgtaatgagacaagacgttgtaaattctgagacaatggaagagtacagaacactttcggctaggggcagttatgagcaggactaaatggttattgttagttaattagtcggcaaattctttaataattatttgaccatggttaaagacaggtaacttatctatagctaggaaagatagtatggcaaagaggaaaggtggtgattaaaaccattacaaagtgagcttcatggaggggcccagagggtgcttgccactaacaaggaatttgactccactcagttaaactaatggccaatagttaatggaaggtgaagttaagctacctccagcttatagggatctcataatgatgggatattttgatttttcctaaaggaattccattcacataattgattgtcgcgaaattcgaatatcttactttagtagttgggtggttttcttaattaggggatcacataaaagttcctcaattttttcaaactgtttaaacttatttaagctagtatagtactactttagggtaatctaaaaacttctttagacttgcttaataaacagttgctatgccaagaaaaagtcatgtcttatgcctaatcttccaagatatctgaacgttggactaacacatggtgtctaaaaagttagtgttggcgtgtgaccagaagtatttaaggttgttaattgcataattgtgaaaggagtttataataatatttactccccttacacttgcagaaaagcactaattcttttagtaattaattaatcgatcatgtgtacaaaaacatatgtcatgaagcactctaactagtatgatgagcagttctagtttggatgatctcacaaactaaacaaaaacaaagaatgtttatatcttgcattagtcttaatacgattagaccatatacatcaattaaagcaaggcgtgtgtgtggctttagaatatattctaataaagccattttcaattggaacatttctcttttcccttttgggaagaatggatctggtttggccactctgacgtgtcacctgttaagctggttgttcacatgctcatctctctgaatttcggtgtcttttcagtctaaacagaatgatctgataaacacatccattagactgttaatggttttcctctgagaaaagtaagtcatctgctttgtaatgacgctgttcctcacctggaatgattaaaaagtgtcaattaatgcgacaattccacggtcatgggaccatctcagaacaattcttcagaagatgtgaggagatgg

SEQ ID NO: 61212 - DNA, 1677 bp, Oryza sativa
  unsure (1)..(1677): unsure at all n locations
cgcttagtcttctcagttttctaacaagtatatattaaatccaccagttataaatgattcaattggcgatcttctgtaggagacaaaatcttattttcatgctcaggcatagctatagaacaccagttttttacaaagtttttgactactgcaactctggttagagctcttaatgctacgaccaaacaccatgatgacttaaaggttggtgctgacagtcatcctttactaatctgtttacttctgatcattgtgtgctcatttctcgctttttcattttttagattcaagtgcgccttgacggcaccagactgtatgatgggtatatggctgaatatgatttggataatgacttttctgttgtcgaagtctatagtgtccgtgatgttcaggttggacctttccaaagtgcacttgaaagtctgcnccatggtgaggtattagctgtagggcatgacacctccggcgaaataatggtcgagactgtggagttgaatggcgattcaaaggtatccgaggatgatagagatcttcattgtaaaatctcaaaggtacacttgcatgatgatatgagcatttcatttttatttctgttaggcatggaggcaacagaaatatttgatttcttgtttgtatttaactcttgttctgtacaactttattttgttcaaatgtaacccgtgttgcttgttttatttcttagccttgggaaggtgggccgcttctttctgttgatggggatatggttggcatgaaccttttttttaccaatagaagagccatttttctaccatggggcacaactctcaatcattacttgacattcgtgcaaaagaagactggccttgtacaataaaaanaaatgaaggttcacaggtatgtctatttaatcctcgcttctctgtcttgttcctgccntatgattctacccacatagtgtttggcaccatttttcgtataagtgcactggtttgatccattttactttttgattagtagtcaactagtcattttttatgatctgcaggcctgaagcatccataggtgagaaatctaacagccatccagaaggtgagcacacaggcactcctcacaagtgcttaacatcatattgttatgcaaattattgagttcgtaatggtacctatttagaagctgtgcaagcgtttacatttgtacatcaattattccggccctttcagtagtactcttgtattgttggatcttattagttaacatatgtacaataggtatgttcatgcacgctgacttctaatgctaattgttgctcaggctgttataatgatataactcatgttacatgctatgtatgcgcagagtttatgtgaatttactttttgtgtatagtattagtatatgtcagtgctgatcacttcaccttgttgaccagtacatggagattntctcaaccaggaacagttagatcttgacttcatgggttatcctaagttaccatcctnncatgtaggaggtgagtcagtgcttctaaaaattgctgatcttttacagctctcatgtaccactaacaacttattctacaatgtatttatccagctggcatgatcttggttaattcttttgaagacccttttggcgacatatatggtgaaggtgtctggagaaaattcagcagaagagcttctatcctaaatcgca

SEQ ID NO: 61213 - DNA, 1191 bp, Oryza sativa
tgccggttgggcgctccctgttgggagcgccggcctcgttctttttgcctcccgcaggcctcccctttcgggtggcccgcgaagcgccctcgacggtgaggacatgaccctcgtcatcggtatgggctgacctcttcttcctcctcctgtcacgccgccctatctgagcggcggatccgggggcggccgaagctgccacaccggaaccggaggggttctaagtccatgcctcctccttatgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcctgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgc

SEQ ID NO: 61214 - DNA, 755 bp, Oryza sativa
gggactaagaggagggcgaacgcatcaccctcgggcccgacgtccctcgggggtaccaggctacgtgtgcgattgtgtctgcctcaaacctctagtcatatactcctgatcccatgtcaccgacaaatatggttacgacggtattgtaagagcaggcacaatagcatcttataaccaactataacacacatcgagaagaccaaatttgtagccagctgcagcacaaatacaagacacaatgtttgtctgataagtgggaccaggtattactagtgtggtacatatttataaacaactattgtataaattgactgttaaattaactatagatgatttgaatctagtactattaaacttgctctaaacctctttgctcattacctgggtaagaagttaggtccccatcgtttggttttttatggaataaaaataaatttataggtaaaacttttatatagatgttcttggtggcttaaaaatcaatgttgaaaaagaaactatattgaaaatatcacaaaatcaaaaatttaaattttggctttttcttttactgattaggccatccgatgggagccttagtacttgtggcaaccagcctgatgctgctgatactacagcatagtggtgcatctgacggggctagggctgggtctggaagtatctggcagccccagcccgattgtccagctccagcgaagtgcggcaacgtcaacattccctacccgtttggcataagagaaggttgcttccgaccg

SEQ ID NO: 61215 - DNA, 1322 bp, Oryza sativa
tttagattgtatgggtatcgtcggtaccagggttatcgaagtgtaaacctctctagcgggaggacgtgagaccccccccccccctttgtgagttcggctaggggatagggcgcgatgatcaagagtgtgtcatcgccgtggactcggctagcgaggtggatggtgaacggggagtgagaccagagattatctaggttcgggccgcttggaagcgtaataccctactcctgtgtgtgggtttatgtttaggttgttacaagggatcttgaatccgggagtgcaatctgcaagcgttcccccagagttcaagatcttccgaatcccccttactcggtaggcaaggtcctccttttatagtttagggggttaccacatgcaccgctctacacatcttgtcattggaggggggcccacatcaactctggtcgagccgccacccatgccttagatcggaagtaaggtggccacccgtcctcaggtgatccccagcgcagtcttttgtctgacacggggggacatcccctgtcattccctcataaattcttagagactttgtgggttcatgcataggggatgcaccggtcggacatcggtctccgggcgtcgatgagacggggcatacctgcccccacgccacctgacacagggtggggcatgggttagggttgtcaaaaaagcttgaggctcgcgaactactcgagctcggctcgtcctaggctcgattcgagttcggctcgagctccagacgagccgagcccgagcctatccctaagctcgcgagctttgtcgagccgagctcgagcttctaacgagtctagtaatatatgatttttgttgttatttaataaattaggagatcaaatatgttatttgtatgtcttatattgacatcatatatttattttgttcttttttcctcttctattaatacgatgaactagaaattaattataagattatctttgaaatatatattgtgttacttaaaaatcaagctcgagctggatcgagcttgagccgagcctgtcaaaaagctcgaacattttataggctcggctcgagcttatatcgagctcgagcctaggcagacgagctcgctcgagctcggctcgttgatagccctagcatgggtgcgctgccacccgtctcatccgcctgcgactagtctcagcctggtcaagggcgattgacgcacatcaatcaatcgaacgtcgcacgactagccatgccacattaaatgcggcggtggtggttggggcgtcgcccatcaatgcgcctggcagcgcctctttctctgcccactcagcagcaacgtggcagcc

SEQ ID NO: 61216 - DNA, 1145 bp, Oryza sativa
tcgtcggagagatccccgagcctcgtatcttccactgctctatcctcttccgccttcgcctttgctgctgctcttcatgtgctgccaccacctcttcgtccttccctagccgtcattgccattggccgcaccaccatctatgaggacgctggccggcgtcgtactcttcatctccaccatgctgccgctccctctcctcacctcaccccttcccttctctagatcgacagagccaagcagccaacagggacagtaatggcggtggcggtggttgaaggtgttggtaggaaggtggcagtggcgggggatggggacgaggtggtggcgagaggtaccgttgccgccaccatcacctgtcgccaccattcgttcatgcctttatgtgtcggttaggcaaggaatagcccatggggatgggggtagagagatgcctttagatttctatagcttttctagtgtagaagcttttgcatgctcctatagccctatccacttaggctttcaccgattcttatgctggtcacgattcagtacatccaaataaataccaagcaaaccaatagcacgggcaatcaaacaataaatcaagccacttgcaatcaacgtactactgcacacaagggctggcaatcacaaaataacagagccaagccgccggattttgtttaaaatttgggtaaaagataaaataaattttaaaattgaatttttaatacgaattccataaaaaggtcattaaaattcaaaataataataaaagttgaacaacctagcaaagcacattctataaatatacaaaagtaagagtaattgaaactcagaaaaaaaatatttctgaaattgcttttcaacactaattccaaataaactttaaaagatcatgaaaattctgaataaagtaggaaaataattttgaaattactaaaatttgcgattaaaataagaaatatcaaagaacagtccatatagtacacaacacaggattaactaacttttgaaataaaaataaaataagttcaaaactggatttacatatgaattccagataaagatgaaatcattaaaatcacaatcacaaatataataaaaacttataacataatcgcggcgaataaatttcgatttcgctaggcattgatgacaaa

SEQ ID NO: 61217 - DNA, 1331 bp, Oryza sativa
  unsure (1)..(1331): unsure at all n locations
aatccgttatctttgttttcttctgttgtccccttttgtgcaacaatactaacagttttgtaaaagaaaccaacttgttatcaacttaaggggaaaacctgaagttcagcatgtatatagttttttttttcatattttacatagcataataaatagtatggtctctacccatgtacgtcgggtcaatctagttaaatagcaaaaggaacaagaaggtggaggccaccagccattgtgatcatagataaaccacctnctttgatctcctaccttgcactcaataaaaacatgtctttttatgatgctcaagtttttaataagatggtatatctgatcctctgaggtatgaaaatttgtactattctatctgtcccaaatataaaaacgtattaatctggaaaaaaaaatgtgtctcatccattactaattttttatatttttgggatgaaggtagttaaaaaaaattggtacacttacaaccagtanaatcttttgttntttggttctgtttgtttgtgtacatactatagatatatacagattcaaataatcgaaaaaataaggaaggagatggtgttcttttaccatgnggaacttggacttggcggcggcggcgcttgacggacatgaggcgcatcagattcagcatccccatggagatggtggtggatgactcctatctgtctcaggggatctctctccggcgatggccactgtggtgagagaatcgcactgaaattagggggattggagaggcaaattaaacgagagattttccttttaggaaggaaagagaagacattgcaagcgacgcgtccgaggcatccacatctacaccggcagtggtcgtcgacggcatgcggttttctggaccgccggcgaccaaagagatcacacacaaagagcgcaccggagcaatgacaacatcatcacaccatataagctaagattggcctagcctggtcggttagatccaagccaggctaccaaaattagagatcatagattgatccacttcagacagttcacgtagaggctgatatatatggttgccatttgccaaggcattcgaatttcaacaacactaatgctgctgggtaagcaaaccatatcaatacaactgcaaacgatgacacatgcatggatatcaggttatccaatgattcagattggcacttgagaaccaagcatcagattgtcactggataaccaatcacacaaaccagtttgtcaggacatcctttggaatgggtttcaggaatcaatacagatgacttgcaaaccacatcaaacaaaatttgaaaatataatacgcacatagcagggcataa

SEQ ID NO: 61218 - DNA, 1244 bp, Oryza sativa
gaaaacggtctctggttttgaattctgaatgtagttaacacatgttctcataggctgaaaatttgggtgcaatttttaggggagatatggtccaagttgacacatgggtagctgctgctggcaaaaatggcatgcgtcgagattggcatgttcgggactacaactctggtcaaccaatcttgagggctacaggtttgtgtttatcgttgcatttgttgcatttcttttgttcatgctgtttacagcatgttttatcccttttcgattgctaattgttcctctcttgtttgcagtgtttgggtgatgatgaataagaacactagaagactttcaaaaatgccagatgaagttagagctgaaataggcccgtatttcaatggccgttctgctatatcagaggagcagggtgaaaagttgcctaagccagggaccacatttgatggcgctgctaccaaacaattcacaagaaaagggcttactgtaagtcagttaatattgcttgttaccgtcattcattttgctggtggttctcatgcataaaatttctcatgagggatcctttgttcatgtcagccgaagtggagtgaccttgatgtcaaccagcatgtgaacaatgtgaagtatattggttggatacttgaggtaacttctttttccttttctctatccgaacatgctatctctagatcagaaaagagagtgtctgatcgtaattagtaacctagttcctagtcatatgccaagctgtaaaaacacttgcactgtatattcaaaagctattcaaatttctgagtacgttttggttttttttcctcagagtgctccaatttcgatactggagaagcacgagcttgcaagcatgaccttggattacaggaaggagtgtggccgtgacagtgtgcttcagtcgcttaccgcttgttcaggtgaatgcgatgatggcaacacagaatcctccatccagtgtgaccatctgcttcagctggagtccggagcagacattgtgaaggctcacacagagtggcgaccgaagcgagctcagggcgaggggaacatgggctttttcccagctgagagtgcatgagcgcttctgtagtttatccggcaagtaacctctttgagaagtgcagattctaacttggctagcaacacaggacaaatgattgttggtgggaaatttggcatgccgagcctgggttttgtgatgcacacagcacacattcagatttgaagattgagagatg

SEQ ID NO: 61219 - DNA, 709 bp, Oryza sativa
tgcattgcatgctacagctcaagtaccatcagttgacgaatgcctgctctacgcatctcaactctgcacatctccagcgaggtttcaggctttcagctagtgattacagtacacagggagtacagcacaggtccagacccaagaggggtttgctgcgtccccaactcttcatttgcacttccatttggcattttgcatatcatatcatgctattactttcagaaagtagctaggcttgctccgtttgatttagattatgagcaaattattatcacggatacttgcaagcatgtggggtgtcagtgcgattcatctcaaagattggcttagttttcaaattttggacattttaattcatggaatttgtaacgagatggcgcatttaatttactgtaccacctgtctgtatgtactgtatacaacaataggctccaaaagtccaaataatctccggccacctatctattgggctcaaccctgtaggccggtcagagcccacgtaactggaagccccttacggcccaaccaacatagccgcatgtaattcacaatccaaaatgggccgaacgtaaggcccaatcccgttattgggtcgcacataatcgaaatcgctttgcaggccaaccctcatcagcccggcccatggaaaacgccttacctgggctgctagcccgagacatctctctctcccgaattttttttatttata

SEQ ID NO: 61220 - DNA, 717 bp, Oryza sativa
aatctgacttcctgaaatgttgtttctacaatctaaatttagtttttaaagtctgatttatacacgtctggtctatcttttgcttgtttcagtgaagagaaaagaacgaaaattttcggtagtccatacacaaaatgccatcagtccacttgcacttggtgatattgtatgttttctcatttccttttgaaatgtttagaataatagcatcccaagtataaacctttgtgatgacattccatgccctcttctcttgcagccactcatcaatctagacttgtgggaggtaaggaaatgacactgcgtttagatattacattatgctaaatattgacatatctacttttgtgtttcagcatgcttactacttggattacaaggtattttctagatcctctttttcttcttatacctaaaattgtaattcaccaagtactaagctatcataaatcactggtgatgcttccttttgatgcttcaggatgacaggcgaatgtatgttacaaactttatcgaccatcttgtctcttgggatactgtcactctacgcatgatgcgcgctgaggcttttgtgaaccttggtgaaccaaatatcccagttgcatgatatgagatgatatggatatgacctagagatatctatgcatgtattctcatcatgaggtaaaatccagcattttgcaacatcatatctggtacatatgcagcttaattatg

SEQ ID NO: 61221 - DNA, 791 bp, Oryza sativa
atattccatagtttttttccatcttcgactccgattagcttccatgcattttatcaatagttcagctacctgaaacagagaaaaacagtgcttcttgctttttaaaccaaggtatacagtgccgggatgtacgactcaaaatataattcaagaaatataatataagttctgatgtattcaagttcatatccttctggtgtggtatcagcagtcatgatatgaaattcttaaactatcttattttgctaatggagttaataatcattatagaagtttgcatagtctattagaatcctaagtatgtttctacatttaatcatgaatctcctgatgttttattcttttatgtcaaatgatttccttttattcgtttatagcttgaaaatgatctcttgtcagggatggcagtcgcaagggatctaggtgggaggaaaaaccgaatagtaacagttataagtaactggacaactatggctggtcaggtgtatgaggcaatgggtcatgccggtttccttgattctaacatggtagtgattttaaatgacagccggcacaccttgcttcctaaagcagatagccaatcaaagatgtctattaatgccctctctagtgctctgagcaaggttcaatccaacaaaggatttagaaagtttaggaaggctgcaaaggtaaaactttatgcttctgtatgacataatgtactagatttgaacttgctaataaaacatagttttttttacctgtcctgttatttcctgattatgattatagtatagacatatagtttctag

SEQ ID NO: 61222 - DNA, 840 bp, Oryza sativa
catacgtacgtctacaacgttatacacttaaacaatatggtattttttaagtatttataaataatcttttagaagtatgaaaataaatattttttttatgtgtgtattttaaaacaaagcgagtgtaccttttgaatttaagttttgatggtacacaagacgtcgatcttaagatatatcaacccggtcttatagagagagactcacagaaataagatgtgtgtttataaggataagtgtgtgcgtgttgcgaatgtctgtgtttgtactgtgtttcttttaaaaaatacgtgcttgtgcatgaactatttcattttgcattcctgcataccatccatccatccgtagatcaagggacggacggctgcgatacggctgttcagacggtagagtgtacatgtaagatgtaacctcgcccgttgccacggtcgcacggccacgactccatctctcctccatcgggtacctctctctctctctctctctctcctcttctcgtcgccctaatccccaatccaaaacgaatccccaatctcgtccgcgccgcggctcgccgtggcctcccccgtgcgccgcccgccgcttcgcatcccggtgagaagaaaagaggtaaagctttcggttccacggcgaaagtttggatctttgatgcacaaaaagaagcatcttttcctgctttaatctcccttgttcttgagctacaagagatcctctccccgtagaaaatcttgatctttctaagaaccgtgaaatactgattcttggagatgatcaatggtaaattagtgcagagattaaaactaggtttaggagaccccctccccggattgattgattgat

SEQ ID NO: 61223 - DNA, 1810 bp, Oryza sativa
atagatccctcgtgtttcaagtgatcaagtttctctcagaattggtgatacctatccctaccaaacttcccattaactgctacacacaactcccgaccaactttctacagcatgtaattcctcataagtttgtaaccacagagcagcatttcctacgaagtgaagggtagcaaaggaggcccaagttgcataaggaacttgatacatgtcaaagtatttttcagattttttcttccacaacttagggttatctccatcaaacttagggaattcagttttaggtaatctaggcccctgtgttccaaattgagaattcccaatcccccactctgaactctccccaacttcgaaattaactgcagattgagggatttggatcttactcttgaccagggttcgctcctgggcagactctgccgcagtcgcttcaccctggtacttgttgtccacgcggtgcccatttggcggaggcgtcgccgtcgacgactgggcctccagcttgatgacccgcgccttgattccttccaccgaccgccggaggccttgcattccagcgtccacgcttggaatccaagcctccacaccctttagcgatcccaggatgcggtcgaggttcgtgctgagatccaccaccttctggttcagattgacaacttctccttcagcaatcgacatcctctccgtcaaggtgggctgggatttcttgcgcgccagatcgaaagataccaaatgtgacgatcctagggttcggggctctagatttggggaatcgtcacagtaaacatggaagaacagaggaggaagaaggagaattcaggaccagaaaggttggtagtagtttgttatcatttcttttcttcgataccccacttcaccaacctcacagggtttataacacacccgtgctgttggctcggttcttataaagatggcccaatagctggcccaacacacacaatgtcccttacaaggcccattgatcatgacagcataggcccctatactgaatgtcttaacagtatgctgacatacacaaaaatgctcaatatagctcatatatgttctcttccgcaggatttagaatccaatacttaaaagattcaaaccagtaattgagaagctgcaaatattgaaccactgcatctttcagtactctgtctctatagctcttccttgtaaattgcagtgtaaaagaagacataagcttactgactaaaataatgtcttgtacaagtcataaaattgctctttgagggaaatttacactaattttttgcactgggatatccctttttgtatgtgatagacaacagatcactgatcgaagttcttcagatgattagaaattcttagagagcaccaagataatttaatcatgcatcccgctttgggccagatgcttttccatccagttgaatcattgctgattttccttactgattctgagattgcttgtacagtatctgtttgagagcatttctgctcaatccgaaccacacgcccaattttggtgtcacaggtatctctcagagtgaccagttgcacagacctggatttttcacattttggtccttttgaaaaacttatttcacaactagacccctgaaaaaacttatcccagaaatggtccttttttggcgccagagtggctggcgccgtcatccaacgggacggcgccagagaggctggcgccgtccttctgccactgtggcgcacgcgaaccgacgtggcaggaggagggcgccagccatgctagcgccgccgcctccattcctgtttctctatatggagttgcaacggtgtcattttt

SEQ ID NO: 61224 - DNA, 3425 bp, Oryza sativa
accgccgccacttgaaatttctccattccacaaattgtgccaaccacccttgacatgttgaagcagactaactatatcaatctcccaatgcttctcaagcctacattcagcctaaaaagaaacagtgttctttctttctgagcttggcgaagagaaagatagaatgaaagacgagaaatagtgagacaatataatgagatgcacatacatgttcatataactattatgtttggctatgtattccttcgtggatatagaggccggattaatgaaaatccattatctaaaaaaatataactattatgtgtcttttattgcatctatcatctctgacaaaaaagagttaatctagcaaatgagcacctgcaagtactaaatcactctttgtgctcaacaagggcattgaatcacttgtacttggcagtactctgcagtgtgaaaagaaaggattgggataatttcactcagataaagttggcacaagacatatgtgacgatcctagggttcgtggctctagatttggggaatcgtcacaggaaacatggaagaacagaggaggaagaaggagaattcaggagcagagaggttggtagtagtttgttatcatctctcttcttcgataccccacttcaccaaccacgcagggtttataacacacccgtgttggtggctcggttcttacaagacggcccaatagttggcccaacacaaacaatgtcccttacaaggcccattgatcatgacattccctcccccttaaggactggcttgcccccaagccagcgcagatggaaaacgacgccataagtcggccaaattttcccaggtggcaagagtatcaggaagccctgaccatcgtaccagaacagaaggaatggaagaaccaccacgcttgatcaactgacgacgtagaatggctttaggatagacttcacttcatcagtagaacaagtcaggggtagatctgaactgactggtgtatcaggttgcactgccttcttaagtaaagagatgtgaaccactaggtgaatcaagctcccagccggcaatgccaatcgataagccactgctccaatccgttccaggactttataaggtccaaagtacctgaaactcaatttgtgacaagaacgtttggccatggttagctgaacatatggttgaagtcgcaagtaaaccatttcaccaggggcaaactggcgttttgaacgatgcttgtcagcttgtgctttcatgcgctgttgagctcgaaccagatgatggtgaagcaactcgttcaatttcgcccgattgacaagcaactgttgcacatccgggatagtactttgacccatatcaatcacaccgaagctagttggcttacgggcaaacagagcttcatagggagacataccaagagcgctatgctgacaagtattgtaccagtgctgggcctaagcaagccaagaagaccacttaccgggggaagaataaacagcacaatgcaaataagcttccaaacattgattcaaacgctccgtttggccatccgtctgagggtggtaagacgagctcatattcaacttgacatccgagagtcgaaagagttcctgccataaagcacttgtaaagatcctgtccctgtcagagatgatggcctgcggcatgccaaaaacatcatagatgtgctggatgaacaactgagccacttttaaggtagtaaagggatgagataagggaatgaacgtagcttatttggtgaacttatcaaccaccaccataattgtatcaaagcccccagacttaggaagcccttcaatgaagtcaagactaatgacagtccaagcctaaagtggaactggaaggggttgcaacaatcctgggctcttacaatgttctacttttgcttgttgacagattgcacaagactgaacataagccttgacatccctttttagtccaggccaggcaaacatgctcttgattcgttggtaagtggcagctataccaaagtggcctccaacgccactattgtgcagggagagtaagacagcttgctgggcttccacgtgtttccctagccagattctacccttgaatttgataatgccattaaccaatgtgaaattgttgaccccatcaggatgtaaacttaattcaaccaataactgttttgtagcaggatcatggtgataaccatcgaccacaacttccatccatctaggttgaccaacagaaagggcaccaagttcatcatactcaccctgtcttgatagagcatcagctgctttattctccacccctttcttatactaaatgacatactgcaaccctaacaatttcaggaaggccttttgctgcataggtgttgacaatttctgatcacacagatgagtcaagcttctgtggtcagttaggatagcaaactcagcatattgcaaatattgatgccatttatccacagccatgagaatagccaaacattccttctcatatgtagaaaacccttgtgctttaggtcccaaagccttactcagaaaagcaataggatggccagcctgcatgagaactgccccaatacccttgtcactagcatcagtctcaataacaaattgttggttgaagtcaggcatggccaaaactggtgcttgctgaagacactgcttcacttcttgaaaggcagtatgttccagtgtagaccagaaaaagaaggtacccttttaagtaactctatcaaaggcttagtgatgaccccataatttctgatgaactttctataataccttgccaggcccaaaaaccctctcaattgcttaagatttttaggtactggccagtcccttatagcttgaaccttctgaggatcagtggcaaccccaatagcaccaattatatgtcccaaatattccagagaaggttgtgaaaaagagcatttacttcttttgatgtagagctgatgttgttgaagcactgtcagtactgatttcagatggcagacatgttcagccaaggtcttgctatagatcaaaatgtcgtccacaaaaactagcacaaacttgcgaatggcatgtgcaaatatagtgttcatcaacccctgaaaagtggctggtgcattggttaatccgaatggcatgacacgaaatttataatgtccttggtgagtcttgaaggcagtcttaaactcatctttttccactaaccgaatctgatgatagccagatcttagatccagtttagtaaaccattttaaacctgacaattcatccaacaattcatcaaccacaggcattgggtacttgtttttcacagtaatgtcattcaaacccctatagtccacacagaaccgccaagtaccatccttctttttaaccaagagaacaggggaagcaaaaggactatggctaggctgtataacaccatgctgcaacatttgagtgacctgttt

SEQ ID NO: 61225 - DNA, 928 bp, Oryza sativa
  unsure (1)..(928): unsure at all n locations
atcctaagttggttggaggtcagctacgacgacatagtgaaactggaggttggctaagatgtcaccgtagacctcgcttcacacaacgccagctctgacaccgtcacggtggttgccttaaacattacgagaaggcaaacgataatggggagacacatatcacatgtgggcttatatctgaatgcctcgtgggtgaacatgtcgtacatgtgggctaggctgtgttcgctcctgacacggaaaacgaaacacgtgattatagtgagattaattaagtattaatctaaaaaaaacttgaaaaatggattaatatgattttttaaagcaactttcatataaaaaacttttgcaaaaaatataccatttagcagtttaaaaagcgtgtgcgcggaaaacgatggaagtgagttgggaaagaggggagaaaaacacaaccttataattgaaaggctggtgcttttctaaaatttactcatttttaatgaaacatctaattaagtatatacatgtttcgtctctgcttcttgcctatggaagagctagaaggcttccactctttccggtttgtgatccttttatggtagtcaatcatgtcaatgtattctaccctggccttgtgcatatatggagcatgggattgggatgtgttaggattcaagaagccgggaaaccttcattatgccggtgccaagccaaatggtgaagtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61226 - DNA, 707 bp, Oryza sativa
aaaatatatatagcccttatagaatacatgcaagtcattctgaacaaataatgcactatatcttcagaaaaataaacagaaaaaacacattgtatgaatctcattgtatacttcacaaaaacaaatagggagaaaaaaattatttattagtgcaagtgcctgcagtagccgcaggcgatgacaacgaaattggtcgaggttgcaggggaggagatcaaccatgagattacgtgtggcaagtcgtcccttcgatgtccacaatgatatagttgattttgtgttgatgggttaggtccttgatgcaagggtagatggctttagtacctgcttgaatctggtactccttgtccttgccttcacaaatacttaaagttctgaaaaaacaactgatcaagatattgaaattttgaccaacaatgacttctaaattattcaattagtttcagtatatatgtgagtttatgacttcacaattgtgtgcaactcacatgtcactctatggtgctgcactcataatcttgcagtaacaacatactaggggagaaaagaggggctacgaaatgcttgaaaaaaaatccacacacaagaatagtttgcagacagctaaaaatttgaattaacatccacaagcgatcccttgtgcacttggcatctactccttccgtcccctaatataagcgatattcactacgtttgaccactcatct

SEQ ID NO: 61227 - DNA, 803 bp, Oryza sativa
ttcaactagcacacagtggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaaccgttttcgcattcaattcctgtttataaatgctagtttttatgcaaatgaaccactctagctcttctttgttaattccctgcatcatacccctattccggtatga

SEQ ID NO: 61228 - DNA, 1248 bp, Oryza sativa
tccccgaacttgatggagcctcggacgctggagtcgaactcggtgaagaactcccgccggtcggtcatgtgatgggtggagccggtgtcgaggtaccacccatcagccttgtcgttgctggagccgttgccagaggaagacgagtaccttcggctcatcgaggtggaggaaagccgttgcggccggtgccgctggagatagctcgatgccgcgtcgtggctgtcgacagtctttggcccaatggccaagcttgccacagttgcggcaagcgtcgtctcgtgccggcttgtggttgccggcggcgccgccctgggcgcctctgcgagcaccaccctcggcgcgtcttcgcgcccaccgcagttggacgcctccgcgcgccttgcacggcttgcggccgcctgtcgagggagaggactcccccttcctcccgtcaccctggctggcctcccactgctcccgagtgagatggagcttcccgccaatggtgataggccccgagagaggctgtggctcatcgccgtcgacgaccttgaggcgacctaacgcctcctcgatcgacatcgtggagaggtccagcagagattcgatcgagcgagcgatctgcctgtacttctcagggacgtaacgaaagagcttctcgacagctctctcctcgtcgtaagtgtcgtcgccgtactgcaccatcttctgcaaaagagtgttgagacggagggcaaagtcatcaacatcctcacctggcttgaaggccaggttctcccactccttgcggagtgcctgcagtgtggacttgcgggcgcggtcgctgccgatacgtgccacagcgatggcatcccaggcctccttggcagtccacttatgggaaagcgagaactgcatctcgagcgggactgcagcgatgagggcatccagtgcccgccgatcctcatcgtagtcaacgtcgccgtaccggactgcctcccacatgtgccgcacctggagcctcaccctcatcaccgcggcccgctcgatgtagttggttttggtgagggtaggccacccaccgccgagaccaaagtcccttaccaccgtctggacgccgtggtgaccatggcaccggtcaggggagggagagccgcgctgcctgcgagggccgcgcgcgggctccgggctgccgccggcacgcccgcgcccatctgggttcccgtcggcgggtgcgcggtcccttgggccgccgccgccgctctgcccgttcccgtgcccttcctcttg

SEQ ID NO: 61229 - DNA, 1168 bp, Oryza sativa
gttcatgatcccacgaactatcggagtcttgctggcgccctccagtacctgattttcaccaggccagatatctcttatgctgtccagcaggtctgtcttcacatgcacgatccacgggagcctcatcttgctgctctcaaacgcatcttgcgttatgtccatggcacggttgattatggtcttcacatccgccgctcctccactgttgacttgagtgcatactctgatgctgattgggcaggttgtccggacaccaggaaatccacctcgggttatgctgtgttccttggcgacaacttggtctcctggtcctccaaacgtcagcttattgtatcgcgctccagtgccgaggcagaatatcgtgtcgtggccaacgcggtggtggcttcgacagcttcttcatgagctccatacccctccgagccgatccacattggtttactgtgacaatgttagtgctgtctatctctcttctaacccggtgcaacatcagcgtactaagcatgtggagatcgatctacatttcgttcgcgatcgcgtcgctgccggatctgttcgagtgctacatgtacctactacgtcacagtttgccgacatcttcaccaaagggttgcccagtgccatcttcttggagtttcggtccagtctgaatgtccgttcccacgacgttccgactgcggggggtgttagattgtgtttatcccttgccatccttccttaatcttctccgatattgtttctataaatcggttgctagatatggaaggcatgtgcctatatgtactctaccatatgtgataatccaatctatcgtgttgagcctgtcgtcgatgacggtccagctctcgtcgccaggcttggcaatggcgcgcaccgtgggatcggagaaatcgactgccactactgtggaggcatcctcgacgacaaaaccggcggcgttcacgcgaagacccacgccatgggcgcccaaacgccagctcgctcgtcggcgccactccggtgtcaggagcgctgtcaccggcgggaggtcggtgcggtggcgggtgagcgggttcaggaggtggaggcggaggctgggctcgtggagcagcagcaggaggccctccggcgtgagcgccagcatcgtgtggtcggcgagctccgggatgtcgtccgtgtggatgcaccc

SEQ ID NO: 61230 - DNA, 2316 bp, Oryza sativa
aacacgctagccctgtatccatgcctccttgggttgtcttcttccccccattttcccaacgcaactatcttgttttccacgcgcacgcttttcaaaccgttaaacggtataatttatgcaaaaattttctatatctaattattttaaaaaatcatattaatttttttaaaaaaataataataaatacttaattaatcatgcgataaaacgaacttcgttttgcgtgccaaaaaggaagggttcctaaccccctcctccgaacacattctttggtgggtcgggggccttgccttgtgccaagctgcaggcatcgaatgtgaggcggctcaaccaggaagagttgaagcctagggtagataagaattaataagagcatatccaacaacatctctaaatacaactttctaaatacctattttgccagtttgccaaagagttggagagtcaaatttgcatttcactccaacgatctctctattaccttctccaattttaatagtgggtcccacatgtcaatctctaccattcttcatttcttttcacgtcattccctttccccaccctcccgccggtggatgcgcaggtgatggcacagcggctgctgctgctcgaggcaagagggctcgcggcgatgcttggcggcggcaggggcggtgatgcaaatggcgccgcaccgctctaggaggcccctggcccatgtggcgcctgcgtggaaccccttggccgcgccaacaacagcctccacgtcgcaggcgacgtccggcgggagcttctggaggtccgtgaacaagggttcatcctcctcgccatcaccaccgccaccggcatggcaggaattgattgggacttgcgattcgttttcctcactgtgcgtgtcgtggtttcgccttttgcggtggcgacggctctacgtgaccgtggcgcagcgacaatgacaatgactgccgcggcgaacggtggcccagacgacgatagtcgcggcggatggtggcccaaacgccggcggcacgctcgtggccggcgtgtcctccggttcggccccggccgatgcgctcaagttgctgccttgctggtgggtagacagaaagagaggaaggatcagactaggagtggtggtgggacctacctttggccagtggaggaggctggctacatttggtctgtcggaggagcaatttggtcatccgaatgaagaatctgttggagctcattttttctctgtgttggtcaaatttctgttggagatgctcttattttgtctaaaaataaatggagtaacaacttagacataatcaattattacgaatatcggtatggttcgtagtatcaagttatatctaatttagttgtagattattttaacacagaaaggtaatggttgcggttattggtcgatcggcggggcacaccgccacagtcaggttgaagcagctcgatccatgcgtggcggcgagatgctgccgaccgaaacgttagggtctgtctaagaagggcgacgaatcggtatggaagagactgatttgcataaatatcggagatttaaatgcataagttaggaccgctcccgcttgtaccgaattacccgatcctaggggttctatttgcgtacgattgatagcgattcgaattagggattcgtttgcacgaattcatattcatgtggtcctctgtatgggtaatcctactggaagccgtcggatcagcacgacagtcgacagcacctgtgagtcctgtgacccttcggcggcggtggaagaatcatcaatcatccgcgaggatccctggggcggagctcgatcaacccgactctccgcccatatggtctcatgcattcatggtgccgcacggccgcgcgtgaatgaatgtaggggacaccgggacagcggccaacagctgcctcccggtcactaatcatcgtttgttcagatttgaaatcaagtctattgttaatttcgaagtgctgggagttcacagttcagtcgggaagacaggacctctcgtgagcaaactagcaaattgaggtgtaatctactaatcttgtattagttatgtactacttgctcctttccaaaatgtaagtcattctaatatttttcatattcatattaatattaatgaatctaaatagatatatatgtctagattcattaacattaatatgaatgtgggaaatgctagaatgacttacattgtgaaacggatggagtaccttcctcttaaaaatagttatttttctagtatttaaaatgagaaaaatggacatttggccacgttcaaaaaacggtttcgttggaatgccattcccaaaactcgttt

SEQ ID NO: 61231 - DNA, 1106 bp, Oryza sativa
atctatctatcatcactaattcctacatgtgatgtattgctaaaagcatgtattttttttctttttattcttgttttgtgctactgctaacacaattgtccatgaaccacacctgtattttttttccgtcctccgccactgtccatgttcaaaacaatggttcaaaatattgactgaaaacgagcacttctgatttcatggcttcaaacatgcggacaatctcaataatgaactttgtctcaccctctcatgggttggatcataactctttaataaagacacattcacataagatgtttatttctccaacagttttgcatgtgtgatgaggactgatgggtgtatagatcttgtgttctacatcaagagtccccattgctacaatgttctttatagtgttatagtgtgatgatttccttttgatgaggaagaggatttagaatcacaactgattctctcaatctgagaagagacttctaaagggtgtcaccgttatggatatgcacaataggatcaagtattttccggattccatctatatcctctgtgatgttatttagtgttaaagaacaaaatttcttaccttcacccaagtgaagaagcatatcttgcttggcatcaaactaaggttttgtgcttgattggttgtttcttgaagcaaagcatcttttcttcaaacttttagaagtgagatctcttgcaaaatttggtctaattagatagaggatattataaaagctctagaaagttattttgaaatggagcctcaaactatgtttccctacatgagaaaaggtaaagaaatcggtacaataagaaaataaacaagtaaaataatattggggatcaaaatagtgtccatgacactttaaaaaaaaagcgtatacggcgcaaaatgatagacaagagaatctctactattctaaaaattgaagatatttttgccagtactttggtatgtcattcgtgtatgagtcgtttttaagttcattcgcttttgcaaataaaactccgtattcgagtcgggctttaagttcgttcgcttttggaaatgcaaaaggagtcgtataagaaatctttttaaaaaagactcgcatgctaacttg

SEQ ID NO: 61232 - DNA, 1034 bp, Oryza sativa
atgttgttgtttcactctatccttgtcttagtttctctctctctctctcataaaatgtgtcctgttgaaaatgtttaactgagtttttgtttatttgccttgtacaactgtacttgtcttgtagagcatcatacctggtattcttcaaggagacaagtccgattcccttctgtatggttccgttgataatggcaagaaaatatcttggaatgagtcattccattcaaaggttggccaatatgttccttttagcatgcaaaatattctctgtacaggagtaatgaattttcttcagtatatgggctctcaaaacttatgttctttagttgatggtggtgttatcttgttgctagacgtcgtacagttcacaactaacgagaatttgcaagttaatataaactggttgttatgttaattaagatgatgttgcttaataatgatcatgatgggtgcctgtttgatatattttgataataagtggtgatgctaaaactgcatgttgtaccaagtatggtgactaaagaactattcttgatatttgaattcttcgatacttatatacttttacttttgtttccctgtcaagtttttcacaagcttatcatgtggcttgttagatgaaaatttaatggtttgcctgacttgtgcacaatttgattttctatcaaacggtaatgcaatttttgatgttagccttacttagtggcacttaatttccactgaagatcattatggaaattggaatagcaagtcaagaaagattttttttttgtagccatacttgattcttggtggtagtgattaaccactctgatcatgttatacagcagtggatgtactctgtgccttgtggtattcaaagactatccttatttcttgatgatatctattattttaggtggttgaggctgcaaagcgactccatgtgaaggagcatgtggttttggatggttctggtaatcctgtaaaattagctgctacggttgaatgcaagggaattgttggaagtgatgacaggtcaaaatctatatcta

SEQ ID NO: 61233 - DNA, 1885 bp, Oryza sativa
agaaagttgcagatgctcctggagaatctaatgggcaattggtaagtacttctgatgctacggttggtgcagaaatttattatggaatactttgtgtttgttcaaaagcattcattcctaaattagtgttacagtcaagtcaaactggatatgctattttcctttataacctaaaacacattgccacgtttttatttctcactttcatatcttcccttattcagttgcatggtaatgatttgtttgtctaaactctaaagttctaacttatccaatatcatgaagcaaaatgattttcccatttttatttaacagtttatgggtgttcaatttcccttgtggtactcatatgcctaaaattctttaaaaaaaatgtggttattcttgtttcaaatatgcaaactggaaacttagtccacctatttcaggctacaactgcggaaggacctgccaaatctgatgaaaactctgttcctagacctgataagtttgatgaagactctggtcctagacctggcacatctgatgacagctctgctactaaaccagctgaacataacgagtcaactgcagaaatcctttttaatccaaatgtgtttacagagtacaaacttgctggtagtccagaagttagtcttagaactactccctgcttgatatccctgctctaatttattgacagcctactctttgctttcttaggagattgcagcagatgaagcattggttaaaaaggttggttcgtatcttctagacacggtgataccaaagtttgttcaggatctctgctccctagatgtctcccccatggatgggcagactttgactgatgtgctgcatagcaatgggataaatgttaggtatcttggcaaagtgagtctctgaactgatccagctggatgtgagttcattgcattttatgtatagtatgttcattatctaattcttttctcaggtagttgacatgatcaagcatttgccacatttacggggtttgttgttttttgagataattgttaggtcggcaaagcatgtggtcaaggtgatagatctatcttaccagctgtctgttcccatgatggaaattctccgcatttatttctttaataatttctaaaggatgagtcatactgtcacccagactcatcctgctgtccattcaaacaaatgttatatggataagattattcatcaaaatgcataactttcctgttttaccacgtttaataagaagtcattggaaaaactatgccaatttgttgaccgtactgtttgttgttcccatcccaggaaatacttaggcaaagcgcagatcatgatattggaccagccattgctcatttcttaaattgttttattggcaatgttttggcaccttccacaaaaggtagtgttgacagtacggatacaaaaacccaaaaggtatgctattccacgtgtaagaaactcatgtcatcacttgtattctaactgcaactaatggctattcttttggattttcaaattggtagggtcatgagaagactcaaaatcaaaaatctgccgagggacagaaatcaagcctttctgcttcttcaaagaacattgtgccaacattttcccatctaacatctgatgggatttggtctaacattaaggagtttgcgaaacataaatatctggtagtggctattgcttcttttgtttccgtagttttctatagatgccatcaatataacactccttttatttagtttgaagtgaccgatgatgctaagactggtgctaaaagagttgcagtactccgcaatctttgccaaaaggtttgctttgttcagctctatattcattgagtttgctattctctttcagagaaatgtttaatagtttggctgcaagtagttcc

SEQ ID NO: 61234 - DNA, 780 bp, Oryza sativa
agccatctcttagctcgattcaagtctaacctatgacgagttaactggctacaagcttaaaaaacttgcaagctgcaagtcttttttctgcaccagtttttgacagaaagttaactggcacttagctcttggtaggattgcagactcaacaacagcaggagaatagcaaccttgcatatgctttcccatcttagttggctcatcagtcaggtcttaatagctgacaaaacccctcaaacaacacagccgaatctaacgtggcccgggcaaaatgtttaaagaatatactttggatcaacaggattctgaaactgttaactcggttcttcattcatcgtcacaaaggccaccaaaagcctgacaacaaaaaatggatgagatcaacagcatttatataaccaagataaagttacagttcaacaaacatataagacttcgacagacagaagtcctacctgaaccaggaaactgttgggttccattatcataaaatgagtatatattttggactggtaaatggcaaggatattgaccacttgcactcacaaggagaagcatgtacatactgaatgggcaacatctggaagaaattgatcacagtgcagggtaaaaacttgatgactgaaaccatgaaatgtcatatcctgtaaatgtattgtatctgaaactcatcatcttacattaggcttcgaaagaaacacggattgaactaaaattacaacaccaagtgtacaattacaagatgagaaaatacaccccatgaatgcactgttcaatagc

SEQ ID NO: 61235 - DNA, 1416 bp, Oryza sativa
ggcgttcgccgccgaggccccggttcctgcgcccaccaagcgccgcttccgggggcgtcgcgccggccatcggcgcggcgctcggcgccaccgtggtctcgttcttcgcctactaccctgagtgagcccaacccgaggaggaaaaaaggaagaggaggagatggatgcatggccatggctactaaaccgatccaaacacgcgcgataatgtgggtgctttgatttgtgccaactttgatgcctcgtcttctttcttctctttttataatgggttgtatttttgatgcaccggtttgatttcggtgctttgatttctcatatttcgtccaccctatttgaagggaatggatattgtactattattcaccatttgtttggattaaattaagatattggaattactggctacgcattttcgtttgatttcaccatcattcggttacacacgttctgacgttcatcttctaggagacgcgcatcaatcatgactggcatgttaatttggcaatggcattgccgtattggcattcgtattattgcctgtatctgaataaaatcgagttcatttcgtacttcagtaattggattactgaaaggtatatataactgctaaatttcttttcagtttttccataacgcagtagattaattattgccataacactcagaaacaaacaattaagcaggaccaaatggaacagcctggaagggaatgattttcagaaggccagtgacatcaaattgcgctgtaatcatgccaatataaatcattctagttccttcgaacagaatgtaattttagtccgctttgcagttggcaaaagacttacaaattccgttaaaacatacataagggatatgtggtggcttaatatcacccgagacaactaaattccacaagtatgttcctcctctttttttttttttttgtcgaactgacagatcaaaataggccccagttcattagatcaagaaaatcacaaaaatcttactaagcattattgctagctctcctgaaacaatgcctaagtaaataaaactctgaacaaaagttgtaaagggggcacacgatctgcacaagtacagaactgagcggccaaaaataagcattggcaattcagattcaactactccagcagcggaaaggaaataaaacacaggatactctgttgccaaagacaaggagaaacatctcactacaacattgacatcagaccatcagtccactttgccattggcttatttgcacgcaccagaaagaatgaaactaatcggaaaaaaaaaaggttccgacaaagtctctgcgatgctgtatcccttagtggccaaaaaaaaaacttgctttcgagtcatgttacttagtgagagtgtagagcatgtgattcagaatgaccaccacaattgattcataagtca

SEQ ID NO: 61236 - DNA, 1111 bp, Oryza sativa
  unsure (1)..(1111): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggtttgctcgttcttgccatctctcatattgtgcttgagcttgtttttgcctgatctacttgcatgcttaattaatatagttggtgaccttatatcttgcttagatatcttatttgtcaccttttgattcatatacattttgtttattcgtgctacaagtccatagctagtgttttattccgttatccgctgaacctttcggttgagatcggaactttcaatcccataccaaaagttccgatttgaaccgaaagttctcatctatctaatatgctatgaagttgtggtaattttttaggaacgcctattcaacccctcccccaccccctctaggcgacatcaaggtcctttcaaatcatgatcattgatgatgcgtttagttggagggatatgatgggttggattataaagaactcgtttttcatagtgtttggcttggaacaagtggaatgatccgttaaaggaattccctctagatctggttagctccatccctcaaaagtggatcaatctaatccacttcctcttgacatgtgggccacatcctctgaaactaaaaaaaaaagatcattaacacataaatgaaaccatcccatcctaaaaaaaactaggatggacctaacacatcccacttgatccccaaaccgaacacatgctaacaaaatatgatttttgttacatggcactcaaaataaattggactctctattatttaatgctgatagtgttcagcagcaaatgtaactatcttgttccagccctttaggtatgggataccgtccctcatcatccctttttttgaagtgacaaaattagctactccctccgtttcgcaatgtaagtcattgtggaatttcccgtattcatatgtttagatttattactatcaatataaatgtgaaaaa

SEQ ID NO: 61237 - DNA, 2864 bp, Oryza sativa
ttattctgacacagtccaatgctggataatggtcctacaatccaaaaagcatgaagaaataggcaataccaaatcatggacattctttttctgccaactaagctaggcagtaccgaaatacgattccagcaaaaacgacataattttatgaacgaacgaacttgactcagcttttttgtgtgaaggcagaatgcttagtcattttatctcatcatcagtagtctatcaatgtcacaacaattgtttcacttcattctcgtttgttattattgaactcatcctaagaaccccttcaaaaaaaacaaacaaaattactcttccaccatgctggcgtgacaattctatgtgggtaaaaaactcaaagcaccctagaattcaaaaattgttggaaataaacctaccactgatgttactttctatgacttctgctttgatttctgcttcttcaactccaaggaagtccctaatcctactggtgtggaaccaccggactttttagacgatggcccgttggtattccctgcagtgccgttttgtgggggtccattcgattgctgaccttcagatgcattttgagtgctggcagtagcggaagtagcagcggcagtggctggagtgctaccagaagcagtaggcgccttcgccgagcccagatagttgagaatttgagatagattagacatgtaatcaggcgcctgcccgcttcgcacattaaggcctctggcagcagctttcttccgaacttctgcagttgcccgagcagcccgctcatcaactcctcttactcgaggaacaccttcaccaactactgcagcattaagtgatcggttgacatttgctgatccttcaccaggttgtttcgcagctgccttcagtgctctcaccaaatcaggatttgcctgtcaaatcataaggtaaaaactggatgtcaaaagaaccaaatacaaaatactgagatgtctaatagccatatacatatacttcgttaacagtgacaaggagaaacccaaaaaaaagtggcaatgtaccatcaccttcaaacgaccaagcgtgccagggattaatccatgtacagaatagcaaacaaacaatatagggacaaatattggggcaaaaagcttccataactaaaacaagagaatgtcaattcaatcatactgccagtcaattcaatcaacatcatctgatgcaacactaatgttgccagattctcaaaaggaggttttcactctgtacttcctatgacaagctaaaaaggaactacgagtctacggctatctattctcctggaattgtagggttgtatcaaaggcaaaacggtaaagacttcaagattgcagcaactaaacttaccttcaacaactcaataggattagcaggtgggttagtaccctgctgacctttttgcttctgggcattcacctgtacagcaaaatgagagttacgtcttctatggacaatgcaaaaccggatccagcatgaagataaaggtatgcaaagcagaatggaagattttcttacacaaaggttttgcattgcattacttggtacttcctccgtttcacaatgtaagtcattttagcatttcccacattcatatttcattaacatcagtataaatgtgggaaatgctagaatgacttacattgtgaaacggagggagtatattagatgtacaagagatacaggaccaaataaaaaatagccgtatacattttcttaagaaaatacaaaactacaatactatgccatacataaaacatgttgcatgcttgttaaaagtatcacaaatccaaatacagtttaaacttatacctgctgttctcgcgacttaaatgtatttaaccaactttctgcatccttagtccttgaatcatcactccccaattgtttcaccagtatatcataggtcttcttttcatgctgccatcagaatcaatacatgagatcaatgttttcaaagtattctttttaccaatcatctttctggtgaactgacctgaattgaaagtttgaatgcacccatacaactgaatgcaatggcaagggcatgatagcagatagctgtttgaatatgatctggtcctagaagcctctcgttctttgtgagtgcttcctgaagatacctaagagcagtactcatattcccagcatcctggtacatcattgcaacatttataagagtcgctgcaacatctggatgattaggacctgatgctaaacttagcaaaagcaacgtgcgagacatgtgacgcagagcaagttcagtttgattaagcccatgatagaacaaagccatgttaccgtagctgaaaaagaaaataacacacaaggttagttaatataaaagatattaactgcacaaattgaaagaaagaaaatgatgttgtaaattaatatcacatatgacaaagatacattcattctctagttggtttaaagatttctagtagatgttgggatctaggatgggcggtcagttttgtatcaataacgtgaaatttagcttcacaacaaggacaagatcaaaattctatagaaaaattgaaattgaacaacatgcctgtgggctgtatcaggatgatctagaccaaggcatcgctcatttatgataagttctctatgttgctgcacaattgctcctggtatatcgccagcatggtacaaaaccatagcaaggtaccttcagtcaaagggaaaacaaattaaaatccaaagattttattatggatgacttatgtacataaaaacaaaaagagaaatctagaaaatgccagatgcctaaacaaataagctaatgtgttaccggcaacagtttgcggcatccttatgcatgggaccagtaatctgttaaaggtcataaa

SEQ ID NO: 61238 - DNA, 2034 bp, Oryza sativa
ttgaacaccaagggacaagtctcactggttgctgtacatatgtatacttcgatggggtggctttgtgctcatacagactgtggagtgcattgtagtgtgatggagcttacatagagtataatttttggccggtgaatagtcttgctgtttcagcgatacttagttcgaacactgttgattgtgttgggaggagaataacagtttcatgtttgatttcaagtatgaaattcattgccatggattgcaaagcccatatctttcaaacacctggtttggaagttcaacgatactacgtatatactttatttgcacgattactaataccaatttggcacattcaataaaaacaacctatcttcattcaaatattccatttggaagttcttttcttcccaaatgcactggagaaatggggcttcaatttcactaagaagaaaatttttacaaattacaaaagaagggattcctttgatcaaagaatccctcctactaagaacacattcccaaaacggatcacccacaggtgaagcccgtccaaacaccccgttcggaagttaaagagtaaatattttatttgcacaattgataccagtttagtacatttgaagagagacaatctatcttaacaagaggtttgaagcatggacatgtacgggctgtgcagggaacaacccaacagtttcagcatgtgagcctccagcaatgaagatacatatcagcctggactgttgttccgtttgctgatcatatgaattgtaaggttaacgagaaatctgcataacgtctagaatccattctttcctttcagattgattactgatagttcctgttcgacgtagtcgccagcacagattggtggataactatgagcatcggatgcttcagcaaagtggcccaatggcttaagggttgcatcagaagcaatgtgtgcaaacagctatttacataaataggcaaatgggtaagtcaatagttcaccagagcaagtaagattaaattgatggaagtgcctcatgaagtaaatcacatcgagaaggagtggttagcacttacggttgatgaaaccctccacaagcttctattttgctctcttgctaatgctattgcctctagtgttctcttggttaccactacctcatgcattccagctaaacactccccaccagtaagccattccagctgcagttaaagaacaaactatcctctcaacaaatgatgtgaaccaatgaagccgatggtagcagaaaaggatgtgagcaaattcaagcaaaaaatcaataccagcatctaacagacatttttttaagcttaagagtgatccttgttcacagcacgatagcatggagtatatatcccaaaaggttgacaaacatgtcaaaattccaagcgcttaagaaaatgcagtcttgaatcatcaacagtagataacaaaacgctaaagcaagacttccaaatttgctctcagcatagtgactggaatcatggaaatatgcactaagcgctaactgacagataacaatgaaaagtttactcctcatcctcaacaaccttggttcccaaacccttgagaccctctgcagggatctcagcaactgtgaccagagagtagagctcctccttggcgtcctcctcatcgtttctcttgcgagagattctaacacggactcgccttgggacactccggataccattggtccagatggccttgttaagcttcacgtcgatgcgtatatccgttgtgcccatggccttctgtgcaaacttcctgatctccttgatggcattcggcgccttcttcttgaaggtgctgtttatcagaaagaattatttcattatagggtttatttcaacaaatcaagacttttcaagattgcaaaacttgtaaacaagaatctgcatttatctaaaaggtcaaatgtaatatgaactgtgaagttggctgctttataaagaaaatatgtgcaacaacaattagttatgcagtgctaaaaagtatgaaccacaatagatgaatgaccagaattgattagcaga

SEQ ID NO: 61239 - DNA, 1357 bp, Oryza sativa
ttttgtaatttattttgttattagactacgtctaatacttcaaatgtgtgtaacaaaacttttcacatctagagtttcaaggccaagtttaatacttcaaatgtgtatccgtatatccgatgtgacacgccaaaacttttcaccttgaagttctagggcgtaagagcaattcagtaaacgcagcaactcctgtgcaacacaaccatccgaaattcagaattgtgacgcttagagagctggacccaaccaacagtccaacacagatatacatgcagctgcagcaccaattctcgtaggtgttattttgcaacagaggccgatgcactgaggtctacaagaatttgcagcagaggctgctcgtaggctagtagctgatgccattgggggagtacaaaaatatcagcattcataaacttcactgtttttcatcagcatttctgcagaatatgtttcggttctcaggacttcaggagtattgaaacaggttgtgctgaaaactatatacattaaaactttcaaacaaaacaaacaccagcaattttcactggattctttttgtttataaacaacaaaataattaattcttcatagatttaatgacaaacaatcatggaactaccaaacaacactggaatacagaagaaaaacaatactggaaaacagtttagatctcatatcacagttcaaacaacacataatacagtcaaatatggtgataactgatgagcaacaacacagtaacaatgaagccaagaggaagaatggtgtcttgtgagagggcttatgcctgtaccagagtaaagaaaaatgctgaagaggaacaaatgaaagctagtaattctgaactagcagtggcccatcgcctcattattccatacaaaactatgtcgggaagatgttgaaataaacatttcaagcatgtctcaaatcaagcaaaatggaacaaaactctgaagaaagctggatccgtaggataagatgtagatacctatgagcacaagatggcagcaatcctaacacatgacatgggtttcaaactgtgaatccgaacttgtattgatctatatatttccaatgtgttccctctgaaaatgttataataactaataaactaaatgttaattccccagccaatcacttataaaactcaaacatccaggtaaagaagaaactttctcagaagccaataagatagaactaactcaggcagtacagcttatcaacctagatacagtaacttgctcaggacatcaacaaagaaggctgaaacaacagtacaattattgttatcaccaaacacgttagaggtacggttattagctcacctcatttcttaactcaatcagtctcaagtggt

SEQ ID NO: 61240 - DNA, 818 bp, Oryza sativa
aaaacacacgttcttgatgataagagcaagttcaatagtatagccaactactggctccaattcatctatagccaatctaatacatattcatacaatagttacatactacactatcaataactggtcccacctgtcatacacacattatgtattggagtccgtattacagctggctataaatctgtagcccgctacacttctctctcctcatttatcttcttaaaatatatttgtagctagcttatagcctgctattgtatctgctctaacagaggccagaatgttcgggcctgatccccacgaggccaatgtgtgtcaacatgctgtagctgaaagcctgaaatcaacaatgccttgcacgcgttgttgaccaacctggacgcgtgcgccgcttgtgcaacagtgcaagtcagtttcggactcaccgcgcgccatgcggttgttgactgttgtgaatgggggtagaaatcgcccgcgtagcagccgcgcgaagccacggcgagctagcgcgcgcggccgcggccgcggaacccgccgtgcgtgtgcgcttcgccggatggtagcgttcatgcgcgtgaaaccgctgaccttgggttccatcacccacgcgaccttggccggccgtacactggctgcgcacgcatcacttcccgtccgggattggaaaaagtacgcaccaaaggtccctcaacttgtcaacgagttataaaattgtgtcctaaccacaaaactagatatacgacatcccttaacttacaaaaccgtcaactttagatccttctatgggtttgatcccggttttatccgatatggtagct

SEQ ID NO: 61241 - DNA, 999 bp, Oryza sativa
taagagtagtcatttgacataattaggaaatatttgagagcaattgaaaacctttcttgaacttggcactgattttttgtagcagaccgactagggtgctgtcctccagagcctgtttgctaggccttggatccagaatacttccattgctagagttcacataaaatgatttggagtttcctgtgatacagtacttgtttccttctaaggtcataacatcaatataaatgagatctccatgcaatctgaagaaaggatcaacgactgtgaattccatggagaatcaaaatactaagcaatagccttatatttgaccaatctttctaaggtatccaaataaatgacacaagtgcggaatatgcggtcattagagttacctcctataacttggcggaggattaaatgaagaaaaaactatgctacccacgcatttgatctctgctggtacagatggcaacaaattaatgacagcaccagtactgtcctccatgaaattcaacccatcaagctcttgattagccgtttttcccagaatctcctaagtaaagaaaagacagaacatcaaaacttgcgtgtaaattagtaaactaatcagtgacatgcaaaaaattcctaataatatagaatgtcatcaataaactacacagcatagggcaaaaccaagggttgtacctgcagtatctgcagatttttcctgtgcagattcttgctgaagagcaagggatgtggaaagtgatacatgaagactagagagggatagcaattccctgacacgacggagatgtgacctaatagatctctcatcatatatcgctagaacaaaacccaaatcgttgcgtcaaattttaaaaggaacaactgaagagaatgatccaaaaaagataattttgaattgcataccagcaacaatctccaatgaacagccaccagcagttatatcagcaatctcagcaatttcattatagtcctcaagctcatgagttgagccatctttagtgt

SEQ ID NO: 61242 - DNA, 2873 bp, Oryza sativa
ccccctttgtaacaactttccagttgacaaccctcggttgtactgcactaagaagttcaaggaaaaaccgtccatttgataagctcttgtcctgagagaagataagaaaatttattaactggagttatctaacaacaaattaaaactaattaaacagaaattaataacaccttgaagctttccatttgagatgttcttcctgatgctttcactttgctgtttgcccattttagtatatcagcatcagtaatttcttttccttgggatccttgggagtgggatctcagtctattcaacaattgaagcatattaaatctcatcaattgccacagaagtgctgaaaaacaacagatatggcttcaattgtgtgctaaacagataacatcaatcagaaaccactaaaaagacttgattcagtcacactcaccaacaatcaatttcttgttaccctgaacaatatcattcccagctaaatttactaaggaaaactttaactcctttccgatttttaccacttgattgcaattctccaatttcctgaatggtagtttaattggaggtttcgaggccagcttccaattgacagatcctggagaaactttgtccagtacttcaagaagtacccatctgcatgagaaaggatgtaagtgcccaattcatttggagacagacacaaatgctcattcaaataatctcatacccatggcgaacatcttcaaaaacattgttcacgtaagagtcaaccccaagactgttgatccacatccgaaaggacctttcttctctcgataatagaacatcatcacgtgatgcagtctgattgagagtaacttgtctggtgtcactagttagaccattcctgtgcatcatggaacaatagcattcaagtgataagcagatgaccaattcatgggcagctagctaagaaacttttaaagtgaatatacttgcacatggggaaaataccttagctagctttatgataaaaaaaagaaaagttaatgcctttggagaaacaagaaacatactacttaccgatgctggaatatttgtgccacaaatgcaagattcaaattggcagaaccctcagtgatatccttaggagtcaagtatcttttgcaatccaacttctctgcttgttcaagtaccaatttagccctctcactaggatcctttgtctctaatgtggtttcaggggaatgctctggagcaagagcttttagaaggtaagcatatgcttcaccatcctgtacagaactaacgtatgtgaacattggagattgaagtaatattaattaaatgaatgtagtttgattcacttttcccacatacgcatttagaaaggggatttccagcataagagtgagtcataaataattttcaaagccatctgttgcttagtcaatcaacccaaatgcaaagatgttgcaagccaaacagtggattagcacaagggcagcttcttttatcaaactgcacataatcaattaattataatgtcactttgttctatgtcatatgcaccttcacatctgtagagaaattgctgacggttttcttgaagccagcttttttcagatgatggttcatccaccgaagtagcatcttttctggtgacaagctcaacacttcatctatatcctgcataataatcagtaaaatgaattttgttctaagaacatgtgaattaaattaatagaaggacagaatgtttatttaccttgctgtcatcaaacaattccaccagctggggtgtcttcttgagattcagatcagccaaaagttgaatctgatgataagtgcaaaaagatctttatatgatgaggcaggagtttaaccatagtatgtcaaacatcaaaatgcaaaactcagtgcaacatttacctttatgatttgagatatcaatccaagaattaaatgaggctgcaaaaaagaagcatgttaaccacaacttaacttttagtgaatttcttgaattaaatagaagaagtcacaaagggaaggcggctgaaaacatctgacacatggacaagcatatcaaagaataacacatacagcaaatgagcaaggaaatatgaggtggaaccaattagcaggttatacagcgaaggataaaatggtatgcagcaaattagtggtgacaatgactaattgacagcatactttgtacccaaactacctagcacctacagggcattaaagtatttcaatgtagtcctgaatgaaaattagtggtaaaaataatttgcatagactacaatgcaccatgaattactaaaaagaatttaaagtagggaatgcgttgcatacccttccctccaccaaatcttgtgtaccaatgtttacaactgtacatccaatggccttggcagagttgaggcacagggtgtgattttcattcctctcccatgggttaagaactcttttcttatttattgctctctcatcaatggtcccaggtacagctaaattgatcaatttactgagcaaatgatccataaatgagcaaatatcagctatgactcaagggcagtttctgttcaacgagtaaatggatatgcaccctttggttagctgtaaagaccatctctcaccatagcataacaccgtccctgacaagatcgaacagctggttgtcggtaggctcgattggtaaatacttcttcagaaacgggtcttcacgaaggtaggtgttgatgtgcgccacataagacgacttctccgcctggttgagattgtgcagcaatgtagtggtactggatttgaggaaagatgacgcggttttgccacccccgccaccaccacgtgcgcattttttggcgctcacccttgactgcagattcaggtattcctacaaacgcaccacacataat

SEQ ID NO: 61243 - DNA, 1720 bp, Oryza sativa
ttttaagtttcctcaagggttaaaaattagcacattctttgtttttttttcaaagaaaaagaaaaggaaaaggaaatagcacctgggctctactaggggctataatgaaagaaataacacagatatggagttttttttttaaaaaaaacattttattgtttgttttctttgggcttaccacatcttaaacgattggaaccaaggtctaacttatttggactttaaagggttgtgcaaaatagatgatacgtaatagaagacattgaatgctttacattggaagaggtttcgattgcgagactttaacaatatgagtgtccgttttacatattatcggtgtatttttcttttctcaaaattgaacaaaaatgcacataggtcgagttcctaaataggaggatttttttaaaaactttttacatatatagttatcattataagatgctatttcaaatccattctttttaatcttgtaataatagttaaattattgtttgtatgttccattacattgaactcaaaagaacacacctatctccctagaaagtaggagcaatggagcaccagctatatgaatacaaattaaagatccttttgtgaatacattatctaaaaatacaattaaagatcctccaacttttcctcgagaagaaactctctcgtgtaattttcttattcgagtcaaccagctttcgtgtgctcatgttctcaaaaagcaaccaagaaaaccaaaatttgtccggcacctgtttacccggagctcgagcggatcttgctgctcatgccgacaaatcttgttgcccttgccataatttttcgtggggtttttatcccctgccgaaagcgtcgtcgccacgggcctcttctttggcgtgttccgacgtgccactgttcacagccagaacaaaccaaacacctcttacctgtacaacacatacccccccccccccccccccaatcccgtgctcccgccgaacgtgaacccgtcacgcaaacacgcttgcgcgtaccttgggcacacgtactgcacacagggcgcatttatccgcaaagctatcgaaatattcaggtctccaggatgattcaatgcagaaaagagctcattctctaaaccgaagtactagtaatccagtattgaattaatcaggttgtgtttagattggcccaaagtttaaagtttggttgaaattggagacgatgtgactgaaaagttataaaaagttacgtgtgtatgaaaggtttgatgtgatgaaaagttagaagttttaaaaaaaactttgaaactaaacacatccgaagtatggcattttctggccgaacggttcgacaacgtgatgcatcgaatcgaagaccctgggaagcatcgacgagttcgtacggagccgagctgacaccggagctcctccactgtcctgcactgtcgttccagcttcctggttaatgccgttttccgaaagcgccagatcgccaggcttgcagcgcgccaacacacaataactcaacaaggacggctaaattccacgcacgttatttccatcggcatccaaagcgatagcacgacaaacacagcgcgccgcggggggaaagctggacgaatccttcgccagtgcgcacatcggttgcttgttatttggcgcggatccgatcgccggcgatgtgacggcgtacgggggaaaaaaaaaaggaaaacacggagttgagaccgatcacgcatgcccag

SEQ ID NO: 61244 - DNA, 2088 bp, Oryza sativa
acccactatttaagtcttggtctctggttgccacgaatattatatactcacagctatgtttttaatgggattttagtataggaattctcattggtttctgtctttgagtatgtattagggagtaaatttattgatttgtgtatgtaaagtaatgtctatggcctatgggtatatgtctttcgtgtaattgcagagagaagcacacaaaatgggaaatttgtaagggaagcgtcagatacagtcccagtgtttacaagaaatgcagctgcgttgctctgaactcaaacaggcagttcgatcgaaacaggaccctgacagagtgacagaagctcaaacacgcacactgacataacacatagcataacatcaacttgaactgacaaagcgtacgtctaacacggcgttaacacagcaaacaaccgggacagacagggcaacaatatacaaaagaaccctagggtgaatcaaaccaaaaaaaaaaatgagtggataagacgcaaacgagacgaaaaaaaaaatgtccacttctgctcccaacggtgacgacagtaacacacagcatgaatgccggccggccggcgcctcacccttctactcggcgaccaccaccggaaaaacggctcagctgatcattagctcaacgccggccactctcggcgtatgtcgaaggtgtagttgatctccaggtaacatttccggtcgtcgtcgaggaactgcaagaataaattaacaacacattgctgagcgactgaaccttgcaggtttcctgaagcagctgatatctgacaaagaaaattcgcgtcatgcgtaccttcgtcctggccgagtaggatcccctcgcaaacatgccggacggcgtggtctcctccggcgtcacgtacgtgtacggctccggctgggggctgaacgtgccgagcatctccttgtggctgtcaactgcacgccccaacgggaggaaccaaaaccatgagtgcgtttgcacaaattcaaacgcgctaaatccatcggattttataaaattttagtagtaattaattgttcatctattggagacctaattaaatgtttttcgtgtttgggtatacctttgatgccggtcttccagacggcattggtgtagcggaggccggagacgatgttgttgctgacggagaaggtgaacttgagcttgtagagggagccctccttgagggtgaaccagacgcccttggcgttgggctccaccggcagcggcaggaaaatgtccggccggccgggcgagaggatggccaggctcatgatcttcacgtcaggctccaacgtctctgcaccgataaaatcaagcgtgacaggttcagacttcagacctcattattgggtcagttctttttgggacattattgcatcctaatggccaggacgtgtaggccaaatgattggccgtagttttgagtttaaaattctaatggaagacaagcagatgccgaatgaatgatcatcctaaaaccgaccgtgaagcagctagccatcatcctcggattatttggttaaacaaccacaaccatatgaatcatggtttattcaacactagtctaaaaagcatagacaaaaagccaaggttcgctagaattatgcgatgcaaaaatgtgtctttttaggccactattcaaaatccatttgatcttaaaagcaccaacaccctagcatataaactaacaacagaaatgcactgttccccagtattaagatcagaaggcattgtcaatgtcatgatcagatgaaagcattagttcaagcttcaattaggagcccggaccagattcattatcagacaagccgaacatgcacggcaaagtacaggagttattaacaggaccatctaaccggtgcattgaaaacgccggacccgtccagccaagcccaacatatttcactttttcttttgctgttctaccgtattttctacgtacaaatcacaaatgtacggagtagaatgcaacacggagctcacgggggcggtgcatgcatggatgaatactatagacgatggatgaatctagtcgtggcccatagaacgggggctaagcacggacaggtacacaggtgcat

SEQ ID NO: 61245 - DNA, 4585 bp, Oryza sativa
aaatatgtatgcggagtgttccagggttttggcatggaaatactatgaactttggaatagtagtatggcagtcaatcatggtggtttttgcagcacgtggagtcccatatctatttggctccttccttgggtagccgtcaccccgctctcccccgagatgcagagttgcccaatgatgccgcgccggggcccgaaaccggtggagacgcaaacgcgggaggtggcggtggcggcccccggcagccgaagtcgccagcgatccatcatgatgtcgcgcccgcgaccgcgcgacagcatcacccagacacacaccccgtattccccgttccggctgccaccgctcgggggcacgtcccgcgccgcgccgcgcacgtccctgccactcactcccgttccgagagaccgccgtgcccaagtgccaacccaccgcgggcggggcatggtgattctcgccgtggttttcccaaccgtctacgcggcgcggtggcgtccgtggcgtgcggcctcttttccagtcacgagcggtaaaaagtggcgcggctttgccgaaaaggccccagccgcttggcttgcctgccgcccgctcagctcccgcgtcccgaccggagacgacacgagggcgggtcaaggcgaccagacgaatcggcgcctctgatgaatcgcgctatgctttcctctgcgctgattctacagtgaaacctgcatcgatgccacgtctccgtgccaaacctcgccgtgtcttcggcgtggtttagttcccaactttttcttcaaacttctaacttttttatcacatcgaaacttttctacacatataaacttctaacttttccatcacatcattctaattttaaccaaacttttaattttagcatgaactaaacacacccttctagctctagatgattatggtgcgcgctcattgcagcctgatgccactgctgggcatggcaaagcgaaatgaccgacgagatgcttattatacgttggatctgtcctcaggatcagcacatgactggtaaggttagtttggtgctaccgtggtggtggcccattaaccacgttttcaagaccagacagtgcttgctttaaaaatactcttagccactgaaaccattagcttagttttgacttctacacttgacgccctcggtttatttcccaggtttaggacttagccgacacaaaaacgtttggcaatatcgatctatcaaacaaggatacaattcagatgagtttataccaaaaatattctatttttgatgcaaaaatttggtttcgaagtactcctgatgcaacccaaccccgctctacatatataatggtagaccaaattcggttttacacttgtacatatatacataagcaactgtactgtgctgtttttctcaagtatgaatgtgaaatatgacagtatccaaatggagataaaaatgtttagaaatacagctctaattaaaaaacaaacagactggattttcactactcagaagataaggtaagaacaaacctatccagcgttgccaggctaggaacaccgtctatttagcaactaaactgagctgctctaagaggcaaagagaatcaagattgcaggaatttctgctaatatcaccagctgttgagagctctgctacaagcaggccaaaatagtattcagcttggaagagcagctgaacacctgttggtgtacagtactatcagttcatttgttttgcctcaacattggcaaaaccctgagcaatcagtacataattttgcttacatttcgcagcattgaggaactactgaagagaagacgatgagaaaaaaaaaatgaagtctactgaatactgaaaaattgtgtagatggactcacttgcattctagccctgcctccgctgctcgcctgggcttgtttttgcgccggcttccaatctgcctgaatccattagtcctagttgattcatcactgcttgatcgaacactggaattactctcttccaggacaagattggagctttttttcagctgcctgcctctcttgttaccagcagcagatgcagtggtgttcttgtctagccttgatgccttcagcttaacatcatcaccttctactttttcgccatcaattacattgtctacaaaattttccacatctacttgatcaatcttatcggagaagcgcttttgtggccttcccctcctctttcttgcaggcatagcttcttcagcgccgcttcctttgttttcatggctccggacaatcgttagcttttttcctgtgcctcttcctctacccatctatccaacttagcagtgacaagatttattcagacaatcactgaagctgcaggctctactgaagttgctctatgtttttctctagttgctatttggaaggaaagtactcaatatttcaccgagatacctcgcgatggcgacaatccaatcaagaagataggctagaaatctgcagtcgtaataccaagaacaacatgctgttacatctaactagttcatgatgaaatgggttcttggggtgcagaagcaataaagtttgaggtctattgagatccatatcaataaagaagttgcaaatccagatcaagcaacataaatatccagatgaaaactatacaaaacagcaagcaatacgcatctatcaagataagtttaacaaaaggattttttttttcgatagagaacaagaaacataaaacaaggaccgattcaatatcggaaccattctttccacggatgacaagcaagaaactcaccttccatatagctggcgtccactccaagcagcatcatgcatcccatttcttcatgtttggtagccaaaaaagatggaatttttcgcaggtgctacaggaaaagaaacgctgggtatccaatggatcggcggtaatattcggtttgcgatgccagaagtacccgcggatcgggaggtttcagcaaagattgggatgtggtgttcaggaagcaggagaggactcagggctctacaaatgaacaactagtgctctggggtctgggagttctggatggttgggctccaatagcttctggggtagcagcagcagctgcactggctggggtttgtgtgtgtgagagagagagagagatttggttcttctcatgaagcttttttaatactacctacgtttcaaaataagtgtagtcgtgaatatccatcttatttgaaaaatttatgaaaaaatttaaaaaattttgttacacataaagtactattcatattttatcatctaatagcaataaaaatactaatcataaatttttttcaaacaagacgaacggtgaatagtgcaaaactgcacttattatgggacgaagggagtactgctactcctgtactagtactactactgaggagtcatttgctgtttgtttatgcttttatttacagcttaccaaccgttgaaaaatactgagagagagtgtgtgttcttggcttcttgccattttccagattaaaaaagcaaagacagaaggatccctagccctagggaagcggtttacttttaccatgatgggatttttgtttccatgtttctggatgtttaaacacctaggacagccagtagtaactcaaccgggcaacacctgacaccctgacgtccaaggtcattttgctttcaaagcgatgccacagttcttgattggctccagcttccaggcgagcaatgctcctgtactgaacaggtgtttatttcagatagagatcaatattttgttcatggcctttacctaagaaaacttcgtgtttataattcatttgaacaggtcaacacagtttttgttcatctctactccgtactgtgcttcctagtgcaagtcatgcagatgccctcatacttctcaaacagtgctaagttaaaaagtttagcagtatagtatttcagagtaaagaatgatcaggtctcttctatttactgcaataccatgaagagacaaatcttagcacacttcagctgctgcagcaagtggctgtattaaattataccgtatcctgacacatgctatacttttttattgtattatctcttttactttgaatttgaattcatctttttatacagtttcttatcaaggtagccaaccaggaggttgtactgatcgctagtgcaatagcactactgtatctctgtattactgtactgtgtatcttgagatgattctctcaagcatttatacagaagacgtacatgttcctcttgctgtcaggtcatcattatataccttctcccaattaaccgtccttcaattctcaccgctaacttgcaaacgaggcatgcttgttttgacaagagcttgttgaacaaacggaatttatgaacgctgctagtactcatttgaacaaacggagtacattataaaagatatagtctatcaattatattattaaattatattattaagacagtttttaaaggagaaaccacgttcgctgtgggcaggggtggatccacagtctaacgtccggggtgatctgacaccgatgacatccagcgaaatgcgcggtgatgctcaaaattctaccagctgtgaccccggcataagatggtaaatgaccccagcc

SEQ ID NO: 61246 - DNA, 716 bp, Oryza sativa
tcttatttggcttagaccccggatctgaggagcctatcacacttctgccagatccattttgaccatttggcttctggtcctttgggagttgctcatagtcggagtcaacagcgaaactaaagaaaatattgttgtgtacatacctgaaatataataagagcataggtaagcatctctaaatgggaattaaaacatcattaaaaaacagttaagccagatgactcaaaccaaacctgatgagcaagtgcaaaagagaagttcctaacagtcacatgcaacacacacccttccgagagagaaatttcacataacactagtccaaaattccatacaaaaaccaaacaacactcacagacataagaattgtttcgctaacagttcagatagtattatatttgagcttactcacatatgaaaacattccggatcagttggatttattgggggtatacacctattaatgacaccaactgcccctttaactgcagcatcaacgaaatcacatgtcaccttataaagtgctctgccacgcaatatcctacaatagccagaaatatttattgtagatgatataaataggcaatccaagaatgcaaaggtaggtaacaacctttcttgaggattgctatgaggaaactcctggcaagactgtaattcttcattccagtctctttgcatgccaatcaattcggttccatatgacagcacaacagaat

SEQ ID NO: 61247 - DNA, 2174 bp, Oryza sativa
tcaaggacgagttaacaagatgcaatgaatggcatgacggtaaaggtgtactacctcctcggtgcggctaatggcgaagccgagcttggtgtcgccggcctcgagggtgatctccactggcatctcaccggcggcggcggtgtaccagacgcgcaccggcttcaccacgccgatgtccacgccgtggtagtcctcgaacccgtaaaggctggcgttggcaaggttcgggaggtcggccagtgaccccgagttgaccgtcgcggaggccgtctcgccggagatctgcccaacatgcaagatatgcatgtcacgcacaacacctactagctactaaaacatttactctaggcaagtttgatcgctgttgaggaaccttggtgaggagggcctcggtctggacgttgaggaaggagatgggcacaccggacgactgcgaggagaggatccaggcgttggcgcgggcgagggtgtcctcgacggagttgtagcgggaggcggcgcggtcgagcgccgtggggaggacgagcatggagaggaagctgctggagttagggatcgggagcgcctccctcatcttcttctcccacgggtaggccacgtagccgtcctgcagctgcgccttgctcagggcacacaccaccctcgaactcctcgaccctggacgtcaccgtaaaaaaacagaaaaaagaaaaatgccgatcaattctcaggttcagatcagaaactcaaaaagaaaaaaagaagatgctgcattctatgcagttctgcatgatctttgctcactgttttacgagcggcaataagaaatttgaagaagaaaaaaactctatggaagatgactgaggaagtaaagtcaaccagggaatctgaatcgcattggaatttagcgacaagttttttccgagtcaggggagggaagattcaattatcatcaccgccaagtggcgttctgtataaagaaatcaaaatgcagattccaaacaacgtgcaccgccgtgtctgttgcctggaagtatgcaacttgagcttagactacagcaacttggtgtttttcttatctgaaactgacgtgtttgttttacttgtggaagcagaacacccatcaaatgcaaactacccaggtttttaactcgcttaataaatatcttatcttatgatttttttttctccgagctatcttatgattttgttattgctgtagttgcgtggtttgcagtaccagtaatctgccataggctactgtggattcttccatgatagctcaaaagtgttcaaccgtgactttcgcagcttgcacacggaagaagcaattaggatcgttaaatagagtagtgttctagtaaagcctttgttcaacaaacaatcaaacaaacattgtagccatgaataacctaatggaattcgttcaaaaaacctggactaatggatggccatattattaatttgtgcaagccaagctactctagaaacttcaaatttcccagacaaaccagctgccctccaccccccaacaccaacaacaatgttatcaccagctcttgcaatcctgactctgtcatacatcaaacctaggatattctgatcatatccccagactgagcaatcacaccatgtattgcaaccacaagatggcaaatttctgattatcaatcagcattgatccaagtatatgccaatcgaaaacgataccgtgatcgatcacgccaaaaagatctcctctcgcgagagagagaacgataaagaaggtgtcacctatcaagctaccaccatctacttgttaacttgtgcacaaaagtcgtatgcagaaggcacacgagccctatcctccttctttgtctgtttttaattaaagtccaacatggcatgtaacgaaagctcagtcgcggacttttacttttcttggttggtctagagcttgcacaaaccgaaggaaagtggctgtacggacggacatggatcaaaaaattcagcgaaaaaaaaaatctaattctccgtagtagtttgcatcgtgatgaggaggaacgacatggcgtatgaacgtacctcgaatggcgatgcactcgctctccatgcggtcgacgaagccgacggcgtagtttgggtcacggatcgagcggagcacgtactggcggctgcggcccacgacgggcattatcgcgccgccgcccccgaca

SEQ ID NO: 61248 - DNA, 982 bp, Oryza sativa
ccgatgaaaacagtttattcggtaaactaaatatatatgctcatatttataactttaatttagtgataagtgtaatcttttaaaaatacttacaagaataaggtgtgtattcactattccgcgccttgagagcgcatgcatttataacatgtttatcaacaaaaacacaaaccgaatcttcagcagctagccgagctaattagtgaatacaatagtaccaccctattacatgataatagagataccctttcatgttcatggcatctgatatgttcatggtttgtatagtatatcccagcagctctaggaaaagtttctgttctccattgccaaccatcttctattgacttgtatattccagtttagacttgggcgatgcactttgtgttcagagattcccattcgtcaagtcctcactatcatggctgacgttctcattgggatatcgcagtattgaatctaatcttcttctcagaacagttcagaatcaaaatggttcatttacaggtccacgtggattcgttgacgtcactgccgaacagacgaaaagaaaatggttgtagcgtgctgtcatgcagtaacgtcgtctgggggcgaataggaatatacaattattaacctctctaatctgtaatcagtgagtagtgatatgaatatatggtttagggaaacggaaatcagtttgatgtcatgaaaatgaaacatgcagatagttgtaaatttgtccagtgaccacttcgtacaagctagaaaacatatccagaaacgatgtaaattgccgttcaagtttcgcatatcgatccattcactattgaccaataataatgctccgttgaacgaactaaaagtgcaccacagttgcatcaagcagaggttaagagaaatgctgctaattattgtggaggaccatgtattaattagtcttcggtattttgttgtattggagtaggtgtatgtctcgtataatcctaactttatgggt

SEQ ID NO: 61249 - DNA, 740 bp, Oryza sativa
agctaacaccaaaacgatcgaaaagtgaactaatagctagctaggaaatgataatatgtagtagtagcagtagtagactagtagtagtaatgtaggtaggaaatcagatgcctggcctgcccttgtatgccgcggaatggatacgttttaggccggtttaatccctcgaccgccgccgcattgccgtgtcaggtgtcaccaccaccaccagcagctgctgctcatcatctccgttctgcgagatggatcggagtaggaaggcggccatggcgaaggctaggagctcctcgatgaagcgtcggtttgcatggagaagaagaaaggaggagatgtgtggtggtgttagagagagagagagagagagagagatagagggagggagctgtgggcgatggtgtccaggcaccggcagcaaggcagctgcgtcgtcttaagaaagagcagaaatggcatggagccctccaaagcatctgatggctggccctgtatgcgtatttatttatgtaggggctaaaggcatcttttcgcaagacgtacactgcacactgctctcattttttgcaagacgtacgctgcacactgctcttatttgagagagagataagagatagagagagcagcaacagcagcagcaattttttctttaaaaaaaataatcgaaaacgcagcaaatacaaccactccctcagttctcagatgcataaggttcacaaaaccgtttgctgaccgaaaatcgctca

SEQ ID NO: 61250 - DNA, 1740 bp, Oryza sativa
gtatcagttttactaaaggggtagtactcagacatctcacgaactgttaactttgtttttacctctgcatatcaatcaatggttatctacgaagccagcatgtaatgatcgtatttgtaatagtcttgtctttatttcaccaatcaattagtaattttatagttcagtatattggctagaaagactcatgtctgttaatctggaaatgcccaattggcaggaaggagcatcccttctgcgctcatagctggttcttgcctggcttttacatctgctgcgctggacgttggcggcaacactaccagagtggacaatggcaaagagtactatccctacacagtcgagaataagcccgctcattgactgaagttctgtacgtgtagcccaagtcctgcaaaaccgtcagctcggtgaattttgaagctgatgcttactttcatgtctgttttgttgatgtactagctcctttgcaaatccttggcattgttgtgctcgagagagacctatacaacagtctcggaataaatatttttgcttgctttatcgtgatcatcgatcacaataaacgccttcacgatgcttgaaacatctggttttgcttgctttctcatgatcataaatcacaataattatttcctagcctcgaacatcatgtgatactgaaattttcatactgggatactggtcctcccgtttgaaatcagaaaatctagagtgcggtgcactttgggccaccttttagtttcacattggaccacccttaattcaatcttttcactttagattatctaactttagtttgttacactttgaaccatgccgactcttttctctagacatgtctatcctaggtggaggatttcattagcgtgccacagtcaacatcctggaggtcgttgatgtgttaaagtggaggtttgggggtgatctaaagtgaaataaacataaacttagctagtccaaagtgaaaagattgagggccagtttggtttgtgaccaatgttggccttaccaaaatttggcatgacaggtaaggccaacatgtgtttggattgaagccaaattaactaatttggctattgaaatggcctatgttatataggcatgccaaaatttggcttcaatccaaacatacacaattattggtgaggttgccaaaaaattagcaagcctaatttaggcctcaaaccaaactggccctgaactagctcgtttgggaagcttctcatagctacagcttctcccagaatcaaaagcttctcaaatagtttagtttttcgtctagattctgataagctatagttgcataatttaaaaaattgaactataagctagaaactagaaaaccagaagctagaaactagaaaacctagttttttagattctcggaagctagctacttcctccgtttcacaatgtgagtcattctagcatttttcatattcatattgatgttaatgaatctagatagatatatatgtctagattcattaacatcaatatgaatatgagaaatgctacaaatgacttacattatgaaacggagggaataccaactagttgctttttgtaatcctaagctatccaaacatgccctagaaatggtcaaaagtgaaaaaaaaagagggcccaaagtgaaattcacccgaaaatcttaagaaagtgggacatatagacaggataaattatgcaacgaagtgatacgttcttcttccccgtgttgctcgcaggcatacctcc

SEQ ID NO: 61251 - DNA, 2109 bp, Oryza sativa
gcgtgccactgtggcactgtcactgtgcgagagcgatcactcccccagcctcgctgctgcctgcaagagcatttttctcaccggtactacgcgtcctacacatacatgcacaatatattctactagtacttgggctgtttgatagtttgatactacgggggatgggagtcctaccaaaaccaaaaaaacttagcgcacgatccgcacatgcagtcgtcgctgtctgattttcccataaattggggtcggattattagtacttgcgcagacagggcagggaccagcctcatttgcctcgctttttctgcaatctgcattgccattggcattgccttgcattgcggttgggctgttgcccagtcctcctcgagtcaagccagcccaccaccgcatgcagacggtgcagcagcattaggagatgaccacacgggcttactagacgagcacaacctacgagttgcagtttgccggctgacgcgtggggcccggcccatttgtttggcgtgccacgccacagtgctgcctcccttctgactagtactgtggtgactactgatggatgatgtggtgagtaggagagtaatatactgtacctaaggagtgctcctccgtaaaaagttctagttataaatttggatatgtggctgtgtgttcaaatttatagctacagttcatcttttttagggtagagtagtactccgtaagagtagaggtggcaatgggtcggatcagacaatagacggaacattaacacgtccggcctaagacttgatatcccttgtctaggggtgaaaacggtttgagtatttttttatatccagacacatttgttttaaagtggttcggaaaattttctatatataagacgcatttgtgtttagattagttctatatatgttgagtatatataagtacatgttgagattagagaccaaatgaaataggaatgcgtcaaaatcagcaatagacacatatatcaggtctgacatgggttactcactggcataatataaaacccatatgcgctcaaaagaattttggatatcggatcaaacatgtccacgggtaacaaaataaacctacgctcatcgggtgggatacccgtgggtatcggactagaattgccatccctacccagtaaattgctaccactagttccttaattttggatgcgcggacacatgctggcctaaaacaatgcaactatgcaaggctagagcttagagtttagcaccctgcccatgttctttagcttttcaaaagctccccattggtgctcgagtttgtgctctccttgttttttccccttcaaaacggattcacgaacgctcatggttcagagttcagactagcagtaggcacaggactgtacattggatgatgccttttgagtagttgaggctgaaagcggagatggtacccaatggcggccgataccagtgatcgcggtaagggttgtcgtcgtcgtcgtcgtcgcgggcgctccgctgctcgcacgcccgcctgtcgttttgctcgcgtgcgtgcgtgcgtgcttgcctcgatcgatcggtcggtcggtcggtttgtcgcctcggcacgcaggcgcagccgcgcgcagcgaccgcgtcgtgcgttcccttgtttgggatctcgccaaccacccgcatcacaacgcggctcgcatcacgcccgagacacgcacacacgggcgagagacgccgcgcttgccgggttggttgcctggtttgactccgtttttttttcttttttttggtttgatcggcagcacagcgcctcccggcctcaaaattactgtagtaccacgagatcgatctcgacccgtctcgtcgtcgtcggctaaaagtaaaaattctggatccatccatgccaaacaagtaaaaatctggatccatgcgaaacaagtagtcgaggttgaatcggatggatgtgctcagacagaggcattgccagattggctgcttgcctgctgcaaggtactcaacagtggcaggatggcagggagctacgctacgcatggtccaggtggtctggtcgcgaataggaatggtggaatgcgattatggctgtgtttagttcactgtgaagttggaagtttggttgaaaatt

SEQ ID NO: 61252 - DNA, 838 bp, Oryza sativa
gaggtagaacatgctctacatttaatttctgttttttgttgttttattatatacaagcggccgtgtaatttcataggttgttgctgagatggctgcagttggatttggattgccaaaggatgcatttacctttttgatgaagaaagtaatgctgtaacaatctgtaatatcctgctgtaatttgttaatctactcaggatgcaagtaaacagtaccaggtcccagcattatgttttacttagctaaaaatatttctgttggttcacagaaattgagttgtttttttttttgtaattatgtaatgaacgctgcattttaatgcattattcagatccattctgcattcatcctgttgacattggtcgattatttgtgtgtttttcatagggaccacacctcctagcaccaactggaagtgaccttgagcggcatggttctgagggcactgtttttgctgggttccattatgatctcaatttcctgaccatacatggtcgaagtagatttccaggcctgaacatctggctaaggaacggcaaaaagatggaagttaaggtccctgttggctgtcttctaattcaatcagggaaacaggttagctttgcccgttttactgcaagtatcttaattagttcatattcgcgcatcaatagaaggtcatatgtatgcatattggtttctgttctgatctctaaattctggttttccatgaaattgatactgttgtcaatcatagaatcaaactttgtatttgtattttgagccttttctgaaacacaaacactaaaaaactgggagtgtaagctagtgaaagatggggcttatttttgacaacttg

SEQ ID NO: 61253 - DNA, 4584 bp, Oryza sativa
tagcgtagcccgactttttttgttgttcttggcaagttggcaacaccagtcatgccgaacaactgttttggcttgatgacgtggtttacctagttagtttaatcctgtttaggacttaagatgctcaaagtgctttcaccaggttaaattatcacgggcaccacctaaccaccaggttttgttgggttaaatttgcttatcaggtttttgacgaatttatataaaaagatgtcctgttcttgcaggtctattacatgttagacctgaacaaaaatgctgaactactgaacttctcaggctgcggtaaaaccatggttcctgtactcgtatactaatttatttgggactttactctatatcaataactgtttttactgcaatctaatactaattctgcttttgcttaagaccttaaaggatgtaatatatctcagttttacctatggacatccaaataccaaattattaattatattttctgttaagcctttatttatacagctttacagctggttacttttaagaaaaatgctatgatttatttctgaaattactgcttgtgtatcttgctgatctaacatgtttaatgactagatacttacatatcacatgatttgttcaaaattttgaaagtgtaattgtttcacttttaagtcttaacggtatgttttggttcaacctagggaatacactgaactgcaaccatcctgttgtcaaggagctcattcttgacagcttgagacactggtatggacaacttgcagctaagatttttctcataaatccaattgtgtgtagattcatccatatttctttgtttcatcttgactatgtcggcattattcataatcaagtgtcaaaaatatctatatcgatttgagctttcatgttggtatgatcagaccaagatgatgtatcgacagcctaaaattattcaaaatttcctctaggctatagcacatgcttgtagctatttggcttgtagcaagacagttgatatatgagagatagttcatggctatgtcttattgtgaaccttggaaaacaagatagccagaaactgcaacaaaaacagttatttttatacaaataactgaattatagcatgcatttttattttctctttgacaatggttttgtcatatttcaaatgtcatttctaatctccatgcttgttttaatgcatcaagggttgaggagtatcacatagatggatttcgatttgaccttgcaagtgttctttgtcgtggaccagatggttgtcctcttgatgcacctccactcatcaaggtataatgtagatgcagactttaggtttgaacactaaatatgtatggctgcttaccaagcctgtgcagaccgaattttgtttgtctaaataagtgaatttaatagatttcatgtaaaaacaacccgtacgttacattatatggatgattggatgcaaattatgatgtactgaagtactgaacttccagcaatcaattctaatcaactttgcactattgttgattgttttcttgtttgcatggttttgttcattgaatacatatctagtgcaagctcacaggaatgcaatcatgaaaatttgcaatgtgggcagctatataagatacagtatggactagatgtagggctcttgaggttcatttgaaagtttttttagtgacccccctcaaacgttagaaaattgtatttatgacaaattccaccttttcaagaccatctaaatcctaatccatcaatctctggtcatacaactcacgttgatgtatcgagactagtggcttttatgtttcttcatattaatttatttggttgtaggaaattgccaaagatgctgtattatctagatgtaagatcattgctgaaccttgggattgcggcggcctttatctcgtagggcgtttccctaactgggacaggtgatttgaacacttctatatttctataaaaagaatttggtggtatagatgttttatccttgcttcttttaggactaaagatttggtgatacagtaacacaaaacagtaactattttctgttatggataatatcatgctgagatgctcattcctaaagtacttaacaactgaattcttgaaatgagagaattattgctagtatcacttttctcattggacttggcaaacatgcttcattgtgcggttcagtgacctttccctaccatgcatacacagatcagttattctataatgagtttcatttatttttaaaggtatggtgatcatgtttaacattcctcttgcaggtgggctgaatggaacggcaaatacagagatgatcttcgaagatttattaaggtaatatgccgggagagaagattttttagaaaatacagataagaaaaattgtactcacctgcaatttatggtagagatttcatcatggcagtatatcaggaattactgctgaggaataggattgttatgcccttatgctaatctatcattcccttgcctcatccctttctgccagagtattttaattaaccatgccataggatagttattttactgagcatgttaatgaagtttagcttctcactgtacctatatttagttttaattgtccttgatggtgtatgaacattagcggcaaacttaggttattgtggaacagccaatggctaggaaacatggagattttgttaaatgtttaactagatataggatcagtacccttgcaaaatcagtattttatttaatttaatgggcaattctgaagcatacgatcacagttccgcatattatttgagaaaatggcaacatacttttatgcaatagctctgtaccagttgtgtaaagattaccaggttactgaaacataggggtagaattaggtggctgcagtttcccaaactctgatcttggctatccataactccattcttgagccaaatatttagatgatctccttcagaacttgagcataattttttttaaccatttcaaacatcagtgagttttttcaactgaagatctgaatttactgaacattctgcattttatcagtgcttgcctagcatagccatgagaattcttctgtttgtgttcttttattcttgtttctataataacgaccgaatgactgattggatgctgctaaacatttggagttgtttctcagggtgaccctggtatgaagggggtgtttgcgactcgtgtgtctggatctgctgatctctatcaggtccccctcttttagatgttattttccctttactgttattttttatccatttgcttaggatatcgcttgtttttgaactttgatccccccccacacacacaaaataaataaaataaaaatccatttccaaacaagagcggcttccaaagttattgctaataagtttaggtttaattacatgcttgttacttttgtatcactgttagagcataggtcattatcaacatttagcgtgccccaaattctatcatgtcaattgtgttagttcagtaggatttctccagtatccaattgtttaatggatataaatgtattcagggtctagtgacataccatttgatagtgcaaaacacagtatggtatgatgccacctattatttcattttgtgaggatgtgtaaggaacctctgtggacaaattttaagaactactgttacactgaaggggttcagactcagttattttttgtcaagaaacaaaaatatgtaaaataaaattcacctgatgtggcaggtgaacgagcggaagccttaccatggtgtaaattttgtgattgcacatgatggatttactttatgtgaccttgtttcttacaacttaaaggtaactggagtaagctaagcagtttagttaagatcatttatttatactgtgaagtgtatgctaatctgccttctttttatcaaaatcatatagcacaatgatgctaatggagaaggtggctgtgatggatgcaatgacaactttagctggaactgtggtgttgaaggtacctgctttaccgaatatctattttcttttgtacattgaaatcatgattccatgaaactgcaaaaagatgcttattttcatatcccatcaaattgatacatctgactgatgtagggtactgtaaagatagaaaacttggtcgagtttattattaaaacaaccctttgtatgaattaaaggtatagtcataaagagaatgacatagtttgattttgttgaaatttagtgtcttgtattgattttgttgaaatttaatgtcttgtaattcaacagaactaaaagattgcccctagtagtgaagcttcaatgtcaagatggatccaaatagctctatgagctgtgcagaactttccaaatgcaaccatagatggctatccctctttgaatcagaaataattatttttagggttaattggatccatgccactgcaaatgtggcaaatcaaaaaaatgccacacatatttgcgttatcggctggatgccactgcaaatttttaaaataagaaccatgccactccatcacgatttccgtccaatccgtcacattttccgccgtctccgtcttcgtcctctcgtcgtcctcgtctcgacggcagca

SEQ ID NO: 61254 - DNA, 10044 bp, Oryza sativa
agatcgatggttgtatgttgattggtttagttagctagctagctagcctcgcgcgctgcatctgtagcagctagctagctactccctgagcttgttgggtgtttctgcctgagctccattccgcgccgaaccccgtcaggcccggccgcgaccgcgccgggctgtcctccgcccgtgccagccgtcgcgccagctccccatcctcttctccgttttgccgcgtgaagccgatgcgttttgtcgcgtgcgcctcatcggcttcgactccggtggttgagctgctcacacgcgtccgggggcagcagaagtgagagagagagagaggaggacggaaatcgtgatggagtggcatggttcttattttaaaaatttgcagtggcatccagccgataacgcgaatatgtgtggcatttttttgatttgccacatttgcagtggcatggatccaattaacccttatttttaacctaatgctatgcgaaatgtttgatgttagaattgatgctcttgttctgtaacaggagaaacaaatgatctgaatgtgttaagtctgcgttcaagacaaatgaaaaacttccatgtagctttaatgatttctcaggtaaacattgtgaagtaacctacagtttattttatgtgtgcatcatgtataaacttatcacataatcaccattttcatatatcagggcaccccaatgatgttgatgggcgatgaatatggtcatacacgttatgggaacaacaatagctatggacatgatacttgcattaataatttccaatgggaacaggttgcattaccgtaactattttagttttcaaccaggaatatgtttatgaatttggcagatctatatataatttgttttctccgaatccatgtgaatatagttggaacaaagaagagatggccatttcaggtttttctcagagatgataaagtttcgtcacagcaacccaatattaagacgagacaggtttcttaataaagtaagtaatacctagaagtgctatcattgcaattaactggtttattgaaacaatcatttcatcatcttctcaaaaaatagctgctggtgtctgtcgaaattccaagtatattttctcagtcaagtctgattagaatagtataatacagcaaatatacactttgcagcttttgcagttgcatctcttagtttttttttcgtctcaaatgttcttcattgtattgtgatcttccttgttggtagaacgatgtcacctggcacgaggattgttgggagaaccaggaaagcaaatttttggcattcacgtaagtttgttgatcactttcgtttatgcaccttattatggtatttgtttatgatgctccaaaatccaaattcttggcttctgactttcattgccattttactgtagagtacatgatcacaactctggtggagatatctatttggcattcaatgcacatgactattttgtggacgctgtaattcccccaccaccacaccataaatgttggaaccgtgtggtatggatacttttcagcattgctaaatttcttacgtatagtaaagtaaattcctacataatcctagcatggtgtggttgtaatttctaaatatgtagaagtgctgccagtactcattctgaattttactacattagacgctcggacaaataccaactcttaaaagaagatatacaagtttccacaaaatttctcaggaatagacataggtagtactgatacagttctacaaccaaaagctgtatacggttgttacttgtgctagcaatcctgctaaaactggtttggagtttattgctcattagctacttttaatttttacaatgattggtctggctggatttgatcactcttttctcacacctttccgctcctattgtcattctaaatctgctctaataatctttttgtaggtggataccaacctggaatcaccaaatgatattgtaccagaaggggtgccatttacaggaccaaaatacagaattgctccatactcttccattctgctcaaggcaaagccttagaaaagttagtagttgagagcataaaaataatgccaccaatgctggcttggttggttaataacaggttgatcacattagcagtctgcacttcaaaaaggcaacaggtatagagaatgtctaataacaactgccgaatcatagttggctttggcagatgaggccacttttggcattcaggaatttcttccagttattactgtaggaatgaatgggctagggcttagggccctctgggggcagcaaagctcgaggtgtcgtctcggtttcatgtgagcgtgacctggctatggtcaccctatcatttatcaaggtcctgtttcgtaataatgtgtcatcaaacactcaactcccatgagaatgtatgccagcatctattttgctggaaattcatgaaaaaaaggaacaatgctattagtcccatgaagtatgaacatatgtcagtgtgtatttcttgcatgatgcagaggctgcgatattctgcgcctgcacctcccggtacgggctgcggcggcaggctcccgactgacggcgaccccggttggtacggagggaaagcttccacatgtgcaacggcggcaagctacagtgttcccaggcaggcaccaacctgttctccaatgcagccaagagaagagccagcttcgacttgacaagataacatggccatttgacagagctgggccagccggtgctgctcttaaccaaggcatgtgaaaggttaactcgcctctcctgccaatctcacctgaatatcaagcgcctacagtgcagcctgagccaggtaaaaatccctcctatctcaatcattgtgaccaccttctatcagctaggttccaaacagaggggaaggaaatgaacggccggtgtacttagctcagctgtcctgttgtgaagggcccagaccctgggggtgggacatactactctttgcaagctgtgggctgtccttatgatttgctagttatatatgtcgaagggcagccgctttattagtgctaaccaccttttagtttatggagtatggaatttggcaacctctttaggaaaatattcctaatcattcatcaatgaccaaggaaccaccctagtgcataattatgtcagtctggtttcccaactggctttcagggggaatatataagtccttcataatcataccaactgctaaaaactttacactgctagtaataaaattgataacaagctttacacagcttaatttgctggtagaggttgaaccctgtctggtggagcccggcctgaggttttaggctctagaaaatagcttaattaggtaccgagtcaaggtgaagatagtgtggttgatccaaatccagccttgctccctaagttcctcaaaattactaaccggcgccaagcagctgaactcaagctttttcaataagaatttagtgaggtatttgaggtctcaatataccttatgtcagatagctgccaagaaatacaagcaagaaaacataacatatgcccatgcatgtcacaccttcataactccaagtatctagattcggtactattccttttgaaatactcgaaccacccaacgaattggttattcctaaacaagtcatgaaaggaatgacgaacatacggataagatttactatcaacctctcttttcgcgttttgttaggggcacactcacagtcacaattcatcttccgtataatcgagaaagaaaaaacactatgcaaatcactaaatagagcgactcaacatgcttggggataaagatactctagtgacctgtatgctgacctctaccagactctaacatccgccgtccacgcgtcatcgccgaaatattccaactgtaccacaccatatacatacatactacagtcaggacttcatgggcgtacaggccatggacaacatgttggcacaacttatatgatcttgcagagactttgtggttgtcacgtagccggctcggcgccacgaagtcgtacgttcacctggtaggatagttggtacatcggtgtcacgtagcatgcactggacatccctgctggaatattacaccctgggcatagcccacgttgatagaactgatcgaacgaactcgtgcttttgaagatcgatctgctgttcttaatttggttgttaagttggacagattgcgatgtcgatcattccatggacgatattttcggatcattctgaagaatttgttttttagaaggatcataccgaaacatttgtagcaactcatcatgtgcgacaacaataaaattgtgattttgttgtcgaatccggaaggttggaagcgatgccaaattgcgcgtgatgttcgttgctctgaaatgcaaggtttcttgcaacgggcctgcttggaataaggacgaccttacgctgctcaggaatatgaatattgtgatggagtggaagtttaggtttagtatggttaggctggaaatcactgaaattatcttgtggatcaagttgaacattgtgaaagagtagagttttaggttctggaaggatttaggttggaagaaactgaataacactctataccttcccttttttgaaaagcttggatatactatatactttatgggttgagttgagttttgtgtgggagtggaactaaaggttttgggagggttcggttaggttggaaagtggaaacaactgaatttatctttgggatgaagtttttagtattgctaacacaagaaatgttatgaaaataaatacacagcagatacatgattcttttacatgggaaactcttacgaaaaaacaacacgtaccaattagcaatcatcattatttaggagttggttacaaatgcatgaaaataattgtataacaacactcctcccgtacaacatacaagaatatatataaagaaaaaatcaattataattggtaaagatttgaagttctattaaaaaactaatcttgtagtaccactgttgtaagaacacattcttcataaggggaaaaggaactttttaaaatcttggtgaacacaaatgagaatagaagaacttgtaaaccaatcaaggtgcatgtgtcaacttggttaggaaagtacattattgggaaataagtttggtactagcaagatactcaattccttcttttgaaatcttgtaggagtatatgtcggtgtgttttgtgcatcattttgttctctcgaagaaccaaattattttgagagaagggcaataacaatcaatcatctacagattcatcaaataaaaattagagaatgcatgcaacatggggcttcattgattagtttccaagccaatcatgtcctttcaaaggatttcgttaggcaactaatcttagctgggatggtgccatcataaactaagcaaaccttgactgttttatgttatctgcgagcagtagcagtcgtgccagcaatttgtcaagcctggttagtctcatgaatgtttttcccgatattatcagtataaagatttgttggtatgaaaataatcattcaggctttccactaaaacaagtgttggatcaagatcatgcatactactataaaacatgcgcactgtttgcccctcatgaaatttgaaaaggtccacctattcgtactagaatatttcataatcggccgtgaaatttgatgaagtccacatattagtactcgaatattacaacaccgctggtactataatctttcaacgtttatcatcatcaaaaaggaaaacggtcacatggctatacaattgacggtatgattttttttaaagtttcgacttgtaaattttctttaaatcattggatcgtgttgagattcatggagggaagggaagaaaaattcccatgtcacttgtgaggctaagagtgtcaaaccagcaacctcataggtaaaaatgtgcctcgctagccaaccggctacgcatggtttggtttttgtttaataatatgagagttttgtagaacttatattgtaattataatatatttacaatacaattacattatgattattatataaatagttacttttaaaagtttttcacttgaatattatataaatagtttctttatctaagcttcaaaaactaaaattaggtccgaccaaacgtttagtaattcacccatattcataataggcaaccccaataatcacgcaaaaatatataaaacaatttttgagatagaaaacatgtgagaaagattttctacaattttgaggagcttccagcctcatctttttcttatacttaaatttgactttttaatcttagatttggagttaattttagatgttttttcatcgtagtttattttttaaactttgttttttgtttttagatcgctaaaaacagtatataaaagttttatatacaaattattttttatttgtaaatatactgtttggcttatacccccaataatcccaacgatggggccgtaacacacttgggatgattcggatgaagcttcctgtctccaggaaaagaaaggtttaaaagcttgcaaaatccaaaccgacaatctgcaacaaaactgcatctcgaccgtcaaattccgatccaacggagagtgttggaaaattagcactaaaccccctgataatacctgtatttttcatgtagtaaaccacatctcctacagttctacttctttataagctcccctacctctactgtctcggacaccattacagtacaccacctcaagctagtagccaccttctccccaagcacacactctcctcccaaaccctagcaccagctagctctctcactctactccaatggcgcgcttccagatcgtggccttggccatggcgatgctcttcgccgccgcatcagctcaggccccggcggccaccccgacgcccgctcccaaggcgtcccctcctccggcgacgccgccgccgacgcctgcgccggtgtcagcgcccccggctcaggccccggccactcctcccccggctccggctcccgcccccaaggcctcagctccggctcccgcccccaaggcctcggctccggctcccgtgcccgcggccgcggctcccaccccggagatcagctcgccaccagccccgtcaccggcaggcttggccccgtctcccaccgccgaggtgacccctccccccagcgccgccgccggcgtctcccccgccgccgcgtgggtcgccgccgccgccgtggccgccgccgccgcgttctactgagatcgaggctgatgagatccgccgaccacctcattaatttattacccgtccatcagagggacccaccattcctcctcctcctctcctgatctcctccttttccttcttcatctgtggtggtggtgttgagctgtttattttatttctctctctatcttttttttcttccatttttttgggcattttttttccattcaggcattcgattcagtaggtgtgtgggcgtgtggcgtggacagattggttggttgggttggtgttgtgctgctcctccattgtactatacatctcccgttgttcaatattcctttcactttggactttttactctcttttattttccccaagcgcactcaccccatttttttaatctttctccattaccccttgcagcatcatcgtaccagcagatcagatctttgagcccccgttttcgttgggttatgtacacgtactgcagccgatcgatccgttgctgtaccgatggatctgagctgatgatgcactcactgtgctccagatctggtcgatctcctttaatactcccatctaaaaataagaggaattattggtacgtacgtggggcaagtatatcacagcatttccggtgggattttcgctcagctgcgtcgatcccgtgaggtgaaaaggcctgtagctagccagctggggagcagcgaaaggcagcgatagattacgggcaccgggtcggtcggtgggggcgccgcacgatggcgagatgtcgagacgaggcgaggcccgcgcggcacgtgccggtggtggtgcccgatcctcgcggcagcgacagcccgcagacggcagaggcggaggcgcaacgcgagcggaggcggacgcgacgcgacgcgcgcgtgggtttcccggtgtttttgctgtgttttttctcccgtccttttcgtgcgggcggcggtttgcgcgcggtgccggcttgcggctttatttagctgtaggcaagcaaaggggggggcagcgtcacggacggctgcgtgcggcgcggcaagcagcagcacagcagatgcaacgcggggtcgtcagctgtttaggtagttcgttctctctccttttctaacttttactcactcacgtccaaaaaaaacaatcgatgtgaatgcgatttcagtttggttgtactagctaaagtcacatttttacctaaatagttttatttatttagggatggagggagtactcgttagtttttcacacgcacgattctccaaacaatctaaataatactccctccgttctaaaacttaggtggatgtgacatatcataaaaccatgaatatggagaaacaaaatcccttatattttaaaacgaggtgaatactttcttttaaaagttatttatagaaatgttggttgaaaaaaatcatattaattaagttttaagttttttaagttaacttctaactaaccatgctgtaattagccacccacgacaagtgtaatcgaacacagccgcggaacggcggaagcagagtggtagagcgcgcggtctgatgagatgtgtgatccgacgacgatggtacaaacgactcaacgagccaggttggtggtgaaagggatggtacgggacgataccttggtacgtgtgcacatgccatgccatgtgtgtgtcgtgatcgctgttttctactatcactactgatcacgcaaatgatttcggaggaagggaatgctgtgcagggcaaccaataccatacatcatttcactagctttggcttctgcccggttagaatccgggatccaactgtgccgtcaaattcatgcgttccaagctaagtaatgcccttgtttttgcaattcatgggctaatcgacgttgaggggaatgatgccaattgtctggctgcctgaatgcgatccacccacgccatcttttttttttgtgacctgacagctcctcgccttttagtgcgagcggtccttgtacgctcgctttacaagcgtaatgcatttgcttaagctagccacacagctcggacgcaacgcagggtgaccttagctagcatatcacgcgttgctgactttggagctgtaaagaaacataaagaagcagctgattggggaattggctttcctgccgccaacgacgatctctctcacattctcactcagtgatgaggggggggggggggggggagagagagatttcagcatgtgatgagcattatttcagcgaaaccaccgggctgtgcgtgtagatctccctttttctagcttcttcagcctgcacccacgaacacactgaaattctgaagctgagatgggatttatgggacgagaggtgcagctagtagcagatgttccgttctgccgtgagattgaggggcccacctgtcggccgccgttcagggtgggccctgtccggaacgtgtgacccatgtggcgatgcgatgaagggagaaagaggggccaggagcatccaaggtggtaaggctcacagtacatcgcctactaattaacaggccgtgtttacctttggtggttcgatgtggtaaacaaatggccggccgtccaggagagatctgaaagacactgggggaactgatgcgaaccatcttcagagtttcaggttctatcactaacgcttttccagaaaaggggtgacaagaaaaggcagagtaaatgttgccaaattggtgatcaggttggtctctgaatagacaaatcttggatgtcctttgtctaataaaaaaaaatctagtttgaagttagggtatgtacaatgctccagtctgatgtgtggttttagcttggtcacgtaagcggtgagctgccttagaggagagaga

SEQ ID NO: 61255 - DNA, 2960 bp, Oryza sativa
caccataattggacaatgtaatgctacagtaaatatttgctaatgacggattaattaggcttcataaattcgtctcgcagtttccagacggaatctgtaatttgttttgttattagtctacgtttaatactttaaatatgtatccgtatacttaaaaactttacacccaaaagaactaaacacaccctttaaaaaacaaggttgtcctggcttgcaaagatacaacacgagcaaagacatggctcaagcaccatattcggtgaggctatactcttcacaaacccctcccttccgagtagcggtggctagaaaaacgtgacacatcaaacgggattgaacaagagaactagcacggtggaggggagaaaagaggggcctagttggtgtgtaccacgatcggctcgttggcgaggtaacacattcatcgactatgaatcctgaccgtcatggatcttgtcagcctaagtcgccatcagatccatgggagagagataagagagaatttatacataaacattataatttttctttcttgaaggtcataaactttgtaaatttataaactgcaagagctgtgagcacaacggctgtcccatgcgtaaaaatatcaattttgctatatctcactcgaaagatttttttcttatctctcactcgattttctcactcaaatttacaatgcattttcttgtaaattacagtgtaatttatgaaacttgcactgtaacttttgtaagttacattgtaatttttgaatcttcgcatgtaaattttaaattttgtattggatttggtttttttcttgaggatatggtaatttagtgtccattaaggtgtttcttaattgcttttttctttttattatatctatcggattttaatccaaagattaaaaatccgtgtgatacgatcataaaaatctttcgaaagatgtataggtacttcctaaaaatatttgtttcttttcatgtctcactggtgggcttacaaaggctagcgttcatacaactatacaaggcctttcttttgggctttaatactatattaggtccatttatttcttttattgcgctcgcagtaatcgtacaaggatctggcatatcagcgtatggatatggttgcatttgctacgagtttttcatacctgaacctacgactaatgatcaataacctgactagacactactttccttttccctttgcaaacctgaatgaagattcatgcttacagttcgtagttgatcagaattaatgcttctgaattgaagttctgttccgtcccctgtaacttgacgtcacgttctatcttagccctatcttttgagagagttggcgatgcaagcgtttgccagatgacgaaaagcacaagagttctctgaggcaatctagggcaaattgggaaaagcaggagccttttgcagacagcattagagacttctaatataaccacgcgtatgcatccaacagaccggttcccctttcatcgttcatgccctcgatttttctttttgtctgtgattctacttttgccccaaatgagccgcccaaattattctcacctgagaaaaaaaattatttcttctatctgcaaaacgcttatgtcactcgacatatataggcattctttttcttactcgacatagagaattttaagcttgtgtgtctatatagtaagtattcctttcattcacagaagttacacctattacttttgtcatcaagaccaagaagaaattaatcttagatgttataaaatcaagaagtaaatacaaacatacaaccaatgagtatttagatgactccttgggttctaatcaaacatttaatttatctcttcatttaagttttgaatatataaagactaccaataggaacaatttatttcaaaaactcaaatgtgaaacatgtctaacttttatggatggagggaataggttgtaaggcttgtaacctatcgattttcattttttcaaattaggatttgctatttgacaaattgatagtgttgtaggccagtacgacactaatctaccgttcaaatcctacatatatacccctgcttttggcacaagtgggtgtcttcgacatttgatttttttagttcaaaagtttatctttatattagccaccatgtgtgttgagcctatgagggactacatatgcatgcgcagaacatggaattttactgtgcatgtacatcttctatctaattgaatacagtttgctctttctgaatcactttgatgttatttagcataggaaagcatctacacactacactgcctgacaaaagttatatatttactgcaataaatcccagtaaaatggatactacgcccctcatgcagatccccccccccatatatatatatatatatatatatatatatatataaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttggtagattttgattttaggtatatagcatctatacatataattagttaggtatgtaatcatggattgtgaaataaagttaaatttgagttgttttgttgataggtataggtatgaatcgagttattataactaggtatatactcacaatttgaaaattttgaaaaatttgtgtgattttgtatatttgataccatggtgcccgggcaccatggtgccccatatgagtgtcctatattatatatatatatatatatatatatatatatatatatatatatatatatatatatatatatatatatatatatatatatagagagagagagagagagagagagagagagagagagcttacaaaacacttcgcatggcattgttcggttctaggttgctaccattcacata

SEQ ID NO: 61256 - DNA, 5546 bp, Oryza sativa
cggttataaaaaattctggaaacatttgacaacactcatagaacatatatatacaacttcacaaaatcttaattaagtccaaattcaactcacacgtcgagatataaaaaagacaaattcagcgtatgaatagtagcgtactgtttatatctgaatttgtctctttttttttctcgatgtgtagatcgaatttgaacttgattttcggtggactagtagatatcactgtactctatattgtcaatttttttcagaatttttcataattatttgcattgaattttaaagaaaaagatacacgagtggacatccactcgagagattagaatccacttgtgttcaacccagtggcggatccactgttggggctggttagtgcgccagccccacctccaatccctgcatccaatcagctattagcaattataattaatcattaattagtgaaaaattggccggcggcaaggcaagctacttccctacttcttgcagccaaggccaaactggcaaagacagatatattttatttatagatcattcttagtagaccatgaagtacctatttattaataaataaatttctttagatattttatatagccacagcaagttgaaatatagagagaagtgtgttcttattcattcatgcatttgcatatttgggttatatttacaaaatatttttgttgatatagttcttgtttgtctcaatcatactgagtttttcatagccccagctcattttgcatcctggattcgccactggttcaacctcagttaagcatagaataagggcctaggggcacactcatgcgcagggttttgcaatgccttcttttaaggtgtgaaaaccggtcgttgtcagtttgcttaaaactaagcaaaatccgatgatttttggttaactctgtaagagaatcagccaaaaccgatcccaaacagtttcataaaaatggtgtggttttcacgatttctgatcgatattgcgatggaaccatttcatttgagatcatgtctttcatataatagaaaaataaatataatatcttcaaagaacacaaatagtttgcaacttggcacttaggtgtgttggacaagcttgggcatatataattatggacacaggaacctattttaaattcgcgaggggacatctatcacctcgttgtttgcatgtcattctgatggttatgaaaaaattgaaaaaaaatcaacaagatacttggttaataagtgttaaataactccacaaacatataagaccaaatttaacttgtgcaagttgcaacgaaaaaaacaaattttattgcgaatatacgttaactagccatagtttaatttgttttttcgttgaaacttgtagaagttaaattttaacttgcgtgtttgttgagtgaattatcatatactaatatgttttgttgatttttttttaaaaaaattcataaccatttggatgtcatgcaaataacgggaggataacccttcgagagtttagaacaccaacggtaaaaagacgtgtagtgtgatttgctggaggatagtaaagggaaatatttattcttaaggccttatacgtttattctcataagaaagggattatatagaattgcaggggatttagtgtggaattaactaatccccttgaaacccccttaatctagttgggtgactgaggattacacaaacaaggcctaacaaggaatttttttttagaaaatgaattaaaaatctggcttctacattcacttggatgtatacacccaacagggattcaactgctggaacaagtatagagagcaaaggctaaagttgaggggtcaagctgtgattacaaaggtcaagtaattaaacttcggtatagttatacaaccacgactataccattaccaccagcatgtttttaacatgcttggttttatttatacccaccataagaaatttcaccaacacaaaccatggcatgcataaccagagcccccagacacgacgatacaccagtggcacaagcaaatttagaatcaccacaacaaactaaggtgattactacatacgagttgcacggtgaccaaatcacacgagaaacgagaagaaacacggtcagcttcattgcacgagtcaccaacgtgcaacggccgatcgacaagaacctgcatggcttccacgcactgtctctaccctggctcgcatgcaccgcggccatcagaacagcgcgagcttgatcagggcccccgctgccgcggcggcgacagcgctcgccgccgccggcgaagaggcggcagagtacgacgggtcaccgttgacgttcacggcgagcttcatgccgctgctgcagtggccggggatggtgcagatgaagtagtgcatgcccgggtaggagagcctgatggtggtcgatcccccgttgtcgttgctcagcgggctgttgccgttgcagctgtcgaagttggtctggctcacctccgtcaccgtgtgcgccctcgcctggtagttgaacactgcaccaacacatgtgttttcccagcacgtaggtgtgtgtgagactgtgagtatatgtgcaagcgactactccctctgtcccataaaaaattaagctagtactgaatgtgacacttactagtactatgaatctagacacacatatatctagattcgtaatactaaaatatgtcatatttgattctagattcgttttttatgggatagatggagtatgtattagtgatgagagaaagctgagctttgctcaccgagttcgtctccttgtctgaaaaacttgccgttggcccagttgttgtagttgacgccggtcgtccagccctcgccgtcgccgacggtgtacctcgtggctgcggccaccgcggcgcaactcacgacgagtagcccaacgagaacggctgaagagacggccatttgtccaatgatcagaaaaaggctcgggaagagttgggttaggcacttggagggagagggagataaggatgtcagatgaccaatctcagctatactgttgctgctgcacatttgcccggaggttgtaggcagggtctatttatacgcacggccagagaataagtcaagtgacaaagtacagataaagagttggccaatgtcgaattgtcaatccccttttccgatcggattctttctaaaaaccactataaatttgctcagatgtgaaaaaaaaaagtaattggaatgcctttggtgcaactcaaagcttccaggaggtgcagagttgtttcagtagctggtagcattccctccctctgtgcagtacacgcagagtcacacccccgtcgcattattttttccatgataggaacatataccacatttttctagctgcaaataagcttttggacaagcaatccatgtatccacggatcggcaaatgaaaactgaaaaggagatgttacgcagctgaacgacgctttgctggctgttcagggaactgataccaaagcgccagagatacgatcaaacaaagccatggatgggttaggtgatgtctacggttagctttgccgcagctctctgaatgttccacacacggtgatgtgtctctctgcaggacggacgggcggacgggggcagctcgatcgatcggatatcgagcatactagcagtagtccagcactgtttcactttcgcggtttcacctaatgcgctgaccggcgggtgagtggtgcagaggacaaacacgccggaacgccaccgggtgcaggtacatgacatcacggccggctcacagcagcgacgctagataaggactcccgagctctacggacaccggtgcagctgcaaccactgcaacccctagtacagatatacttgttaccaagattcttgtgatctgtgtgtagtatgtacatcagcaatggctgctcgctgacgctcttatcggagacggcgaaactttcgccaagatgtacgggttcgaaaggacaatgtgtaacacagggttctgaatttctgatccccgtcaacctcgccgacgtaaggggggcggtggccatggcgaacggtgtacttccgctgacgatggatgtacttcgatgtcttcgtcagaggacgactctgcgtatctccggcctccgaccggtgccgcacgccttgtcaaattgaccggcaggagctctggctgccggtctcacgggatgcgatcgatgacaagggaagacatggaggtggtcattcatcgaaccggcgggtgttcgccgttcgcggtgtcggttaggggacacatggcggcggccatggtgagttggtgggggagggaggaagacacaattgggttcacaagcgccgtccgatcgagcttccatggccacgatggactctcctgggcattctttcagttagacaccttagaaacatgttaaattggtacccgtagttttggatcgaccataatagttgggccggttgcatgcggcccttgaacgtggattaagacttggaaaaggtacaccgaaggtccctcaacttgtcatcgggattaaaaaatatcctcgaaccgcaataaccagatatacggtgtcccttaactatgcaaaaccggtcaccagaggtctttcggtggttttaacccagtgttggtctacgtggcggctgagtcaacacgggacccacgtgggccccacatttcaggtgtccacgtcagcgtcctctccctctttcccctcttctctcccttcctcatctctctctctcgcttctctgcaagttgacaacgaacagatggcggctgccggcgaggaggatggcgcgaccggcggggagaagggtggcacgagatggccaactgggacaaggggaagggagaaggagcggcgccggcagccgatggggacaaggcgaccggcggggagaaggatggcacgcggtggccaactgggacaaggggaagggagaaagagcggcgccggcagccgatggggacaaggcgaccggcggggagaaggggcggcgcgcgggaggaggcggcctgcccatgacagcgccgcggccgcgtggggcgttgcctgcctccaccgccgtccgccgcgcttccgcttccgctccactctgcttcgctcgcacgccgcctccgctggccgcatcctcccgtccgcactctccgccgcggagagatcgagtgccgccacatcctcccgtccccccctctaccgactccctcctcgccgcaacctcttcgacggagagcctgacgaggccaacgggcgtgaggcgggagaggagatccggccgacgacgcggtgacgggcgaggccgacgctggcgccagcgccgcctccgcctgagctcctccagcgtcgcccaacaacatcgccttcccggtggtcagcggctcggtggcctcgtaaaaggcgaagtagagcaataccaccgctgatgcggcggccgccgaggccgagaacgagacggccgcgaggtgggcgtccagggagatgaggagggagcgggagcggcggagtccaaggagcgtgagaagaagaagagggcatcgcccacctcgaacagcgcgacagggatgcggatgg

SEQ ID NO: 61257 - DNA, 1054 bp, Oryza sativa
  unsure (1)..(1054): unsure at all n locations
cgacgacgatgacaacccatttcccgccgccgccgacgacgccaaccccggccgcgcgcgccgccgtgggcgccctagcgccggcatccccatgccctgcgagagcagagagcgagagggagggagaaaggagagaaacagagaaagagaggaggggaaagagagagttgacgtggagacctgacatgtggggcccacacgttaagttgacaacgagctcgatactcattcttgaaccacaataacatatacaatgggtttattaactatcaaaactggtgtaatataggtcccatgacaatatagcgggtggtttgtctgacgtagcaatttgacccgagcaacagcgttaagtaagcgtgggcctcaccatgtcaaggcctttttactcctctctctcttcacctatctctttttctcttcacttggatggcgagggcatccatgccaacgaggagggtgacaaagggggtaggctagtgccaacgtcggcggcaacactggtggtagcgaccacgcaagctgtgaggccgagctgctctggcttcacatgtaagcgacacatccctcttcatctcgaagccgatgtggtggtcatctggcttgacaccatcgctaccggtgcggcggtggtgcgtgtacgcgcccgcttgagcgcgttggagagcgcgggtgcggtgacgcaagcctcaccacacaggtgtccctgaggagcggcgatgggtcagatagcagcgttgtggcagcgggcaatggcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61258 - DNA, 6449 bp, Oryza sativa
gttttttgtcatggctggctgcccgctgtgcgatgcagcgcctatgcgtaacgaacaaaaagttagttcatctcttcgctgcatggttggtcacccccaacccaggtggcacaacacagccctgacctcgttgacgaaccaacgagcgattgagaatcgcctcgcctggagtaaaatccggcggttggcgctctcgtcatcgtgcgtacggtggccgtagtcacgtgtgtgtcacatgccgtttcatatgaacttgaaatttggattactccgcatgaattccattcggaatcatccaaaacaaaggcgtgtgtgcgtgtgtttgaaaatcatagggactgacgaaaatctccgaaagaatcagtgacccgaattgtcaaaaccatctttcgttttcctctcccttatcctttcatgtgcactatagtcctatgcccctgatagggacggtacagtgcatgtacccgtgctccctgtaaccaccacactgaacatcaagcgggggcaaggttgcatgaaccgtcccctcggcgtgcacaagacaagcgcgtttgacgtagccgccgtgcagcgagccgggaaaggccggacggtgggggagctaggggccatggctacgtacgtgaagccgaacggccggagctgcagttgtatagtcctttttagacttttccgtgcaggcgatcgtgtactgtgtcggggtgctgtcaaaacttgtccttgttgatggctcatcgccgaggggaggaggaggacctaggacggagacaaagcagcattgctttcgcagtgggtcacgctgccgatttgtcactatgctagattgctagctagccatgttctttttgagttttacacttttcacgcggttgacatggagccgagtatgatttatccttccgttgcattttcattttctgacatttgataacgtaaacagcggctcttaactgtactagtaactgaactgttctgtcatgagtgggccgtactaatttggatgtaagcaaaacacataatgctcttattgtcattacgatcttgggttgaatttgctgttttgcatgcaaatgtacaaatgtagatacaaataaatgatcatacgttgcaatcaatatccatgtctgcacaatgctgtaacattggaagatttgggttgttaatttccaggttcgtttggctggtcagtgaaattattgacttgatttgactctctctcctcctttcttgtgtctgtatcacagacaggtgggcccttctgggacgtgaggcttgggcgcgaggacagcctgacggcgagccaggaggactcggacaacatcatgccgagcccacgcgccaacgccaccaccctcatcaagctcttcgccggctacaacctcaccgtcaccgacctcgtcgcgctctccggctcgcactccatcggcgaggcccgctgcttctccatcgtcttccgcctctacaaccagtccggctccggcaggcccgaccccaacatggaccccgcctaccgcgcggggctcgactcgctctgcccccgcggcggcgacgagaacgtcaccggaggcatggacgccaccccgctcgtcttcgacaaccagtacttcaaggacctcgtccgcctccgcggcttcctcaactccgaccagacgctcttctccgacaacgccgggacccggctcgccgtgaggaaattcggcgaggaccagggcgccttcttcagggccttcgtcgaagggatgatcaagatgggggagctgcagaaccccaggaagggagagatacgacgcaactgccgtgtcgccaatgccccggcgccgccgcctgtggaggcggaggtggcggcgacgtccaaggcggtggtcctggtggacttctgacgaacgagctgctagtcccctgactccccagctgttggtgttcgagaggagctgctcagatatgagagtgttgtggctattcatatatgagtttttggtccgatggcaggtttgcacctacctgtaagcttgtgatttcagggttacccgcttattgccgattattgaatggtgataaataactgagaaatcgagctaatgatcattgcctgatgtggtttggtctctcctttctagtatgagtgataaggctaagccaaaggtggcatactggcaccaaagaccgggtctggttaattctcggtaatgcaaagttaactaggagtacgtagtagtagttcataaatggagaggtctattccaaacagtgggcagcttagaaaactagtggtagccattgacattgcgtagaggagcacaagagcaaaactgtcaaaaaagcattccaacaccaactggtaaataagcatggtagaaagacaaaccgacaacacacatgcataatcgtatatacaagatggcgaggtgcaatgtattgtccatgcaaatgctactttaagaaaagcagtgagagctatctgatctgatactctggaaaagcagagatcagctatctaattatacatgctgtccatgtctattgtgagctcggggcctacatatggggccctgcaacacggaaaccgtcaggcaagtctgcctcttccagtactgcaaaacctgagagaaagccatcacactgtcagaaatctcaacagatcatcattccacggtcacctgtgctgtatgcaaattagggaccttctatcatcatttgacaaaaaatcctttaatattttagaccgcccgattactttatgttgtgtactactcccttcgtcaaaaaaaaaatctaaaactagatttgacatattctaatacaatgaatctagatatatgtactagcctattaggttttctatgggacagagggagtacaagacaaccaaaccttcaaacccctcccttactctctctttttccgacttcccctcatcgccactaccaccaccatcgccgctgccacccaagcttgtcaactgactagaagtggtcaacaacatcggtaagatccctaagctagcctcttccccgcttcctctcctcaccttgtcctcaagccggctacccctgtgccgccatcttcccgtggctccccataactggatccgccaccacctcctaactttgttctacatttccccaccagcccaccggcccactatccacttccgaccctgtagttttggcaataccgcggtcgccttgctgcccacccgaactgttgcctcctaggttatcctctaaaactaacgaacttctctaacctaggactctaatccgtaagttctctatcaaagtttggaatgttgccagtgttggaaaagatgaggagatcatcggggcttaaaaaaaaagacaggagcatgaaacgtgaagcacacccaatgatccaaaatatgtaatatttgaaggtattttatatcgaatgaaggttagcgattcctatgcatgcatgttgtgtgcgtaccagggagagaggggatgggaatgtcggagaagtaggtggacggccggccgaggtcctcggcgtagggcggcgctagcacgtcgaggagcgcgcacggcgtgacggcggtgagggagtggatgttgccgccgctccgcgggaacaggaccgacgccttgcacggcgcctcccgcatctcgtcgacggcgaccactcgggctaaaccacctgcatgaaaaatactatattcctgtgagaatttcgttactgtctcttcttgagaggattggtggacttttggatatcttgccatattggaaagcagtgggatggcgtcacttacttttcttttttttttcttagtataaaaacggcaatttctgatactactagtagtgcagttgtttcattctatgtacactgttgtttttccaacagcacgtggcttgggcttccaaccgaagtaagctagtagtaattcaaaaattaatcgacagaggctgcaagtatccaaaaagttattccagtttcaggcgagagctatcttttgcaaattccaaaccattaaaaactgtatcaagagtagagcagtggacagggagagataggttctcctgtttatattgctgaaaaaaaatgctggtttggtgagacatcggtgggatttggctatctgaaaccgtcttttacaaggattttgtagggaggtattaatctcatcctgcttgtaaattatcagagacctttttctgtccttgatcatagccaggtaacctcaaactagtatatgtaggtgagacaaggaacaaatgttagatgcagttgacaacttgacatcagaaaacgatcgagtttttttgtcgattgatcatcagcgagcgaatcgacggcaaacaggcgcatgcattcgcatgcagctgagacaaatgcttactcttccttgggcccgagcacgggggcgcgttcgcccagtcgtacgacttgacccgcatcgagccgtagagaagcttgctcagcaccaccatttgcgggtggtcgtgcagcggcagcgtcgcgccggccgggaagcagaacacgccgatctgcacgtacgtacgcagccgcgcaacaccgccaccagatcgagcgtcaaattggtaccatctcacccttttgcgaaagtgcaaaaaaatactaagaagaagtgcatcgttgcgcgattgcgcgcgcgtgcatgcgtaccgagaaatcgtcgcactcgtggatgtgcacgtaggtgatccgggtgaacgcccgcgccgagagaaaccgccgccccggcgggctcctctcgtcgtcgtcctccgaggacgacgacctctcgccgccgctgccgccgccttcgatcccgacgtccgccgcctccatgccatctgcaaaatcagcaaaatgaaccaacacattaattaatttgcacacgtatgaaccaagatgcaatgaaagataggagtataacgtaccgagcaggtcttgcagccacctgatctgcttgagcgtcggcaaccctgctttactccccgacgagaagacggcgtcgcacgcgtcgtacagccgctgcaccttgctctggtggtcgtccatggccacgcgctagctgtgctgccacaggaagcgaagtgacccggctggttttaactttcacacatctacactacacaaaacaaccgagcaacctgcacttgtacacacgtatatatccagcgcgtagtacatacgtgcgaccgcagaaagctgacggtgagcgcgcgtggcgattgagagataactgtgcaaatgcaagtgtgtttcgtgtagtgactacgaagctttctacctagcttcgtgacgtgcgttcgtgcgttatgaggcaggaagaattcaagaatttcaaggggatcgaagggtcgcgagggcgtttaccggcggtacaaaccgtgggcgattcgactttacagggggctggctggctcgctctgcacgcacgcaccggtaggcgagctgtgcgatctcctctgctcgtgtacatattgtgtggcttgatcgatgcgagagtggatcctaaatcctcgagaagatattttctgtttatatgtatgtcatttaaatgactatgaaaaaaattaaaaaatataataagataattaatatataataaatcactctataaaaataagttaaaatttaatttctacatgttacaacgaaaaaaacaaattaaactatgaccagttaacgtatattcacagtcaaatttatttttttcgctataacttgtagaagttaaatttgaccttgcatatttgtgaaataatttatcacatattaatctatctttttaatttttttaattattttcatgacatgcaaataattagagattagctagagttaaaaatagttttccgttgatacggtcatcacgaaactactgttcgcgatactaaacaatcggcgaatgcagctgggtaaataggaacttttggtcgcatggaatccggacacggccacacgggccattttatttttcggtttttccatgtgggcgtcgctgttcggttctgcgaaaagagtttgaaaacggcgtaaaaataatgtacgctaaattcttgcaggggattgattgatctgaagaggggcagacgagcttggatgcttggttgcctggttggaacttgctactgcgggtcggttattttatatcgatcggcatgcaagattacaaaaccatgggaacgctgcactgtgcatgcttatccgttaagcatgcggcccaggctgggataatactactcacagaccgggtcgttcttgggcagcagtttaatactagtagtatattcaaaaaagattttgagtaaaaaattcagttttagcagcaagccattgggtgcagtcgtgcagagcggtttatacgctctggagctggagcaaggtcgctgccctgtttgcagttggcatggcggcgatcgatcggagcacaaagttcatccatcggacaacagattgacccatgatattacgcc

SEQ ID NO: 61259 - DNA, 1360 bp, Oryza sativa
tgtatagcctgcaattatggctcatataagaaattcgttctcccatttttttaagaacagggaaaaaaattgttagaaacataatgaaaagagaaaacccttcgtagtattaagttaattatcttttttttctgaaagaatattttgtttaaagtttttaaaatgtacttggaaaaatacagaatcaaatgatggattcacaagctactatggatagccagtgcctagattttagcaatacagtgatctatgaaaatggaaagaaaaatcatatgctctgttgaaaaaaactactgcagcttgctttatattacagtaggttaaatagtaggaacttcaaaacaaatgagaatacaagacccttcatccacaatgaatgtaaataaagccatataggaactacagaacaaaaggcatgggcaatccagggtagtaagtttggctctgaaaaataacaaaatactcatgataatgattttcatctaccaagctaagattaagttctgacaaacctgccttgaatgcatgactattttcactatcgataacaaggaatagtggatatcttgtaaagggaatcagatcttctggataaagattgtttggacctggtaaagatacagtcatgtcagaatagaaaatgcatactgtatcaacctttcaacaagaaactagaccatcagtctagtcggacactaactagtataccataaaaagtgggcttaattgaactatatcattacactgagatatcattccagaaatcaaccctacaagaagacagatgctttacctccacttccacggggaccaagccatagatgattatctgaattgccattggaatttggcttatcgatgggatacacggaagttgcccttgcatatgatgagcttgaggcatacttttgagaagtaatgttctgctcggaaaaacctgaaattttgatcactaaagttagaagggtaagaacctaataactactcaaaacaagaatgttactagatgttttacagagtcagatcaagaagggaacctgatgctgatagatagacaagtaagatgctatcttgagaaagctcctcacagactgtggctagaacctgaaattacgaatttctgatgtaacactacaaaaaaggttcaaatagcaaaagaacaaatcatatggaccatcaaactcgtgaatgaataaaagtacattccaatggattgcaacaattaaccccattgtcaatcagcactgcaacttggcaaagctgaaatattctcacatttttccatttgtgtcatgagaaatggtacagtatactgccaaataagtgggtggttccaccaccaaataaattataatgtgca

SEQ ID NO: 61260 - DNA, 5962 bp, Oryza sativa
tgatagcttgtcaatacagcttctttcagtttcagtactctttttgaatggaatcgtgcaataggtgcaaggttcgacggaaaagagtcaaacaagttgtcatatctcagtgatctagatcccttgtatgctccatcagctttcaagaatctcccaagctcttgaagcacttgtttccattccttgaagttggttttctaagaagtatgaggtcacaaagttgttatggaagaattaaatggcaaggtgttttaattagaaaggatataaatatgtgattctctattgaaatatataacattgcaagaaaatgggaaatatgtaacaaggcactcatgtcataggctcctaaatgctaagctatcgttttagcataacattcattattcaaccctcaaacaacatatcatttctcaattaagcactgacaaaacaatgtgatatatatgctattgaaaggtaatagagcttgtgaaattgctctagttcatacactttagtacgtagtaactttaaaattatcaaaccaactaaagagaatgattctactttagcagctaaaactgtaaaccatacatgattcgaaatccgttatcctaatgaaatgtacgactcatgcaatgcaatatcccaaatccgaatggtaagacgagcattgaacagtcgtattacttcagttcaccacaaataaagtaagattttaaattttaagttacatactaccagaacgaatttgccattttaaattacatataatcgaattgggaaataaatagaaacccttgattaagcagcagtccaggtcaaaattcccaatcagaattctttatacagaaaaaaaaaagagcactgtacatatcacttctatcaaaatttcaaaaccaagcggcaaaacaaccttcaaatcaacaagttcccactcttcttcactactctaatctagaagttaaaaaggtctccttactccttaggtttcctaaaatacaaaacagcaagcgcacaaacttaactcggggttcccctattcaaagcacgagaggagctaagcttcttacggggtatgccgacttggtctcctcgacgagcgaacggaggcgggaagcgaggtggtccaccgcctcggcccgccgcatcagcatggccacgacgaggaagcgcgcgatgaaccgcagctccttgtaccggatcaggaggccctggtgcctgtagccgccgcccaccaccacctgcgccgcggcggcgaagtacccgcggctgtagatggcctcgtagaacacgtaggcgccgacgagcgagcgcggctcggcggtgcggaggtagcgcgcgtagtagagctgcccgatccgggaggccaccttccccgatctcccaccgccgcagcccgcccgcgacgagctcccgccgccgctcctgctgcaggcgccacagccgcgtgtacgccttgaacgccttccggctgtggtggtccaccccgccgccgtagagcggcacgtcgcgcgcgcgcgcgaacttgcggtccgccgcctccgtcagcgccttgaactccctgtacgcgccggaggaggcctcgccgtcggccatcgccggcgacgagaggaggcgcggcgcgcgggggggctattcccctcgccgatttggtcgaatgggagaggggaggtggtggtggtggtggtggtggggaaacgggcgagaaagagaggagagagagtgtgtgtgtgataaaaagggggagtttgttcgagaagagattaaaaaaagtattacgacgagtacggggtgagcagcgcagtgagctcaagctgctgtttgttacagggacgctgtaatttaggtgcctaattgggctcttattagtcaatcatttgcactttgtttaatggcttgtctgcctctactcactgctttggttccacagtgagaaattacccggtatgattttgatttggacactaccaaatctatgtaactatgtttgatttgatttcttaacaaaattttatgttaggcatgtttaattcccaaacagaatttttcgtgttatcacatcgaatgattggacacatgtatggagtattaaatgtagaaaaaaaaataattacacagtttgccaggaaaatgcgagacaaatcttttaagattaattgcgccatgatttgacaatgtggtgctacagtaaacatatgctaatgatagattaattaggcttaataagttcgtctcgtaattttctagcggaatctataatttgttttattattagactatatttaatacttcaaatgtgtgtctatatatccgatgtgacatgcagggtaaaaatttttaacaactaaacgtgaccttataatatgatgaagggaggatagattatactatatttgtgtatgattttgtgataatatttgaggatagaaatgaatgaattaactattgtaaagtttaaaagttgtataaagttttttaataattataatgtttaaccgtttagactggccataataatctataaattataggagaaaaaagtgctaaattttgacgtggttggggcattcaaaggaggattagtaagctgaaacaaattaatcaattggagaacttatgtccgagtacgtaggctgcattctcccccacagcctcgaaagcgatctcaaacgaagaacaagtccacgttaattaaagtgaaaatgaaggtaaccagacatttgaccacccaaccgtgaacgctttcaatgagaacacgacaccgttcagtctcgtcagctcgattcgatagggatatccatttgcggaacacttgacagttgacactgataatcaaaacaaatggcaggagcagccgggctgatgagtgacgacctctactcactgctttgtaaatatgaatatttgtttttttatttagtaaagattaataaaaaaaattcagtcattcaggtgctcatatagatgaatggatagaatacgtgtgtactttaatataggtgaaagtgtgtatgttgtaagcgactgtgttggtattatatttccaaaaagagttaaccatatcgttgtcgtgattcaattttaaattctaagcatttaattggctaaaaatactttgatttcagtgtataaagaaacttatattagagcaagtttaatagtatagccaactactaactccaaatcatatatatctaatataatagcacattcatacaatagttaactatagaaatatattacatcattaatatccggttatacctctcatacacaaataatattttagagtccgtgttgcagctagctataaatatgtaacccgctttcttctctctcttcacttttcttcttgatatgtggttatagctggcttatagccttctattgtacctgctcgtagataccatcagaaaagaaaaacttatgttagataaaaaattaaaattttaaaatgcttatttgaatacaatgagagggattcaccaattgtcctatagtttagccgcaacttgctgcccatgcctagcctagcccccacctccgcttacgccggccggagacggacgcgccgatcgcgacacactggttgaagtggtcgggaaagcttcaggcgatcgcgccatcttcgtacactttgccttgacgttggttgttccatgtcattattccctagctcgcgggcaggtgggcagccgttttcacgcctcgtcattttccggtgaagcagcggtcaattagcactcgctccgctgatgagacgcccgttgcaacctccaactagcacaactggtagtctcctttcctctacctaactgaaatgcaactgccaagaaatcctactagtagtagtagctgtctactgttcatgttgttctccattttgtgtttcagtacaaaaggagcccgagttaattcttgcaagaatttcatactctgctcgggctgagaccgcagtaaccactggagtactcaccagttaacgaaagagggcatctttgctcgattaaagaatggcactttcacttggtatcattctttcacttgccatcattctgctggaggtagaggattcagtgttcagtgcagtggcctctgcctctctggtcggcgcaatcattcggcgcaagtctactcgccccaattctttacagctggagtacgtgcaacctgcatgcaagcattcgccccagcggctcgcttggaacaggttggctccgcgttgccggcctggactgagcaagtgtagcagaagtagtacgtgtaagagcaattaacaattggtgatgcagtggttagcgattaagtaatctgatcatgggaatcttaatctgaacgggtttgtgctgctggtgttctgataaaaagctgctgttttgcggtgattagttagggcaggattagcttagcttagctgctataggcttttggagctggtcccaagggatgcgaccatttagtagaacacacatcaagacataaaccatgctttcggcatgatttctcccgtaccggagtactcactataggtcacatgaaaaaaagtgaaatggagcggtgattggtactgtgcgctagctagctgcatagatgcacactgtgacacatatgagatagcttttcacttcctaatttcttgacgagctagctatatattgtacgtgcatgtatgtgcaaacccatgaaggagactgtgccctagttaaaagaaagaaagaaagaaccctcagcttagttcatgctactaatagtactaatgctactaatagtattatatgcacgggtctcgactattagatctgtctaacaaacaccttctccacttgtatagtactcccttcgtttcagaaagattttatttttatgtttctgtgttcgacgtttgaccatttatcttatttaaaaaatttataaaaaaatattaacaaatagtcatgtataaagtatttttcatcttctatcatctaataacaataaaaatactaatcataaaaaaaatttaaataagacgaagagattaaaagccaaaaaatagagcctttatgagacgaagagagtagatatttatgcacctcaaataataaatctattcaatgtaccctggcccttggggagagctagtttttgctaaagaaggtgaactaaaccgatctgttagttggaagggacaaacataatactccctccatttttaatagacgacgctgttgattttttctcacatgtttgaccattcgtcttattcaaaaaatttacataattataatttattttgttatgagttgttttatcattcatagtactttaagtgtgatttatatcttatatatttgcataaaatttttaaataagacgaatggtcaaacatgtgagaaaaagtcaacggcgtcatatattaaaaaacagaggtagtagttgaatagggtaatatggtgttctcatgtatcaacactaacctataaacggatgcctgcctaaatcgatgctctttcgataaatgaaaagtacaaatagcacattacattgctagtaagaattgtgttgattcttcaattaatatactctacatccgatccgcgtcatccgctctaatgtataataatttttaaatgccgagatacctagctaaaagttgttatatttgtatagttttatttgaactcctaaaagttgatatattagtacgattttgtttaaactcttgtgttcttgatgaacttaaattgttctcatgcgtaaatatcactcgcctctaattatgctttgcattttggtggggaatagaatatcagttttcaaactagtgcaactatggccctatttggtagggctccaaactctaactcccagctctaaactcctacaccagttggagctagctcctattagcgttggagacccacccaaaagtgtttggtaacctttaactccaaatctgaaaaatatcaaaaaaaaaagaaaaaaaaaggaatccccg

SEQ ID NO: 61261 - DNA, 17397 bp, Oryza sativa
  unsure (1)..(17397): unsure at all n locations
ccccgctatcgatcggctgtgcgtcgctcgagcatggtctctgcgcacaccgcccgccgccggccgtgcgccgcccgagcgtcctctccgcgcgctgcctcccttgcaccacctgcccgcccgcgtcggcgtgttgcccgtcgcaggccatgcgccgatcgcccgttgtccccgctcgcgccgaccgcccccgtcggagcaccgtcgccgcctgtgcgtcgtccgccgcccccgtcgaagcgctgccatcgacgccgccgccgctgccgcctgtgcgtggcccgccaagcaccgctgcccgtgcgctgtcgctgctcgcatcgcccgccgccgccgttcgcccgcccgccgccgccgcaggagcgtcgccatcggcccgccgcctttgcccgcccgtgggagatgaagtttcgggggagagagcggggggaggtgaggaggagagtttgggggtagttcaatggtatatttttaaaaatatgttaaaaaattaaagggtaatatgtcttttgggttggagtggagttgtagagcagtaaaaacttatctccacccctgtagttcattttttaggagtagctccgttaactccaccccaaaaacagagaatctggaccgtttggcacagctctggctctaggtaagttgaagttaggagctagagttgtgccaaacaggccctatacaagcggacaagtggtgttaaacacatgtacgctaaggctgtgctcgttagtctggcttcccaacccacacagcatgcacggaaaacggagcattccattagcacgtgattaattaagtatttgctattttttttcttaaaaatagattaatatgattttttatgcaattttcgtatagaaactttttgtaaaaagcacaccgtttagtagtttgaaagcgtgtgcgtggaaaactagaatagggagttgggaaccaagagttgcgaacagagcctaaggccctgttcagtttgatgccattttcaattttagcattaccaaaattttagcatagttgccaaaattttggcaggatttcttatatagttaccaaaatttgacagcaaactaaatatagccaccttttgtaactttaccaaaatttagtaaggttgaaaatgatatcaaaataaacaggccctaaatgctgttaaccaaaccacctcccaaaagcagcaatttgccccaaaattttcggagttccacacgtgaataatcacttcttcgtttcaggcaggaccgcatggctgcatgagcatgaaaaaccctctgtcgtgatctcaaagaggctccacatggaagagaattgaagtactcctactagagactgtgtagtgtgtacacactgtacacggtacacctcaaattttggaccaaatcggcgagatgcaggacaccgtgctcctactgtagcgcatttaacaacacgattcccattgtctccggcgccttcctgtccgtctgtgtccttcttcccatggaccagccggtcctacagtctaaccatgcttcgggtctggctggctcaagctggctggcaatggcaatggcaaaccgtgcgctgcctggcgcgcgcacatatctacatggagactcgtgacctcgcactggaatttttcggggcctgggcgtacgccgactgacacggctggattttttcttatcgtttccatgctcttgactttgatgcatgtcccttgtacaccccctcttctccctggtgtttccatgttactctatgcctgcgcctgagtactttagggagtagtagtagtactggattagtggagagtgggagtacgagtagttcttcattggcccccgttcgaggaggaaacaatggcacgtgaaattgacagccgggggggagtcgtcaaggtgagccgttcgtacgtagtatagctgaccgctgacctgactactagtcgtacaagctgctcctactacgttctgtcactggtacgaggacgtatggacggacggagtagaggagactggagacggagacacggagtttggccgccgcgccagcgtgtacgggctatatgaacgagctattccgcccgtgctagtgctacggtgtgcgtgcaccgtggaccgtacgtgccatgcatggaacggcaggaggcagaggcgcgccacgcggcggaagagatggggttttggctgggcgccttggcgcggcctcgctagcctcgttccgtcacgccgcggcctcaagaatacagcagctagctaacacacatgtccgcttgcggcgcaacgccgcggggagggccgggggccgtttggagaggcggaccctgcgtcgtgcgcgcggcgatgtcgggggagcttatatattgtcatgtcaggtcgacacctatcgtgttgggcccgtttgcctccaattggagagggtccagctttgcgtcgtagtactccgtacgcatactagctacggtagccatagacaatgaaaccaaacaggaccaccacacagccagtcacctcatgtcctccgcggtggcctgcagccggctaataacgcgccgatggggaagctacaattaactcgcgtggacgtgtacgcgtacagcgtactactcttcttcgaaaattgtctacactcgtctaggtcgtccttacctgtcagtacttgattcaactccaaccatgcatctcccatctcttcccgtaagatgtactcctactctgtacagtgtactagcaatccactaaaaccctaaaaaccgtggcaacatgtaatgccttgacgacctggatggcaattgacaagtgccttagaaaaaaaaaatccttgtccagcggcagacgttcgtacgcccgtgctcccggtggcacggcaactcgtcgcgtcaaacgctctgccatcgctgagagattgtccgggcctttttgagcaccagaagcgccacggagttcgctgcttccgaaccaacatgtcacatgtgagtgacatgtcgtagtcgcatcaaaattgaggcccgtgccgctgtcggcgtagcggcccagccattgtacccgtacgccggtgaggagcgcatgcttttaggttcagaaaatggctagtgttttttgtgcaggcactcgtgtttgtgtttaactttggccctgtttgaatccaatggctattttttagccctctctcaaatagcctaaatagccctaaaagatccaaaagggtgctatttgagggctatttggaaatagcccacccaaaaaaactatctcacccaaagggtgctaattggagctattttgagtggggcccactgaaaagtgtcttttctctctcccataggctcacgggattagaaaacgcgacctcctctctctctctctctccgcacgaccacgcgcgcgcaggcgcggggcattttcgccgccgccgcctccactcctcgccggcccccagcagcgccgccgcccccacctcctccccaccagcgccgccggccccgctccttgccgaccgtcaaccacgtcgccgccctcccccacttgagccaccaccggcccccactgctcgatttgttttcttgtccatggagggtggtggcttcgatttcttctccgaaccccactgctcgatttgttttcttgtccatggagggtggtggcttcgatttcttctccgaaccccactgctcgatttgttttcttgtccatggagggtggtggcttcaatttcttctccgaagatccaaatccaagcgtctggccgtcggtgatcggccccggccatgctcctcctccccatgccggcgtggatgcgttggatggatcagtgcttatgcaatggaatgagcagtacacgcctccacagagcaatttgatctctcttttttaaagaaaaaactttattgttttctccctttatgctacaagcatacgagatagagcactgtcctagtgatagagcacaacagcatggcatatgcagccggccacaccaagacacatgcacaaaagatctagtggagaaagagagaaaatgggtagttatgattgggaaagtgtactaaaggtcaagtagctcttgcatccaaacagctcaagggctatttcattgaagggctatttcttgagctaaaaaaatagctcttaaaataactctcggctactcctccaaacagggcctttgtgtggttttcctttctttggtgctttgccaattcgtcaaagctagtgggggcgatcaaaggatgaggaagatggctactgcctttgtgtgctttatcaaaagcgatggatccagtatccactacgaatctagtctaggaagaaaaacaaggcagagcaagtcaattcaggaaagggttaaaaaaaacgaaaagaagagcaaagaacataccaaagccggtaggtccaaagtgcaaagtccaaactttatgtcaaaggtgggcgctgcttttcttcgctagtgcagttttttcagcgtgacaactctgtaattcttccacggagaagaattacgggtccacaggccgtgccgattgggataagcaacccaatgcgcttaacagaccagtccgcgtatcaattattgcatgattctgttcaattttgcgcacacttcaacattttttatcatcttatcaaaccataattcaaacacgaactgaaaagtctacttgtcttggcattcaaaacttacatatgtcatttgcatgtacagtggcgtcttacttcttaggtggtgttttgcaaatgggaaagggaaatgattttcaacccatctttaaattctaaccattcattctccctcttatatttaatcctaacccttcattcattttccaatcctaatcccaccccccatttcccattattcaaacacgtccttagtgtccaaaacatcttacgtataataagaaaaaaaaattatctcaccttgagacagagtttgtcaccaaattatagagggggaataaaacagacagcatatgtcaagttgtcgaccaccaacgagtgaattggcagtttgacacagcatgagaaattttaagctcagcccatgagatcaacctccctcccctgggcctgtatactttgccttgggccgtcgcttggcgtgagatcaatgaaggcccgctacaagtaatgaactcagtgttgcttgcttaaagttttttttttttgggacgcatggcattagcacccgttaaactatcaccatcgacgttccacgtcaaaccaacacaacttataggccctctgcaaggctggtacacactcactctctttttaaggcaaatggaataacattatggtgcacaaattgaatcattttcattaataatttgcatgaaacatttaagatttttcataaaatagtatgagattttttacaacgttgtaaaaatatatacattgactaacataaaaaatatcaaaaacgaaaatttcggaacaaagccttgatactttttttatgttccggtattaccgatatcactatcgtttccatttatgttatttcgattctatttaaatagtaataatagcgtaactggtttgaagattcctattaccatactcgacaatttccattgcctagaaaaatgatcctaaaatgtttaagattgagcattcgacacaagatggaatattgggtgcattagggactccatgcatttcatcaccatacaacctccaatcttatcttctcttccctgttacctcgtgctcctcttgccctaaagtttgcttgcgcagctccgtcactaggaacgatctcacaaacgacgctacaaagggagaaggagatgcggagggataaggaagattgagcgatggcggtggcttggccattggctcaagtgcgatgaggcgaagcacaacgatagttggctacgatcgaggagcttgtcgatgaggaccgccatgagttccaagaaggtagcatgaccactgcttcctgtgggtagacatgcgaacccccgtgccccttgctccacggctttgccggttgtcatgtcaacaagatgttggttgtgacctccttgataaggcccagatacgactctggtgggtagaagaagaaggtagtgtagcttttttttatatagtttgacgatgttgtaatccattatttccttttgttgcacctagctgcgttaagatgttccattttgttctgaatgaatattgaacatattgatatatttgtgttgtaatatatagttttcaagtgttacacctagtgaaaacttttttatcccagcgatgaaacattttctcgaagtgatgaacattgaatttttttttctccaagatacaaacatctgaaacattttgttaaagggcctgtttagatccatttgaaatggcaaatggcaaatggcaaaaattttggtggcaaaagttttggcattgcaaaagtactagttggtgtttagatgcatgttaaagttttgccattctagcactaaagtgagagagaaagagagagggagtggtcccaaagcactttttggcacaatttgctattatgggctagcaaatgccaaatgccaaattgccaacttttgctactagtgtttagatccaaaatgataaaaagtgctacaaaatggtaaaacttttgccattttgaaggatctaaatagggccaaagtaattttcactgagcggtaaaacacgcaccttacaccatacgatattttgaagatccgacataccgtatgtaccatccgtttcatcacgctgtaaaccaaaggttaaagtgttaaaccacacacggtagggctgccacgtagtcacgtagatatatgcttcttgtccatgtaatccccggcacgtctcggcccaccgagcacgaggcgacgggcctccatccgaggatcgtcacgttgcctttcagattccgtggcccacgcaccaccaatgagcccacatcaccgcacggagaaaaggacaggagacggaggcactgccccggtggtctctccctgcccgtgggacccaccacctcccgggcccacctggcactgtggtggatagccgcttgataggttccgggcctgacgtggactaccaaataccaattgccatggtccaatatggggtccgcgatctgggcctgcattgattcggccattaaaaaaggttatcgtctcgtcgacgtttttcatgggggcccaattcgctagtaggttgaggctgctgtcacgccagcatggcctcgtccctctggttgacggtctcaattttgtcactttcatgttactcaagaagaaaccaagttttcgtttttgcaaaaagttcacttactttcctatgtaaatgagtgtttattgaaatgtttagcaagactagtacaagaggttatagacacttacagtccaaaaaggagagaaaaatccgtccattagcgtccggatagtgaagtactaccacaaacctcgctgaaaatgatcctgattctaggagattgctgacagtactcgactatacaaagcataggataatctgtccgtctctgttacctccttttaactatgataacgttgcttttgtaaggttcagaaagtcctcatgtctgtatccttaaaatatatatcgtatggttttgctaattttatatcgatcggccacaaccacaagtatatcatggccacaatagttttatatactattatatcactgtttatttggttcaggttcttaatcggaagtcacttcaacgtcatgcgaccgtgcttcacgcgagctctataaaatactactgcaaagcacgattgtttatccatctaggtttcacatagctaatctatatttctgtgcaccgagatctaaaatattccaattataaaatgcatgggccacaagaaatctaatgctggtaccttgaaaccagtaaaaatgtttctttctttttaaaaaacatatgaccggcttgcagatgtagtataaccggatgtacatctcacaacttgacctggtccgttgcacgaacgtcgctgctgaattgctcaccacgtctagctttcaccaaactcgtactttccatccccgtttgtcttctctatcgcgatagcaaagcccgtactccgtgaagaacaagcaaaacgagatgagtatatcgcgatcgcctgatacaatcacagtgtactacgtgacactgtgacaggttcaaattcgtgcggagcaaactgaaaatgtcactgttccttccaccactagtagtagaagggtgtgtttacttcgcaaattttttttgtcatatcgaacgtttgaccggatgtcggaaagtgttttcggacacgaatgaaaaaactaatttcataactcgcctggaaaccacgagacgaatcttttgagcctaattaagccatcattaatacatgtgggttactgtagcacttatagctaattattgactaattaggtttaaaagattcgtttcgcgatttctatccaaactgtgcagttagtttttttatttatatttaatgctcatgtatacaaaaattcgctgtgatgttactagaaaaaaaatttaggaataaagcaggccgaaaccacagtacggtactagtaagtctgattattactccatgctgttacagaaccgggaggatctgcttcgagaaacgaacaaacgcagtgacgttcagatcagcgagtctattttactctctctgccgataattatgccgacaaccgcagtacattctacctgctacaattacaaagccaggcagtagcagcaacaatcgtcaccggaatattccactcggtgtggtcggtggtcaggagcaccaaggcaaaagtcgcgagagaatattccggcaaccatatcgatgattttttcagttttccactgcaccacctaccactagcagagtagcagtagcaagtagaacacatcgcaacacattcatcaaccttctccatgcacttcaatggcatgcaagcagcaaagcttatacaacaaccctgacgaatcatcgaaacagatggcactgaacgctgcacgagctgctgtaaacacaggcagtttatgtcgtactctctggtgttccggctcacaataactagctcaccgtaccggttgttcctgcgtagtactcctactacaaccagctgcagtagtattgaaatctactgggagttgtgcacagggtttgtaaaacccccgataacagcatggttaccgtgcttatcatgggttaagtacggtaaaaggtaaaagaaaaaccgtagtaaccttcttaaattcaaataaatttaaaaaataattaatgataaattttacacggtttcgtgctgttaccgtccttaccgccggggcgcggtaactctagtcccggcggtttgggaaactctggttgtgctctgatcccatcacatcgccatggtgaaatcacaagcttttgttccaagttccgaaagggaacgacgctttcgcggaggcggccggagcaggcggcgccgtggccgtggaaagcgcgaagccaaagcaggtcgacgtcgtcggatcgctgtccgcgaggcgagagtcccggtcagtgaggaagaagccaacggctgctcctcgtggccgccgggcccaccgaacagcgacactgttcaggccgtgggccgttcgttgagtcgtccccttccttgctcagccagacttcctcaaaaagtcctaattaccatcctactgctagtgacatatttatggtccattttggatggcatatgcttacattagagctcagatgagtttaagtagggaagtgagagctagaaattggagaggtaatggagtagtaggattttactacactgcagtgctacagctaatgtgcgcgagaattggcaaaagagactagagaagtacgtagaggtccattttttttacaaaattgcagataagaccctgctttcctgcagaattctttattcccccaggcatagtgttttccaactctctctctcggctgcggttacgccggatttgcttcagttccagtgctccgtgggctcggcccaccacgacgacagcggcgggggctgatcgtcggcgaagaacccgccgcacggctcgtcgtcgtcgaggaaccccgtctcgtcctcctccaccttgaggaaattgccgtggaagaacacctcctcgtggctcgccgccgccgctgcgcccgcgcccgcgcccgcggcgggcggcgcgccgagaaacgtgcacgcctccggagccagcgcgtccgtcgccgcgggcgcggcgccggccgcgtccacgtcgttcagcaccgcgcttgagtcgctgtcggacgacccaaatcccgccgccggtggcccgtcggaggccgccggctcctccttcaccgacgtgaagctcgccgccgcctcctcgtccccgagcttcgccttcagctccttgatctgccacaattcgcgcgaccaagaagccatcagacattatgcgcgcaaacgaacgactgctcgacgcagtcacgcagagcaacagctcaggcggcacggcagggcagcgactcagtcggcacgtacctcggcgaggagggcgtccttgtcgcggcggagcgcgtcgtgatcgaggcgcagggagtcgtaggaatggcggagcgcggcgtagtcgcgctcgagctgcttggtcttccaccgcgcgcggcggttctggaaccagacggcgacctggcgcggctgcaggccgaggtcgcgcgccagccgcgccttccgctcaggctcaagcttgttctccacctcgaagctccgctccagcgcgcgaacctgctccacgctcagccgccgcttcttctccccgccgccgccgcacgccatcatctcctcctccacgtccccctccgcctccatcccaacccctccatatccatcatctaatcaaaacacgcatgtacaattacaaaacactcaatttcccgcacatatcacactacaccatcacctccaaagaatgaattgccacaaaaggaaaaccaaagaacaaagattaccactagaattagccatcgtgacgagcgatgggctgcctccgccgccgccggcaccgccgggtcgcttcatgccgagttctagtaaaattcagtgaacgcctggtcgatctctctctctctctcactgcgagaagacgacgggcacagaagcgtaggaatgacgcgggtgcctccgtcgctgagtcctcgccggtcttaattccacgctgcgatccatggccaaacaccacgtagccaagtccccggtccaaatgctgcctagaattgcaattttgttgcgcggtttctcatgatccaagaaagggaccaggggatgagagtgtggagtgtggagtgactcttcttccctccctacctctctctctctctctctctttctcggtttcctttctgttttcgcaagacggcgcgctgtaccctgtgtgtattaataaaggcgagagagaccaagagagaggagaggagaggagaggggggcgctcgggttaggtagagagggggtggtggtgcggttaggaggtgaccagggttaacgtgacgtgcgtttgcatgctcatgtgcaagacagtacgaagaggcgcggccgttctttgcgttgagtccagtaacaaccgaacgaactagcgcgagtacgacgactgactgtactcccggcactgaaaaacgactgaatcgacgtctgatctagcgtccaaagtcgaatggatttttcacctttcgtaggcattagcttcactcaccaatggtgggggtgcttcctgcgttggtcatggcctaaagtttatcaactttgctatacgtccaactcatgtgtccgacgcatgtacgactgaaacggcagaaaaaacgagcaatgacagcgtcagatatgactacgcgtcgctgagcctcgttgttgtttgcttgcgtactgtgctttctatacactgaggccagaggctagtccggctgagacatgtatcgatatagcttaggttgctattaaaaggattcactccagatgttagattagtttaggccttcaggatatgaaaccaatatattttcacagccataacatgcaagtcctcttaaaaaaaccataacatgcaagaaaaaatgattgaccagacttgatagaaaaacaaggcaccatggcttcaatttccatatttatgaccaaaatcagttgaaaaatcaaatatggccatgtatatgtttgcaagcatggaaaaacaagagatgttgaaaaacgaattgagataaaagattaatagaattgttcatggggcctagaaaatcagagcctaaaataccttctgttagcttcaacctgaatactctgttgcggttgccgcaaaaaaaaattctgattaatcttaactgattggtatggataggagacgaaggggattagaatgagggtttagggtgagaaaggaaatgtagaagatgaaaagtcatggatgtgtatagagtaatatcgagaagaggaatcgacgtcggaatatggagcttcggctggagttgggcttttaaaaggcccaacaatcacagctcacgctcacagataacgccgtcgactagtcgtatgatggtcgtacaaatccgtcgtgtgtatagcattttcgaaagtttatatagccctacgaggactggaacgaggcggtggtcaaggttcggtcacgcccatgcttgcacgcacacaccgtctcacaccgaatcggtaggagactaggaggcggcaaccaagacgaactactcctccaaccgaatgctaatccgcgcgtaggcaagcgacggcgaggcggtggcggtgagagatgcgcggattcggcgacggatcggcggtggaacggttcggcccgcggcccggcgagaggcgtggagaagagcgcgcggatggtagcggcagcggcagcagctgctctgcttctgctgcctgcttcggttggtcggggcatcaaaagggggaagtgccggtaaaagccaagcgatacggagcgcagctttcctggggaatggtggagcgcgcgactgcggagctgcaggtgcacagtaaaaatcctcgcggaattgcggtttggtccctagattctgcggtaatacccctactggtgtaggagtagtagctcccagacccacaacgagggacgacgcctcacatgtcgggtgctgagaaagtggctttcgtgtggatttgagggaacaatagctgtgtttgcacgacacatggtagagagattttaacgtggcttagtcccagtttagtagagctctaactttaaaatttagctctagaagttgggttagagtggagctgtggagtagctaaaattcagctccacatctgtagttcatattgtgatagcactctacctaactccgctcctattttaggtggagctgaaactatttgtctgagctctagctctaggagagattgaactggaactggagctgtgccaaacagacccttaaaaaaaggtgaaaccacatactttctccgtccaataaaaaccaatctagtaccaaatatgacacattccagtattagaaatctggacatacatatgtccagatttatagtactagaatatatcatatccggacctagatttcttttttttggcggagagagtaggagtatgtgaaccagtgttgttgcctcctccttcctataataagtttgtttatagattctcacatatatctctaaaagtttttacttttaactatcatatacctgagtttatgaaagtagagaataattgcatttagagttgaacaagggtaaagtaattgtgttatgatttgataaattagagatatattggtcttttttattggtatgtgtggaatgagtgaaagatgaacttatttcaggacactggagtacatgtatatgttgttataccaatcgtggtagggaaatgtgtatgttctacactactaaagaaaagatttttgtgtacgagggcctctatagaatgcaggcagaccgtaactactcatgcctacaaaaatcgacctacttttttatttttgcatacgacttcttaaaatgcccacatgcaaaaatcaattttcgcagacgagcctcttgacatacccgcatacaaaaataagtaggtatgttaagaagtgggtctgccacattaaaagtccctttgatttgtaggaaatacataggaattttggacgattttaatcctatacaaaaaaaactcttatgaaggcctttgaaaggattgaatcatatcttatcatttgaaatttcaatggaatggacaattcgatagagattatgagcaaaaattagcaagagctctaacctattgaaaaatttcttttgagtctatctctttcatccggttcgtatgtttttcatgcggccgaatcaaatagtcattcctatgttttttctgtgttctgtaatcctctattttgcatttgcattcctatcaatattctgtgtttcttttttcctattccttcgtttttcccattcctgcgattcaaaggggccctaaaatatctaatttcctcctccactcctcactctctccccacccctctattatcatctccttgtcccactcctctcctctcctcacatgagctcatcttctaacccctctcctctcttcccattgcggtgggagcggcatcacccctcgcctgcccggaggcccgtggaggaggcccatcaaagacggagtggcggccattccccacgtagatccaccggctgaggaggtgcgttgacggcgacgacgacgacgagctgcggggaatcggtgacagcgacggcaaagacgacaagcgacgacatactacgacgagttggcgatgatgttactggcagaccgcacctagctaaggtttcgagtatttatttttggggatttttttctagattttttttgtgtgcagacaacataagcatccacacgcaacaattgagttttcgcgtgcgggtgcaccgcccgcatggaaaaatagcgatttttgcagatacttttgggcaaacgggcagctcaaccgcatataaaaatagatttcgagtttagattatcggattcacgccaagatttgtatttggactcctcttctccgatgatggtgacaccactactccaatagaggacatgcgaattagggtttggggttaattagggtaggaggaggagttagggaaggagggagtttacttggggcttagcacgcgagatggccatagacggtggaggatcgggggtgggtggtggatacgggcacatggcgaggtgccaaagctgtggggttgatggtaggcattgggccagtgttagcggaggaggtaaataaatcaagtggttggtaacagatttggcggtggagagccactggagatagagaagacgacaaagagggcctcgccaccatcgtctttaaggaggaggagttaagggtggggtgagcgggggtgttaggggagacttgacatcgtcgttcgggccttttggccaaccggcgaggctagggaagactgggaagggaaggtaaaaagataatgttactgtacacacatatgatttaggatggaaatttttattacaagttgtgtagacagtcctgaaatctatctatctattatattattaaaggaatataaaaaggagcctccacgttcgctctcatggcctagaaattctcacattaatcggagaaaaagaaaaggcggagtccatataggaaatatanatttagaaatagttgaaattaggaattaaaaaataaggaatattagaagaggagactagagtccatatacaaatacaattaggaaataactgaaattcggaattaaaaaatgtggaatattagaagtagagtatagagtccatatagaaatacaattaggaaataattaaaattctgaattaaaaataaaaaatattagaagtagagtatagagtccatatagaaatacaattaggaaatatctgaaattcggaattaaaaataaggaatattagaagtagagtatagagtccatatagaaatacaattaggaaataatataaatttggaattaaaaataaggaatattagaagtagagtatagagtccatgtagaaatacaattaagaaaaaaaatagaaattcggaattaaaaataaggaatattagaagtagagtatagagtccatataggaatttaaaactaactaaaatttggaataaacataataaaattaaaactagagtttagagtctgtataaaaatacaatttacaaataactaaaattcgaaattaagaaaaacatgggaagaagagtttaagatcaatataggaatacaatttagaagtaactgaaattcaaaattaaaaattaaagaatattgaaagatgagtttataattagaaataataaaaattcagaaaaataaaagaaataatattgaaagaagagcatagagtctatatagaaatacaatttacagaaaatttaaaattaaaaaaagaaatattaaaagacgagtctagagtctatataggaatatatataatttataaataactaaaatttgatattaaaaataattaataactaacatgtataaaaatataatatgaaaattcagaaataaaaataaataatattagaagaagagcatatagtctatatagaaatacaatttacagaaaattcaaaattttaaaaaaagaaatataggaatatatataatttacaaataactaaaatttgatattaaaaataattaataactaacatgtatataaaatataatatgaatattacacattagtagttttgtaaagttattgcaaaatttaaaattatgttatcattttaatatatttgaataatataatgagaaaacatatatgctattatatgtgagaaaatataatgatgctagccacgcaatctgcgcgggccaccatgctagttatattattaaagaaatagaaaaaggagcctccacattcgctctcatagcctagaaattctcacattaatcggagaaaaagaaaaggcagagttcatatagaaatacaatttagaaatagctgaaattcagaattaaaaaaaaggaatattagaagagaacactagagttcatatagaaatacaatttagaaatagttgaaattcggaattaaaaaataaggaatattagaaaatgagactagagtccatatagaaatacaattaggaaataactgaaattcagaattaaaaataaggaatattagaaatagagtatagagtccatatagaaatacaattaggaaataatagaaattcagaattaaaaataagaaatattagtagtagattatagagtccatatatagaaatacaattaagaaaaagaaatagaaattcggaattaaaaaataaggaatattagaagtagagtatatagtcca

SEQ ID NO: 61262 - DNA, 19659 bp, Oryza sativa
taatgtaatcaccgaagattctctgtcccatttctgcagacggcgacccgaaatcgttttctatgagcttgtcgttgtggaaaaagcagtagcggctttcgtaacacctcatttttttatctgtttaattgcattttttatcctcccaaatctccatcgaatccctggacgcaaaagactagggacttttttaatcgatctgcgcgactatagaattcgtcccgaaaacgatgaatcgtaaaagctggattccttggatgttccattggttcgtgccctttgtgaattgtgatgtacgatcacggtcacaattgtaaagctagcaaaaggttcttgcagaatttcagccatggagttattttgtgatcatgcgtcttttgtttatgtttgttcattgatttctttgaagttatatatgtggccttatgtgcctataaaaccaaccacatcacatcaatcatattagaacaactgaagagtccaggccttgacacatgccactcaacatgaaggtacatggagtaaaatgttgaactagttcagacatatttacaagaagaatagatgaccactttgtcaaaatttggaatagttaaaggcattaatttcttctttgcaaaaaaaaaaagcataaggtccaataagatggggggcatgtttggggagcttctaacagctgcagtttctactagaatcttcagttaccataaactctcttaaatagtccagattttcatccagattctgagaatgtatttgtagaatctaaaaaataagctagaagttgagtttcccacatttttcaaattctcactagatatttctcagaattttaagcttccctaacattaccctaatcacctttgtcaaaactaggaacagctgaaggcaaaaatggtataagttccaataagattaaacaaataaattgtagcttacatcagctagattataaaaaaaggcaaaatttgctacaggatacccaaaaaatgtgtaattagttgtgggacaacgtaaagacgtgaatttgctcgaggacacttcaaaaaatatgataatttgctacaggacactggacacattaaaatataatatctagtcaattgatgagagagaaaccacgtaaaatgacagttttgctcttatcttcttctcccttctctcgttcttcttctgaatatcctcttgcgtgcgtaccctgctgcgagtgcggtcacaggccacgcccgccgccacggactcctcgccgttgttgtggtcacgaccgccgcgccagacatctttttcttccacttctttttttcggccactagcacggaacgaccgctatccgtcggtgcgctagcatgagagggtagtggggacaggaagaatgactcgcacgcatggccggctcagcggcttaccgcagagctggaggttgtcggcgaaggactccggcgagaagcgtgcgagcaaggtgttggagcacccgtgagcttggcgacgtcaggcgggacagagccaggaagggaaaagaggtcacctgggacatcaccgaagaggtggttgcatcgaagggagagcacccggaggtagaatccgatgaggctgacgccaggtaggcggagaccaaggacagtggcgtgggcagcgtcgcaggcgaagcggacccagtcgtaggccggcgtggaggagttccaagcgatcggccgctggtgcctgtgcccatgcgcgctccacacgacaaagctgtggaggccctactctaagttgggcaagatcgagaggaagaagaagacaagggcaaaattgtcattttacgtgctttctctctcatccattgactgaatattatattttaatgcgtctaatgttctgaagcaaattaccatatttttggagtgtcctcggacaaattcacgtctttgcggtgtcccacagctaattacatatttttttgggtgttatgtaacaaattttgcctaaaaagaattcttgaaaagaagaagattgcagatagtagtatcttgggatgacaatagtcaaggaaaatgctcaaaccgtttttctcggaaaccaaattgggacgtacaccaataacgatatcagtaatgctgtagtatactatttttgaaacgaaattatcgaaataaagcctcaaaaacaacatactgtcataaggatagtcacagtatgtttacattttaaattagcgtcatatacaactactagtaaaaattcaaagtattaattaagtactacttaatacttttgtggttaagtttttttttaaaaaaaatgataggttgacgatactcatgttaatttcttccgaaattccagatgaaaacggtatagcacttataaaaaggtcagaaaaaatcaggatcccggttgggtccatcactttgcatatttttattaacggccttatttggataaaataaatcacgtataagtagggccactgatataggtgtggagtgtggtcaatttgttggctgaagctggatggctagacaaacttatatttatatatatctaggtaggtaggtccatcgtatggcctacacggttactccctcttgctagtattcaggataggatcctcatcctctcccagcctcatgcggctacggataagaatggtgcggaaacaaccaggttttacggtggccgttgtggttgatcggagcctcggataagaatggtgcggaaacaaccaggtttcacggtggccgttgtggttgatcggagcctatttcgttcgaggttacagtgtggcgtccgtcgccgtaggtcgtgagcatctacgtcacgctgcgtagctactaacgctagctgaggacgacgatgatgcgcggggcttggctgccgtcgctgaatcaaagggaggtgccgcgttaaggagcaacgcgagcttggcgtcagagctgatggacatgggttgtcgcgacagtcggggatggtgctgtcgtcggagtggatagacgcggagcaaggacacggccactggcgacaagctctgacgtggcgtggaaggtggaggatgcggccatcaacgactagctccagcgtggggcgtggatggcggaggacgcggccgctggcgacaagctccgacgtggcgtggacggtggaggatgtgaccgttgtcgatgagctccggcgtggggtgtggatgacggaggactcggccaccgccgccgagctccgatgtggcgtggacggtggaggatgcagccaccggtgatgagctccggcgtgagacgtggacggtgggaccaccggcaacaataccttggtgtccggctcctgataccttgcaagtatcacctatacgtggtaggaatcgcctgatatctgacaggtatcacctagcgcgtgatacctctcaagtatcacctatatgtggtaggaatcgcttgataactgatagatatcacctgatacgtgataggaattgtctgatatcggttaggtatcaggacctaatatctaaccggtatcatcccatctcattagcagctctcaagttttgtatgcccaatgccctgcagcacttgtgcaccattgcaagtttgcaactgctggagacctggagtagactgtaatttagcagctagatgtgctgaatgattcataaatttgcatgactcgagaataaaaatttggtatacttacttgatccagtactaatgtactatacacgaatgcacgaaacagtgacggccagggtctgctacttagttgtacacaagcgcagtcgcagcctcgcgcagtcccactcgcataacaacacggtgcaggttgccgtgaaatgatcccttcaggtcgtctcgatctctcacgggcagcgtacaagtagtagcagtacacgcacctgttggcgttgggcaccgtccgctatacctcctcctgacctcctgcctgccgccggagaagacaaaagtggagcgtctgggatgtctggaaccgtacgccgtgagattccggaagaaaacaaacgcaatgatgtgacatgcttacagcgacaaacggaaacaggcggatgctcaccgggattggggaaaataccctgtgtgctgcgtcgcaacgcaacttgcccacttcactcgtcctgatgatttttttctctttatccccctcctgtcttcctcgtttctttgcggctgcgtgccgtcgtcatcgtcgcacctttgcattggatcaagttggtgacccccgcgctttccgttccacgattgggcgtgcaggtttgggcgtttctgtgtgcgatgcgaagtgcggtacgtgctcctaccacgcgacgcgaggggatgggcgtgaagttttttgcgtggaaccggaagggtatcgatatttcgatatcatctcgccatcattccggcgtactacgtggattgggttgggctaggcgcggcctggccgcgtggtggggggcgggtacgtacgtggtggtgtacgcgcggacggcgcctgcgcctgcgtgtgtgcctgcctgcctgcgctgatgacatccgggcgcggggcagagcctggtccccttccgcggtggtcagcagctgaaagccgcagggcccccggccgctagcctttttcttcttccccggcctcctctcctcgcgccgttgccggcgcgccgcgcgcgcccgtcgaccgcgtctactcgcggagcatagccatatttcaccgtgcaaactttcacttgtcagctagttttgcgtgacatacactactctacagtctacacatgcatgtagtagtggctaacgtattgacttttaaacaagtggatttgaggctgcgttcgttttaggtgatagagtgagaatacacatccgcgcgcacactttccaaagtattaaatggtgtgttttttaaaaaattttctatatgaaagttgctttaaaaaaatcatattaatccatttttgaaatttaaaatagttaatactcaattaatcatgagttaatggctcacctcattttacgtatcttctcaatctccttaatccccttctcctcaaacacaccctgagtcgattctgtacatgcgttttactgtgctggtgagatagcagcggtaaggttaactcgatgcgaaagggcgcccggccggcagaagggaccgggtttttactgtagtgcagcagcagtgttttgggcacagtaacaaccttacagaacaaaaggaccggggaccaaaaggtgattggtgatctcactgggaaatggagaaaacccaacagcaacgaggaaaggttgtgggggcctccaccacacacatgttcttctccggtaacacaagggtggtaaacgtgttgtgtagcacctcaactttctttcaacaccttctccatttacatttactgcatgacacggttcatgctcatgttgaagaaacggactggtgaaaggaagtggcagcagagttaggaattttaacttgtaatgtaaaatatcgttgctttatgttttagtgggtcatgtttgtaaatttcaatcgattcaccactggtagagaaatgctctttactcccggttggaaacccccctatagtcccggtttttcaatcgggagtaacaatctgggactaaagatagcaatctttagtcccggttcaaatacctgggactaaatatcgatctttagtctaacaccaaccgggagtaaagaggagaatctttagtcccggtaaagggttagtcctagtttttttttcattgttcctttgaatattgatttcacaccaatctctccaaaatcataaaatcaatcacaaattccaaatcgaaatcgagatggtcccaatatccccagatcaaatagcaacatcacaaatcataatattcacatcacaaattatcagaaaaaaacatcacaaattctaaaaaaataaatacatcacaatcacaatcacagatacatcacagatcacaaatacatcacagattaaataacacagatctagatccaatgaatcacaagttattaaaaaagaaaaacaagaaaaatccagccgcctcctgccacgggcgacggccaccacctcctcctgcatgggcggccgccacctcctgccgcgggcggccgccaccgccgcctcctcctgcgcggacggccgccaccacctcccggtacgggccgccaaccgcgcccgggtccccgccgccgcgcttcgggggcgagctcctcgtcggctaagtgttgagagagaagaatagaaagagactgagaagaggataaggataagtgtgtgagagaggaggaggaatacgagatagaaatttttgaggatagcagcaagggattatatatatatggtatatttgatttttagtcccggttggaaacaacaaccgggactaaagttaggattttagtcccggttggtaatatcaactgggactaaagaactctagggactggcatcctctgacatgactaaagatgatctttagtcccggttagtgttactactcgggactaaaaatcatctttagtcccggttgatgacacgaaccgggattaaagatgatatagtccccttacagttataaactggcactaaaaatactttttagtcctgatttttaatggaaccgggactattgtgaatttgggtgaaccgaccaaagatggtttctccaccagtgcacatataaaaatttagtctcacgagagggtttacgaaaaagttatgccttctacagtaaagtgtggttaacatatagtgtagcgccttgtctttctttttacggcttattcatttgcattttcataataacacggttgagctggttagaccaatagattgatgagaaagacaaaaccgattaatgatcgagataaaactctctatgatagtcgatcgactcgactgactaggttaaactctaggtattgtcatggagctctcggggaaacacttgtggaagggatagaagacaactcaagaatgtagttgctctaatatcatacttcctccgttttatattataagactttctagtatatatgtgtctagattcattaacatctatatgaatgtggataatactagaaagtcttataacctgaaacggaggaagtatttaacaataaaagatgagatcatactagttgaatagtgaatgtagtgtactgagattcgcgtgacaatatatatccaaattatgtgggtaaaataaaaaggcacataatcaatacaagtgaattacattttgctctaattaactatcatatatatactcttaacaagctgtagtaacggttgtacacccacagctagctaaaccgagcacgccctacaattcgatcgtgtctgccttcattatagctactagcaaattaccttttgaatgcaagccagttaaagatcgttatgtaaactaaaatctccacgtaatgacacaaacagtccaacagggcagtcaactaagagaggcagtcatgcctgcctaccgtaaagattaatgaacctattcatgacaggtacatatgcatccaatgaatttttttagacatattcaaggaccagggccccaatttttcagcacacgttagctaccccgtccgtccggaagaactaccggcacaccgccgatgggcctcccccccctgtcgcgtctcgttagtccactgccgtgttctctttccaacctgtcagggaatcgtctagtaaacctagagaagagagagagatagaaagagtgtgtgtgtgtgtgtgagagagagagagagagagagagaggagaggagagggaagggaaatgaaggggacgtgccgggccacgccacggaaacgactcggcaaggagccaaagcgcggcacctgctgcccccaaaaggcgtcgtgccgcggtgcatctagctaggccggacgggctaggaaagcgatgcatggtgtggcccaatatattgaacacctttttctagctccacgtccatccatccgggtacgtacgtactactgtgctagatagctcggcgctcggcgatgcctgcacggaccgaacaaccggtccaaaccccacacacgcactgactgcacgcacccaccaccgaatagcgaacggattccttcgctttcttgcgtgtgtgcgtgcctgcatgcatgcacacgcacagcccggctggccggcgatccgcgcaaaagctcacggctttaagtagcctctctctcctctcttcttcctgcccgatcgtcgatcgatgcgatgagttggccttcatttggtcacccggtcacccactatggaactcagggttggcgttacggcgcgataaccgtagttatcacacttacaatgaaggacggtaaaagaaaaatcacggtaacctatttaaatttaagtaaatttaaaaaataatttaaaattttgatcaattttacacggtttcgtatagtttgtcatagttaccacggttaccttgcttaccgccgaggtgcggtaacctggtcctgacggtttgggaaaccctgtagtatggattcatctgttagagttagttcttttttcgtgagtttctttcactgtagatgactgaaactttacacggttcagtgttggggcctgaataaaactctgtcaggtgagtaggaaaagttagcgagaggatgctaaaagctcttttgtcaagggcgaccatactgtcaagttggaggaaaagttccttccctttcacgctttcggacgatagactgtgcagcatcgtgcatgagagtggcgttcggtttccattagcagttaacgcggttggagagagctagtgtagggtagtggagagacatatttggcgtagctaagcttagctaggacacctctcggtctcagttgtcacggtcgttcgtatctctctctctccctctcggttctttttcatggtcatatatgtacaagcgaggattgatcgatcggagcaaaagttatttcactttgggtactgttcggtagcgtcaattcaacaccgcgaaaaggagcgcggaagcattccatatatatgctcgcgttttccttcgtccggcatccatccgtcaggttactcgtgcgtatgtactgcggcacatactactcctacatatacagggtcaacacgagagagcagcgcgtaggtgccccctaccgccctacccagcgaccagcgtgacgccagttgcgttcgaattgagatgcatgcatatcgcggtggtcctgtgtattgaccctatctcaacttcatggagccacaccagaagagagaaaattacggtacatgtaccattcaagccgtggagaaaccacgccccggtcggggcagccagccatcgccatgcacgtcggtctcgacgacatcacgctccgcgtagttttccgcgcgggtgggcgcggtggatgcgcgagacccggacgggcgagatatttttcgccggcgtcgcgctcgcagccacgcaccaacgaacacagtaccagcgcgcgcgcgcggctgggttgggtagctaggttggaccggggagcgggtgcgtgcgtggcggcagcaagcgaacgagcgagcgacgtcgcgttccgtggagaaagcgaaggacgggcgggtcgccgacgcggacggacgcaggggcgggaccgcgcggtttggctgctgctgcgcgcgtctgcttttgagttggttatgatcaggtggtccaagagcagaggggggaggggctgggaccatgcggctcggctccgctttcgtctcgaacagtgcgagcgtatcgtacatgtgatgtgcgtggtggtgtgcatgcatcagcagcattcagcgccgacggagagacgtacgtgccggggtcactgatatggctttttccgattaactgtgctgaggtggaataggtttttgtttcgaccccaaagcaagcaatggcgttattttcatttattttgggagctgcggcgcgacatattttctcggcccaacaacggtagtttgcatgagggcctattttgagttgggttggttctaggcccaaaaacattacaaatggagtagggcacgagtaggaactggagttggattggattatggcaaccgtgctcctataatccggcttctcgcctacgaccatcaccggctcaaaccattcggtgtgtcgtgtctgcagtgtccaaatcctgctggatccctcgtagcagctatcgtacagtgtccaaaaccttcgatcgtctcctccatttgtcattgccatccgaccatccctatcacttactttgacatgaatccatggcataccggaaatcgcatacacaagctgcggccgtctcctcagataggcgtgtccccatgttgttctcaggagcaccctttcctcgatgaaacacccgctccttgcactaagaccattcacaccattcgcggtgcaagaccctcctacaaggggtcctatatgccacgtacgtagattgagaccacacctcttcaaatttcttctcccacaatgcatttgagcctagttggaccgccgggggaatcactttggacatgatctgaagtgtacgtactgtagactaactgactaagcaagttcaatcgttgcaaaggaaagacacagaacggttataacagaattctttaaaagaaggcatagctaagaatttcgcattgaggtaatcagattgacctgattttccattactctcttagttccctaatttacatttactatacagctgagctaaccgagcggccgagctgatcattttgaaggaacaaagttattctgttattgaactctcatcgacaggccacaaaagaaacatcccttccgaattcagtgagctccaatggaaaactttggtcaatttacaggcagccgctatcaatagagccccaaaagtttccaccagaaggttccaacaacaccccagatcagaatattgatcaaggctgttacgaaacccatcctgaatacatctggaagctcaagataccccgctgcagatagaaagcaacaaattacagagtagtgagaatatgaatttggaaagactaattatggaaccaaatataaaaggaacaacagcatagaaggaaataacaggttttctcattctatatctatatgccttatctgttatagcatgttgtttttgcttcctctgctctttttttttagggtaacccgtttgtaaatgaaaataatgaaatgaaatccagaaaagtagaacatgaatttacctccaaagtacactgcagcctgtccgctactataatgagttagtgcaccaaacagatttgtgttgaatgccaaagcaagagctgacagcactcgaggaacaccagctgctacatgcatggccagaaatgccgagtataaagctccaacatgtccggtttggcttgcaaatagatagtgatcaggaagtaggaagcctcaagaacacaaaaggctgcaggccagctcagcgagaaggattcaagcagcttggcaacacagcttgacatccatgacacaattcccaggttagtgagctgtcctgccattccaactagaactgcaaaccatgccaatgtatcccatgcagatttctcatttaagcaatcatcccagtctagcacacctagcaagagaagaatagagagtccaagcatcgcggcaacaacactagatacaccgatagcatccctacacagaagtcattttacatgatatttagggaatagttgaataaatatgcaaaaaaacaagagcatgatagtaagggcatattatctatgtacggtattctgaaacaactgcctgattcataatgctattgtcttcactatattaccctttagcatactaaaagtacaggaacacaggtgatctggatgcaaactaggattggtactaggaattggtcggagttagcttttcttctttttattttattttattttttaaaaaaaactacaagctgcaagacagttgcagctacagattaaagcaaatggtatcatcaaaagaaaaaacactcattttctatttgttatcaagatcatatgttagttatatgaaaaatcctactaataattaaggaacatttaaaaatctgacagactcttgtaaaaaatggtgaaccatatcagaatcaaaagttgaaatgaaatgtgattaatacaggaatacttgacctggtgtctacagggaaaggaaagctaactggaacaagctgctccctactcaaatatgaatgaaaaatcacacaagtattttaacgatgcaactattaagtatcttgctagcaggaggcaattagctgcattccatggaaagttttagtcaaccaaaaagcaacaaagaaaattatgtcacaaactgcaacattgtattgatatcaaagtcaacattatacgtgggagcacttgtactaaaggaggagcttgcccaaaaactcttcatgggactgcaaggatcactaaggcagcctaaggatgctactattaagtactctactatggtatatcaatataatcaaataaagggaaacatttaaatgctgcaagattggattaatgtgacaacgtaatattaagattgaggatgatgtgtagtggagaagcttacccaaatacccataatgaaactgcaaggagcattgtaccaatcataacccattcattcttagtcactggacccatgcgctcaagcttctctgcagctaatgctggggcatcaggagtatcctttgtttcagggggaaatattttgtatagcaagtatggtgttgctagtagagaagcaatggctggcaaactagcagctttgaaccatgctacccatggatttgcaacgataataccaagctcctctgctagcttcaagcacaacaaattttgtgctgcagcagttaggaagagcgcacttgagttaccagctgcctgttaaaaaataggagaagaaaactagatactctgtaaaaacatttctgaagatgatgcgtatacaatgaataacagaagtataggatgcacagaaacatcatgcatgacacaccacatgacattaaacacggcaatggtactaaacccaagagaattataaccggcattctgcattcttactgtttaatggaaacggtaagaaagcaaaatgcacaaagtcattctgcattcttactgttcgattagagagggactataaaatatcgttgtcttatgaccagatgaatcctctcttttccaaaaccttcacccttctgctagattgatgatgaactcagtcacataatattacgaccattcatgcatcaatggtggcattatgattaaaaaatacatcaaattgtaatttaccctgtaagcaggctaacaaaacactaggttgatctgacaatggcctagctggttgcctgatttcaacccaaaattactaggtaaggatgttctgcttgattgtaccaatgtgccacccagttctcactcccactccacttgtgcagagcccaacggcaggacacagtaatagtcaatgcaagtagcaatcgtcccttgctaaaaccaaaatttggttgctatgatcagaaaatcctggttgcaatcgatctatatgaacagatcccatgcgagtatgagaaattttatcacttaattacctggaattgcgacatcacaagataggatccaagcttccgcgacgacgggtggttcggcttgctccctgccgagagcgagagcgacttgatgatgggcaggaacacgcctccggccctcgcggtggtgctgggcatggccggcgagatgaacgcctcgctgatggtgagcccataggacagccccagcgtgctgcccccgagccacttgacgaagtaggtggcgatacggtcgccgagaccggtcttgacgaaccccctcgcgaagaagaaggagatgacgatgagccagatgacctcgttggtgaaggcggagaaggcggcggcgaaggggagcgtgtgggtggcgacggcggcggtgagccccaggaaagcccaggcgccgacggggagcgggcccagcactagccccgcgatggtggagaggaagatggagaggagctgccacgcctgggggctcacctcgggtgggcgcggcgcgaggaaacgcacggcgaggccgaccgcgagggacacgaggagcggggcgagcttcgtgccggcgggggccgggctgtccgcctccgggttgggtgtttgcgaggcgaggagaggtgggatgcggcggcggagaggcgttggggcgaggcgatgatgatgatgatgatgcgaggagagggagagcgaggtgtgtgggagggagagggaaacggcggcgatgtggcggcgccggagctggtgcggggatgggaggagcagaggcgggcggtgggaggcggcgatccggaggctctccatcggcgtcgacggcgacggcgaggggagtgtggggcggcggagtggtcgaggtcctcgtggaggcggtctcaggagaacgacttgtagtgcggcatttttgaaggaaaaaaaaaatcatagatactaacggctggttttatatttctatcgatacgaacgtggtgcgaacccgacccactgacatgggaggccacgtctcacgtgtcctacaggggcccacctgtcagtgtgttggggtgtgcaatgcccaggttgtgattgctcagttccaatgggatactcgggatcggagtgggccccagcggcagccggaggaatcgcggcacctatggctacctgaggctgaaccgagcgccggcgatggacccagcgagggcgtcgcggttgcgccgaacgcgtcggcggcagccaatggcagggcgacgcgtgtagcccctagatatacatgctcgcgagtcccctgccgtacgatgaagctctgacgatctggatggttctcacacgtcccgttcgcgatttggactcgctgcattctgccgatcgccacaattctcacgtggccccttgctccagcgctcgtgggatagtcacaggaggcctgctccatctcaaaatataagaaatttagataaatatgacacataaaggagtcctaaaaatattttaatataacacataaaggagtcccaaaaatatcttaaaatataagaaattttaggtggatatgacacacacagaagtcccaaaatataaggacacatacagcagtcccaaaaatatcccaaaatataaggaattttgacggagatgacacatagagtcccaaaatataagaaattttaggtggatatgacacaaagatttttgggtggatctgatacatcctagtatagagattttgtgtggatagaacacatcctagtacaacaagtctatatgtctcatccacccaaaatcccttatgagatggagggagtaatgtggtaaaccagcaggagtggacccgtttgtcagtgacaagactaatactccgtcaccatattcctcaaaaaaatagacatcatattcaggcctactaacaagaaaaactagtggatgccccgcgcgttgcagcgggatttgagaattcttaccgagaaacattgttgatcaatcttcacgtgtttcctttttttactcattggttgcgtgtttttttttccgacaaaataatgtggagtactccctccatcctaaaaaaaactctaccttaggaggggatgtgaccagggaggatgtgacccctactagtacaacgaatctaaatgaatctagacagttcttagttctttgtccagattcgttgtacttaggttaagtattttttggggacgaaggaagtacttgtacttaggttaagtattttttggggacgaaggaagtacgtgtttatcaagtgggccgctttcgtccactggctgctaagaaagaacgaaaatattttcttctgttacttgctaggccaacagcccactgggcggagaggttcgttccggttttttttttttttttttttttttttttttttgccaacagcaaactgaatacatgcaatgtttgaaggccattcgatcaagatctgactgttaatatgcgttaatgacgtggcgagctgtgggtactaactatataggaagaaaagatgccttcttgtatggaataaaatgttcttcgttaacaaaatgagtagataatgcttctacattaaaaccagtagaaattattttgcaacagcttacactacagacgacatgatgcatattctgatattcatgcattaatccgcataataaccctatggttccaaaagataggagtccaaaaacctttgtaattattaaaagttcaaaatccaatcagctatattcagcatatactgttggaaaattatatgctgatgaagcagtgaggcctacacctatgatgagttgatgaccaataagattcttgtgaaaacttgactttgttaaagaagtgggatcaccttcatgcgacagcactccaatcgcgcgtgtcgtggtaaacagttataaggttagtcccttaattcttggttctctgcctcaggagcacttggtaggaggcaagagctcaggtatgtcagtacccggagcatccattgcatcacgaggatacttcgcgggggtgcagcactccgatatgtcaatgccagcaacaaccattgcgttgcgaacccacttcggaacatcgccctttgggaactgtcaccaattggtttgagaaacgaccagccagtaagataatcatcaaggaaatagcaaaacagattgtaattttggttttgtagatggaatgggtagcacatattatcaaggaggcagcttagacatctcagagtcaggaatgacagaatttacttgtggtgctgatagtttatatataatattagggaacaagatatacctgcatcctcaagaatcctcgcacgaatctacaatatggcatggaaactttcttattcaccaacacagtgagaaaactgacaaatgacacaaaatttagctggatgataacatactctgggaatcgtccttccagaattgacatgtggaggtctctacttaactgaaataaaagtggatgatcaagcggtgacacttaaaaagaaaagttatgtggaaatattcattaatatacccgcatcataaatgatagattgtgatacgacagcagttgggaacccatagcatcttttgtgacaagacaatgcaagtaagcacgtgtatagtttttgcagacctgaaaagatagtcaagttatagaacacgaaatagaaacagaaaaagaaaaagaaaatttcgaagcagtttaacactttgttcccagtagaacgaagccttaccatacatggacaggtcggatctatcggtcgttcatcagttgccattgcgttttgtttcaacttcagaacaccctaggagatatcacaataaggttgcaaatgctaagattagaatcaaactcagaggaaaagagaaacaaaattattgtgagcttgcttccatatgttaatactctcatagattatgctaactggaataaattgttcaatatcactaagaccatcaaatcattccatgtaaaatattagtggcactagttatcagtgcgaaaagaagatcaaacataaatattttctctagcttgaattgtatagttgactttgatggatagataagttccatacctcaggaacaagtgcagtcccaaagcgagcagtacgagttggataaacacagtcatacatgtctgcacccaaagcactacatactacaatatcaagtggatagccaacaccctgcaaattagcataacagcaaggtcagccaaacaacccaaggaagctacatggttcaaattgttgtgaatcatagaagacaatatcacttttggctttatgagtactttgagaaatttgaaactataccataacatatcgtggtttatcttcaggcagtccagcagtgcactgggcaacaacacgccagaacgagtctttatcttcaccacctgcaagaccaccaatggcatatctggcaacaaaatatcacggtaagtggtatcagccattgaattgtagatcagatatgagataatatagcgtgcatccaccgacaaataaataaagagtgcatataaagcaggcacaacatctgaagatcatgcatcaatcacagaaaagacaaacaatttgtttttggctgcatgtaaaaaacttgcctacatatttgctacccatggaaagaaatcctgagagaaatattagactatgacataccctggaaggttccgctcaaccaagcccttcacgcagatatctctggaattacaaaaaaaaaaacactattgattatttcaattatgccttaaaggattgatatattacatgattagatggatgaactcacctaagaactggatctaatcctccttgtacaatcccaaataagttctggacatcaggtttcttatgagctatatgtattgacaaaagaaaacaccagaccttagctaaacatgcttagcattattgtaaatgttcttttcttaacgccagtaaaatacatagcagaattagagtcataatcaaaatgatgctaagctctaacttaacgacaaaaatagtgaaattaaacgccagaaaagtatgaaatacgggcagtggcaagtcatattgataaccataccagcaatgcacctatcaatccaacgaagggtacgatacatagcttcctctatccttgggccagtaattgtggtcttcacaacatcatcaagagccattattatatcagctccaatgttgttctgcattcatgttcaatggataagcatacacatgataagatgtaaaactaccaaatctattggcgcaaaactctaacttttacaagtacaaatcttgtctagaaaaggatgcacctgaatatggatagattcctcaggtgtcaagagcatgggcttcccatcaacaggtgactgaagattggtcaagagaaaaaaaatatataaaagatacagagagggaggcattttcagcagttgtaaaattccaaggaagaaagtacaggatgcctcacacacataattaagcaaaagaaccaccaagaaaaaaaattggcttctattactaacatcatagatatgatatgataccatgccacaacacttgactatgcaacatctgctagatcaaacggcaatatatatctgttcattcaagaaatatttatatgtttgtcgaaaaccatcagctaaccgtgtggttctcattagtctcacaagttcacttaagaatttttggttcatcattgtaataaatagcagtttacagggaaataacaagactacaggggatgcccagtacaatcagaaatattatccttgctcagtatattttccattagttttgaacagtctcaattcagctttaagaagattaaaaaaatcttataaacctccacagtaatacaagcatgcctcctgattattatatgataacacatggacagctggacattgttatcaataaataattataaactgtggcacatttgaataatttgatttggaagtatgataaacatcagtgcacaagaagttgacatctgtaaaagaaagaagcatcacaaagtagcctgcacaaatctacctgaaatgtaactccttcctcagtaatgtcagccaaatgtagcaaagaaacctaaaaagcatgtttccgatcagtaaaatttcagcagggaat

SEQ ID NO: 61263 - DNA, 6576 bp, Oryza sativa
cctgagtagagagaacagaaattaaaatgctatgagatacaataattcagagaacaagaaacattttgagaaatttatcatgaacttctgtgaactaaacaacatgaaaactctgcttctttttttttttacacaagaaaaactctgcttcagactgaacaagtgttaaagcaacagacacaataccttgagttccaacaggcataaacagtggtgtctgacaagtaaagtggggtagtgttaatcgagctgcacgagcacgattgaatcttcctaatacctgcaagcaagaataatttttacttcaggtttcgtcattatgctcaatgcctcatataagatctaccgctatgtcagccagccaccttccatcagttggacaataccgacgatgaggctggacagaaagaccatgatgagctgacagagtgacagtgctagaggtactaggccactctaacaggacgtgccacgtggcaattacatatgcccacattcatgcttttctattattttcctattacatggaccactaataggactataggtatattagcttaaccttagtgaagggtaataaacaaagaaaactcaagagatttaatcaaacaaagtacaggattaacaggaatacagtatgtagcaccaactgtagagtgtagagctaggcaatgacaaattacaacactgagaaggcacgtgcctatggcagcattggtcaactaccttctttaactaaatagttactaatccagagtactaaacgcaatcttaaaataaaacagtatcagcttaattgggaatctgtactcccagaagatcgtatgagacaaaaatgattagagtgaaaatcacatgtaatggcttgtcgactaaaactacagacagaagtacaaatcttatccacttaatcaccacaaacttcagccggacgcctagtttgcgtatgcgcaaaccagagaaaccgttgagtttgcttcgcatctcagcaatcaaacgcacaagcaaactagggaaaaatcatctagaatcgaagaaagaacatgcacccatttggaacttcaacaaacctcgaaccgaagcgccatggagaacaaataaaaattaaactccagccaccgagctggaacctgcgcgtccgtattaacaaaatcagctcagagattagctcgaagcaacggaaagaacagccgagacgcgcttcccgtttggcgccaaatacgatattgaacgcgatacggaaggggaatctggcgcgaccaaccaacctgcggtgcggcgctaaggctcgtagaaggggatgaacaaggccgcggggagatgagacgaagaggaggcggctccgaggggagtcaaagcccactctcgccggcggcgggggaggaagccctaacgcggttcttcttcggcgtgactttggtggcggcggccggcggaagcccagcaccgatttaaaaaggggaatgggaattttgcatggaacaccctcatctatgacatatttcattcgatgccttccattttgcatcctcctgcttctgggcaggctaatgaaccatgaggaaataaacatagcaagaaaaaaacatctatgggtaatatatttatattattattgttttaaaaccacaactgaaaaacagaccgatgaaaaaaatccaaagtcaaaatcacatgttggctattgctaataagttaacaagcaccaaattttctcatatggtatgtgtcttgtgtttggttaaatgtcatattctctttattataagcattttaaggttttcaaatcctattcaatcgtgtgaggtgtgaatgggattttttcttataggtgtgggaataatattggaaatttagattgtagaaagcctcctgtcatgtgctaactaagaaatacggagaattggaataattggatcatgactcccgtgtcgcctctctggtgacccgggaggcgaaaggccgacgcccagctccaaccccgccacgccccgtctgcctcaccgccgccggcaacgccaccgtctgcggtggtggccggcgacggcagggccgccctcctccctctcccctctttctccctgtctctttcttcctttctccttcctccctcccttcttctctaggtttgaggcttcccggaggcgtcggccccgggcttggttcctcctcctccacgtctcacgccggcgaccaccaacatctcctgggcaggtggtgagggggacggccagatctgacctcccaaggtccaaatctgacgcgactctggtgtgatccggactttgaggggcctagcgacgactgtgagggctacacgtgggcgagctccgcagtttcccgcgtgtcctagcgtgagagactggctggtggcagcgctgcaagatggggaacggctagatctggccctctaggtccagatctgacgtgtccaagctggggttgggcgaggaccggacctcaatggcggtggtgacgacgggtgggcctgtgtggcgccgatggtccggtggtgccgacgagctctgcagtttagtggtgctccatcagtccggcgaggtggctgagcaggtcatcaatgacgtttgtccggccattgtgcaggtggttgtgtgcatagtacaggtaccccgtgtgcaggtggcatttggtggcttccgacgcagacgctatatttggatgggactctgaggtgaaagccttgctcggcttgccgatgctaccaacgacgactcccttgggtgacgtttacctttttgaaggcgttgctattggagccctcgttcaaactccacatcaagggatttctccgggtgaaaaccttagattcgttaggatcgaacgatgtcgtcgttctgtcggcgtgtccttcttgaaggcttcgttttaggagttttatcccttgctggactgttgttcttagttttaggttcagtatatcaatgctggggttttcgccggttttccataaattaaccatgccgttgtaaggtttttgggtccggttttccttataaactggatcaactctcttcttctatagtaaattgtactaactccctgcttgtccccttagaaaaaaagaattggaatatgatatagaggagaaaataaggctttgtttgacacaactctagatctcaaatggatttgaagtttttatgttaaattgtaattgtttaaaatttaaaattatattaaaaatgatataaaataacttatcaaaatattatcaacgtaatcgtagatataaatttatgaatttatatagagctacggacatccggctctaaaaattcttacatcaggagctatgaaaatagaggaccaaaaaagagtacaagaagtagacttttgaagcccatggtactactatggttgtgtacgtataaaccattgctccccaccggaaaaaaaaagcccgtggttggcgcggccgcggagcaacaccacgtcagtggggtggaaattttgccaaaaatacgattcatagggcttgtttagttcacgaaatgaaaatttttggatgtcacattagacgtttaactggatgtcgggaggggtttacggacacgcatgaaaaaactaattttataacttacctggaaaccgcgagacgaatcttttaagcataattaatccgtcattagtacatgtgggttactgtaacacttatagctaatcatggactaattaggctcaaaagattcatctcacgatttttcccctaactgtgcaattagtttttcttttaatctacatttaatgctctatacaggtgtccaaaattttgatgggatgttttttggaactaaacggggccatagtctcaaaaacaaggttgacgttggctaagaaatgaaagttcatgagtaaaagaaaaaacactcacaaaacaaggtgcccattccggtccaagaccaggtacaatagcatactataaaccagttataaacacgtatcgagaagataaaagataaaagagaagagcaatggactatcacatctcatttcatagataacatataccattaaattaagaggtaacatatacaatatgttatatttatcatacaatccccaatatttttaacactctcacatgcttattgaagtttgtgtaagggttacctcttacatgagaggtgattatttctctctcatctttcttctctcccccacctcatcgtgtagtcctacgcagtatcttggagtttgtgcttggataaacatagtatattcccttatagtacggactttaagacacaatgtgtgtatgataggtaagacaaagtattaatagtgtaatatatatttataggtaaatattgtataaattggatattaattgactatggataatttgaaacttgtaatttgctatgtactaaactgcggttgagttcggttattaactttcccaactcacatatctcattttccgagtgcacgtttttttttcatcttttgcaaataattttatatatgaaagttgatttaaaatcatattattctattttttttaaaataactaatactactaaattaatcatatgctaataaattactccgttttacatgtgggagagtgagttctcaaccgagagaaccgaacacaacaactctggggtctgttcggatgccccttttcctaacccatctcgctcattttccacgcgcacacttttcaaactgctaaacggtacgtttttttgcaaaaagtttctatatgaaagttgcttaaaaaattaaattaatctttttttaaaaaaggtaacaccaccaccgaacacgcctgagacaattaccaacgcatgcaccgaccatctcgggagtagttcggaaaaaaatatagaaaaatacagccgactcgattgccgtgcattcaactctttgatcgagccatatcttcgtgtcctgttgcattcactcccctcggcctttttcgcacagaccaaatacgaccacctaaaaatggttgggaatcatagtaaaaagaacactactactgattgcaaaatgaaattaacataggtttattcctagtgcaggattcatttgaccttatttgacagagatccagttatcaaatccacggtatatttgatgtttgtatattcatagtggtttaaaatttaaagtttcatctagaataagaacaaatttatttatccaattgctatgcatgtaatagtacatcggagggtgaactcctcaagtgggggacagtgaggccccccttgttagttcggctggggcagcgggtgaaaatcgagaactcggtgagatgtgtggtgtagagggcctcgggcccctcgagagcgatgagacaaaaacggtttatacaagtttggaccgctaagaagtgtaatgccctactcctgtgcttgattgatcgactaagaaattcaggctttgagccaatgagaaccaaacgtgagttagccaaagaaccaatctctcttcccccactaggcttggacctccttttatatcttaaggggctgctacatgggcctataaatttgcctaggggaaagggaggataatcacgttaaatgcacgtcttgttgcttgcctcagaagccattcgcacgtccgccacggcatggggcccgtcaattctatttggctgacatggggggacacgcatgtcattcaccatttaatgggggaagacttttgggtccttacttgcaccgggaaacgaaaatcctgctctggctgggttagatgaatcaactctggctgtaatgagaggcaaagcaacctctcatcatcatgatgtgacaggagatgtcaggcggcggcgtgccacctgacatgcaaccagtgcgcaggcgcactaccctagtcgtatcggtcattcgactcgtcacagaccagtcatagatcgatcaggtgcactacacgttgtatttgatgcggcgtagcatgcccgctcacaccaccttaaatgtggtcaggtaagcattggggtcgtccgcctaaccctgcacatgcggcgtcatgcgacccttggcatggagggggcggccgccgtcctacctcgggggagtgccacgtgggtaccagggggagccttctctctctgagcttgatacccccggttccgtatcactgacatagtagattcagatataaggatttgtggaactagaaatacctagctttataaaatcttggatctagaattatgccaagagtttcaatctcattaaatgaggaatcctgctatatgtacgatggtgccatctgattactatctggccgtgttacggcataaacacagctaacaagcgtatacgaagatttatcatggcgtgaatcatctaccgtgtgaggctttctttgttgctttggtcaacggcaacgtcatatgtatatcattttcattaatgtcacatatgttaaagtgacaacgtgtcatgaaatttactaaggccccctttaattcaaaggaaatttataggaaatttagaggaaatttatagaaattttagagaattttatttctataggattttttcctacaaagccctttgaatcaaaggaatgaatcctatgaaatcctat

SEQ ID NO: 61264 - DNA, 1158 bp, Oryza sativa
ccgtccccattttggatggattccattggtataaatcgcgccccgctgggttcctcctcctccgccgccgccgtgacagctcgtcgaggcatcgcgctccgcccggctcgccgctccgtcgcgagtacgaaccggtgagcgtgtgtttctccctcgcctccgcatttttccctcggtttttgaggcggcggcattctgattctgcgcatggtgatcctgagtgcagtgtgggtgtggcgacgatcggcttcggggacgcgtctgggctcagagcgtgttctgagaaggcaggtgtctctatctctgttgcgtcgatgcctcgtttccatgttgatttgggtgtaatgatccgagcgtaattggtggctggtgtaggttaggcgatttgattctgtacgaagcaccacggcgagagctcagaacgggaacgctgggagaagcatgaccgaggtatctcaccaagcttgcagttgctggcctttatattatgatttgatccatatgtacgtttttagggatcgcaatgcttgacacaatcatggtatgtttgtatgttcccagctccatgcaaacatgttctgtatctataaactggatcatgccacattttgccatctcttttaattttgcttctgattctaggatgtgccattttgtcttgtttttctaactttgtgttcaccttctcctttccttatttttaattatgtaaccacaggaaagaggatgtacaatgtctgatactgaaatgccatttaaatattcctctggtaaagccttcccattaggagtgtctcaagttgaaggcgggctgaacttcgcacttttctctcagcatgcttcttctgtcattctctgcttaaagcttcctgggaggtatagctttaccttttcctaaaactgttgtgaccttactggtttttctttttctgattatatgtgtacctgtgggttctggtctcttaaagtctcaactatggcaactggcagttttgttgcatgtcatctatctccttgctgtcatctttttatgaacttgctcaacatactttaggtctcatactcttacgagatatggcaaacttgtttttcatgaccttactacacgatattaagcagttgttatgcctttgacatagagtctatgaaattttgaat

SEQ ID NO: 61265 - DNA, 2037 bp, Oryza sativa
catttccagttaagaatgtggctgtgtgtttctaaaaactttgatgaggccaaacttaccaaggaaacgatagaatcagttgggagcggattatcatccgccacaacaaacatgaacttgcttcaagaagacctctcaaacaaggtgaaaggcaaaaggtttcttatagtattggatgatgtatggaatgaggatcctgatagatgggatagataccgatgtgctttagttgatggtgcaaaaggaagtaaaattatggtgactactcgaaatgaaaatgttgggatattagtgggcgggttgactccttactatctaaaacagttatcatacaatgattgctggcatttattcagaagctatgcatttgcagatggtgaatccagtgcacacccaaatttggaaatgatcggcaaggaaattgtccataagttgaaaggcctaccattagctgcaagagctttaggtagcttattatgtgctaaggacaacgaggatgactggaaaaatatcctagaaagtgaaatatgggaattgccatcagacaagaataatatcttaccagctctgagactgagttacaatcatcttccacccatattgaagcgatgctttgcattctgctcggtctttcacaaagactatgtgtttgagaaagacatattggtccagatctggatggcagttgggtacatccagcctcaagggcggagaaggatggaagagattgggaataactattttgatgaattactgagcagatccttcttccaaaaacacaaggatggatacgtgatgcatgatgccatgcatgacctagcgcagtctgtctccattgacgaatgcatgagactggataatcttccaaacaatagcaccacagaaagaaatgccaggcacctatcattctcttgtgacaataaaagtcaaactacatttgaagcttttcgtggatttaatagagcacggagccttctactgctgaatggatataaatcaaagacaagctctatccccagtgatctgttcctcaatttaaggtacctccatgtccttgatttgaaccgacaagaaattacagaattgccagaatctgttggaaaattaaagatgctccgatacttgaacctatcaggcactgttgtaagaaagctgccttcatcaattggtaagctctattgcttgcaaacacttaagttacgaaactgcctcgcataatcttgtaaatctcctatccctcgaagcaagaactgaactgatcactggcatagccagaatagggaaattgacttgccttcaaaagttggaggaatttgttgtccataaggacaaaggatacaaggttagtgaattgaaggctatgaataagatcggaggacatatctgcattaaaaatctagagagcgtgtctagtgcggaagaagcagatgaagcattgctaagtgagaaggcacacatcagcattctagaccttatatggtccagtagcagggattttacttcagaagaagcaaaccaggacatagaaacactcacatccctcgaaccacatgatgaactcaaggagctgacagtcaaggcatttgcaggattcgaatttccacattggataggctctcacatttgcaaactatccatctgtctgactgtacaaattgttcaattctgccagcacttggacagctgcctctactcaaggttataatcattgggggttttcctaccattattaaaattggagatgagttttcaggtagtagtgaagttaaggggtttccgtcactgaaagaacttgtatttgaagacacgcctaatctcgaaaggtggacttccacacaagatggtgagtttcttccattccttagagaacttcaagtgcttgactgtcccaaagtaacagaattgccacttctcccatcaacacagtggaactgaaaatttctgaggcaggcttttctgtacttcctgaagttcatgctccaagatttctaccatcattgacacgcctacagattcacaaatgccccaatctcacat

SEQ ID NO: 61266 - DNA, 6003 bp, Oryza sativa
cttactacctcgcatgattgaagatctacgcatcacctcatgctccaacataatcaatcctcttcttgatgaacttaatgagctctttgctctcaagaatcttgtcattgcggattgcgttagccttaatacttttccagaaaagttaccggctaccctcaaaaaattggagatcttcaattgcagtaatctggcctccttgcctgcttgtttacaagaagcctcttgtctaaaaactatgactatcttaaattgtgttagcataaaatgcttgccagcacatggacttccactgtccttagaagaattatacatcaaagagtgcccatttctggcagagaggtgtcaagaaaacagtggagaagattggcctaaaatatctcatatagccatcatagagattgacgatgatagtgccatgccagataggagcataaggagaagattatgctaaaagcttcttagcaactcaacaaaaagggtatgaattaattgccttctctagtttcttttgtctaaatataatagataaggctggctgtgaacatcatactcaaacctattctctgcaggtgcaattggtatatattcagtttattatctccagtgcaaagttctattttaacataattactaacatttatcagatacagaagtaatacactcgaaatgtaaaaactatggtaaacaactgtagcgatagagtacagttaagattgagtgatttccaccaaacagaaaacaacagaaaagaataaaagaaataacgggacaaagaatttcagtactaacaatgtaactaaaaggaaccaggaaggagagcatgtatatctcttttatgatagaagaattttggagcatgacatatgtaaacagttttttgtccacaagaaatgaaattcagattgtcatggtcaacacttatatcttcatattacaaactaaaaatttgaagcagtttcatcggttctgataggaagaagtttgacgagcatgcaaaaatgaatgcataataacagttcatttggtcagttgtgttatgcagaacagttaatatcattgccttttaggtggaaacatctacaccccccgtcccccccaaaagaaaaccctcttctgggcctatgtccatattcaaacccatggagtgggtgttttttgggacagagggagtataaattaaaaatgctatattacaatcaccatttgatgagaaaactatagtcaaatggtatgcgttactcatctgttcgcctttatgttggaccattttggtttggtgccaattcttgccctaccaattctttggtagttttgaatagtgcatgttagcattttggattggagccaaattttgccaaatcaatagagtggagccaaatctatactataaaaaaaattttgccgggtcggccaaaggttggccgaccaatttcattaagattggggagaaaaacaaaggaatgttacagcgacattacaatgtcgcgctagtccgggagagatcccagacacagcgtgaacaaacgaaggagaaagagacaatacaacaacgattactcgctgaattgggagaagatcccagctaccctccacaccacgatttcttcttttatattctcggctacttactataaaaaatttggtagtgccaaaatatgcccaaggtttggtactaccaatattttggtagggtttcaaaccaaacaagcccgttattttcagaactgccatctagattcctcatgcatggcaatgtcagcgtttcaagagaatctcatattctacctgcatcaggatgtgctatgttaatgtgacagagaaggacgaccagacaatcaatcaatacttcaaagaatcaagtcaagtttgaattgattctttctctttagatggtctgggacactgagtcttttgttacagatttcccaaaattgaactgaagaaatcaatgaagactgaattcttgcttctatttatgtctatcaagccatattcgaaggtccaaaattgaccagttaccactccagaagaatgtataataatcttcttatcaaagtttggttatcacctaatatagttcaactaggcatatgcttatccattcaaaagggaaagaaaactaagcatggtccaatgttcacctttacgtttccttttcctgaccaactgtattacacagcctatcccataatatttctctaggtctgttatgattggggcatttcaaaattaagtaattttccaaaataaaactatgaacatcagtacaacgataccatatatgtatagcacaatatacggtgatcaaatctcagaggcgctttctctgacctaattagaaaaacccgactagtaaaaatccacgaacttacagccaaaaaaaacgaaggacgcgttgtagattcgctccacacacacactcgctatatctctcctcccccttccacgtctccggttcgcggagatacgaaccggcggtagccccgcgccgcggcggcggcgccgccgccgccgaagccgccgcaagccgagaatttcccccggagaagtagaatgatgaggcccaaatttagattgatactgtagattcgatctctatcgggcctggatgcacggcccaccaaatctaccatatgggctgggtatgggccttgaacgaatgctgcccggaacaaattttatttgttcatttcagtgtaaaaatacttatggccccagcacagcctgacaattcgaatttccgtgttgggtttggaatttggagagggacttgattttttttctgcgaaaacaacatggactacttgaattacctttcattctttgcaatagactgttgttatttgcacatatgtttactgacctcatatacttgatcagtttgaacaatggcatctttctatttccatagcctctgattctagtgacaatcaaagggcaaactaggtcaaaaggtatctgatggctacaccttcaatgcattggttcatgattcattcacctgttacaaatatactcattttgacacacactacgccgtcttgcccaaaatggtgaagctgcaagaaaaagccgtttaaaaaagaaggttatgttcatgaacctaacctgttgcgtggagatccctttaacctttccatttgctcatatgctattccaaacatgttcacaagaattgcactggaactcaaaaattatttatccttttgtcactcaggcatttccaacagcttgagaatagcaggctgaaaattactcaattggagaaggaacttcagccaaattgttcaaaatcagccgtttggtcaacacaagagtgaagtgtcagggtcagggagctgacggtaaagcattttcaggattctactttcccaagtgattaagcacactttctcacttgcaaaatattcacctgtctgactgtacaagttgttcgattctaccagcactagccactaaagtttttcgaagattgggggcttttcctgccattacaaaatcaaccaagagttttcagacagcgatgatgttaaggggtgtccgtcactgcaggaacttatgataatctcaaaagatgggtcttctgttcaagatggccagttgcttccatccatcacaatccaattacaccattgtgttcgttgcaattaaatcttcacaacaagatcttacatgattatattacgataaaaatatttatatttgtaaattacttttattatatactaagttacttttataatatatataagttacttttagatttgactaaattacttctatacattcataatgctctaagttggttatttttattattgttcttagttaattctatattttgtggactttataaatcttctctacactttacttgcgaattcactctacatagtttcttatttcagctcactcacaatataattatttctactacagagagttactcctccgtttcataatgtaagtcattttagtattgcccacatttatatagatattaatgaatctagatatagttctaaattaaagttactttctttttttataagttacttctataatatatgtaaattacttttaagctttactgaatttacttttatatatataagaagtaacttagtgaaatctagaagtaatttagacatatcataaaagtaatttgtgatttttcatcaaaatataatcatgtgagatcttgttgtaaagatttaattgttacgaacacaacggtgtaattggattataaatcggatgagtaatttaagagaaacttctctaagaagaaaaaaatatatagatattgagtgtactagtagcttttttttggatagaatggtgtctctctttagcactatccagctagtactctcggtgtagttacgtcctttaaaaacatgctactctctcaacccaaaatataactctacctttaaacttttgtacaaagttcaaatttcagtgaaaggcaaattaattaattgatgcatgtaagaacaaatttatgaggttacaaaactactttttagaagcccatagtagttcacaatacatattcataccgggaatcctaatgcacgcatgcgcgatggcggaggcggagcaagtagcacagacgagcgcagcctacgtcaccctcaccaagccgctaatctctagcacttagcgctaatcccttttttatgggtaaactattttttaaaaaaataaataattgatataaaatttttaaatatgaattgaaagttgaactgaaagttttcaatttttatttgaacactttcaaattttgagctaaaaatttttaaaactgaatttaaattttaaaattttagttgaaagtttcaagatttaaaatatatatttcagttgaaagttttcaaaaataagttggaagtgagttgaaagttttcaaatatgagtttaaagctttaaattttgaactgaaagttttaaaagttgaattcaaagttttcaaatataagttgaaagtttaaataattggtagagtaaattttaaagtggaagttttatattagaattaaaaaggggaaaaacacaataatagtttgtttgaaaaaagtgttaacgttaataacacggcctaattacgaaaaaaatagaactaataacttgatgtatgcgaaaggaaaaaaaaggccctagcactgcactgcatgtggagtccgaaaataacatgagtggcgccacctggcatcactctctggaacgccatgttagcgtaaatcggcgtgacgagctgtaactaaatcaaaattcacaaaacactataatcttaatggtttctgtcgttatcgatacgtgaccaacaaaatgcccgtgcagtgcggtggataatagcgaggtggatgaagtttaacctcaatgattcatcgaagcacctaagtatgatcataagtatcggtgacatgcacagttatcttaaagatatatttgtgtttggacaactagtccactctaattgtgcggggtgtggatgattatgctaatgaatggtctcgatgatcgtagcattggagaaatggatggccgaacgacgcacctctgcctagaaggcgatgatgaaattttaggagaccattaattattttgaattacatttttatgaaaatcttataatctcttttcacaattgatgattgttacaacagttcattgatataatcacaatgtaatgctctgtaccgactaaaccaaaatagtgccagccggacctaaccattctctttttattttctagaaaacctttacgagtaaaagtcattagcacataattaattaagttttaattattataaacttaaaatatacatttatttggtattttaaattaacttttatatagaaagtttcacgccagtttccgcgtttcttaaaaaataccggtcgatttatttcctagtaaaacacatatccggtttccatgtttttttaaaaaaaaataccggtcggtcactatccttcctgcgtacagta

SEQ ID NO: 61267 - DNA, 11725 bp, Oryza sativa
ttcccggctggtgcaatttttattttttccctcattgttctttgtttgctgcaagttctcagctcatgatgtttttcattccaatttataggtggcttgtttaaattgcaaagcattgcaagcctgctcatttagtaagctgattattaatcctgaatcacgccaagtcgataaatacgcaacaagagcagagcttacattgcttcagacttttagctccatgttatgtcggattcacgtttagtgtatatattccctccgttttaaaatgtttgacaccgttgactttttagcacgtgtttgaccgttcgttgaataaaatttaagtaattatttattcttttcatatcatttaatttattgttaaatatactttcatgtacacatatagttttacatatatcacaattttttttattcttttcatatcatttgatttattgttaaatatactttcatgtacatatatagttttacatatatcaaaaaaaaatttgaataagactttttagcacgtgtttgaccgttcgttgaataaaatttaagtaattatttattcttttcatatcatttgatttattgttaaatatactttcatgtacacatatagttttacatatatcacaaatttttttattcttttcatatcatttgatttattgttaaatatactttcatgtacacatatagttttacatatatcacaaatttttttgaataagacgaacggtcaaacacgtgctaaaaagtcaacggtgttaaacattttgaaacggagggagtatatccttcatgtatccattcctataatcccatggtacatagcctctccatccatcgggatggttgtggcggtgaacggggttggcgcgacggatctatcggcaatgggatgtcccgtgctagggagggtgatggcggcgatggggggagacacagtggcgtggtagccttactgcccgtcgggttctcttaggttgaggggcgtcggtgctacggtgtttatgtgtgccgacagtggtttagatggtagttatagaagtttggctgtgacaaaagggggcatgtgtaggcacaatcgtgaaatccttactacaacgacatatcgacactacttttgagcgttgagaaccctatattgacgttgttaaggcgtttccctccatcccttgcgggactctctaagtgaaaaccatatccaaaatcccttggatacatggcatagacgctttttggcgttatgtcatcctgaaggcgtttcctaagagatcttgttattgcctcaatttgaccaatgctcttgtgatgggtctctgactctctgtgcatgacaagtggatctttttttctttctccttcattctccctctacgaccattttgttctggtgatgtccgggagatcacaagcgattagttgtttggagttcagcgtgggtgggggggggtcgtcgtggctcctctgtaggtctagcgatgatctgtcacacttagcaacaatcaaattggtgttagttccttcttcaacattgcattgacggtgtttggcacagttattggagtgcttgtttcaaggttcatttaatctcttttacctaaaaaaagggttactttaatcttcacgtttcaaattatccaaacaattcttcaatattcatcatttggctcaatctagtccttggaacttaaaaaatggcatgtggacatgtcacgtcatcctcacatgatccccattattgtcattttcttgttttcttttctttaaaaaatctttatttttcactatggtatatataatggtataatggtcatttaattgttgaccttgcatgtgaggatggtatgacatgcacacttgatttttttatggggacaagtactatattaagctaaaagataaatttaattagagatttgtttaaataatttaagactaaaatgatcttggagtcaaactttaagataagattttatccctcattctaaaataaattaacatattatagaaatagatatatcttagtagtataaatttagatagatattttatttaaatttataatattaaaatatgtcatatcatatactagattaacttattttaagatgaaagaaatacctccgaaggctagtcttatattaatttttctccgtataagatagacgatcctaactcatacagtcgtactacaaccgtatcatactttctgcgttttaaaatatcgttacctaaatttcaattggacactttctagaagccaaaaaatatttgtatccgtgtcaccctctagaggagcagcggaaggttcgcagcccgttcgtgtcgtgtgcacgctgttcgtatccgtatcatatgagctcaagattttatttattttttaaggaacattttatttatttatttaaggtgcagataccaaccgtcgtttgagttcttcaaaactcctgttgcattcagcagaccagataaatttttcttccttcttcaagagctgtgtcattggcttagcaattttagagaagttctcaatgaatcggcggtaatagcccgcaagtcctaagaaactccgaatctgagagactgtcctcggtggggtccacttggtaactgactccacatttgctggatccacagccactccttgagcacttacgacatgaccaagaaactgaactttcttaagccagaagtcacacttgctgaacttggcatatagctggtgctcctttaacttttcaagtaccagccgaagatgctgctcatgttcttcctcggacttggagtagataagtacgtcatcggtgaaaactacgacaaacttgtccagaaattcaataaacaccttgttcatcaaattcatgaagaaggcaggtgcatgtcacgccctgaagtttccccccttttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaaatcccaggaaaatcctttcttttctttttctttttcctgtttcctcctttttcctcttcttgggccgtcggcccagtccacccgtcgcccgcgctcggcctccccttgtgggccggcccgttcccctttcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgcctcttcccccgcatctcccggcccgcgcgcgcgctcgagagggcgggattcgatttcgaatccacctctctcactctccctccactccccacgtcgccggccaaatcggccacctccccggccacgtccgccccctcccgcacctataaatcgctccccgcgtcttcctctctcgtttttcgcactcgccgcgctctcccgtgcctcctatcgcgctcgcgccgcttgttgctagtgccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccgacaattcaagccgccgtggtcgtcgtctcctctcctaacgcctctccatcttctcctagggtgtcgccgccgcccgtccgtgcctccgcgtcgccggtcatcgccgctcgtctcttcccacgccggtcgccgccatcgcctcggtgaggaatcccctttcctccttcctttcctctccccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgcctcgccatggccggccggcttgagccgtgccgagcatgtcgccgcccactccctcccccttgagccactgcccgtggggcccgcttgccagccgccccctctcccccccttagtgccgctgatcagtggggcccgcctgtcggcgccaccccctcccctcgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgttccctgtttcagtagtcttatagcatgttttgcttgtgtgctttgtttgtcgcgtaggtttcggccgttttgtcgatccacggtttctcgaagacgttgctgaggtctcgtcagtgcgagagcaaggcaagtcatgaaatacgtttgatcatattgtacccaatttacaaatatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgctttccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatgattaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggattttttttttaaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcaccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcagatggagacaaggaatggttcacgcgactcgaacaacgccagtggcagcgaaaagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagctgcagcagcagaacctgcagtttggttctccacctcctcagtccaaactgctagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacacaccagctgcaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaacctcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccgacagcaccgtccctaccacccgggtagcttcaacaagaaccaccataatggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatccttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttaacaaggcacagaggagtgattgattgcgccagccgcaccatcaagttaaccaatgcaaaaggagaggtggtaaccttccagtctctagtgccgcggaagccagggatcagtttaaaccaggctgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccagcgagttggcggaagtcaagaagcaagtcgatgagcagttacagaagggatacatccgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgacctgtttgatcagttgaaaggagttactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatcttcacccaacctgatctgaatctccgacagcgaagatggttggagctaattaaagattatgatatgggaatacattatcatcccggcaaggctaatgtggttgcggatgccttgagcaggaagagctactgcaatgttgcatgggtagagcaactatgtggtgaggttcaacgcgatttggaacatctgaaccttggtatagttgagcacggattcgtggctgccctagaggcacagcccacgctggtggagcaggttcgcatagctcaggcaagtgatcctgaaatagcagagctcaaaaagaacatgagggttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagaaaagttctggtgggtcagcatgagaagggaaatagctgagttcgtagcactctgtgacgtctgtcaacgagtaaaggcagaacaccacaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctatcaagaatcatgtgtttacatggtgtacctaagaagatcgtgtctgatcgaggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgactttggtggggcatgggacaaaagcttgccgtatgctgagttctcgtacaacaacagttaccaagctagtctgcagatggcaccatttgaagcactgtatggacggaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctctcagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagtttccccccttttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaattttaaatcccaggaaaatcctttcttttctttttctttttcctgtttcctcctttttcctcttcttgggccgtcggcccagtccacccgtcgcccgcgctcggcctccccttgtgggccggcccgttccccttt

SEQ ID NO: 61268 - DNA, 6202 bp, Oryza sativa
tatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacagtgcattagtgagtccgaaagacataactatgcatttgaacaacccgtaccaagtgatgaatgctgtctttggaatatcctcttcacggatcctcaactggtgatagcctgatcgcaggtctatcttagagaacaccgtagctcctttaaactgatcaaacagatcatcaatccttggcaaagggtacttgttcttaatagtgacctcattgagtgcgtggtagtcaacgcacatcctcttggttttgtctttattctccacaaagataaccggagcaccccaaggcgacgtgctcgggcagatgcatcccttttgtaactgttcatcaacttgcttcttgacatccgccaactcgttggctcccattctatacggcctcttgtagatcggtgcagttctaggtaccaagtcaattcggaactcaatatccctttttggtggaatggttgtcaggacatctggaaaaacctctggatactcgctgacgataggaatatcctccaacttcttagtggttttctccactgctacttcttgttcttcaccagtagactggttcagactgatcccttgcttctgcggtacttgagggaaggtccacgagatcaccttttccctaacaaattaaggttaataatacatgcgatcgactaaatcataaaaagtatttgatctcctcaacaactagatcatcttcatccgacatcgacatgccatacgcctattccacttgctcgacgataggtatggtgtccattacctaaaattggcaaacaaatacacagttttagaatccaattgatctctatctagaaacaaacaaaattaactctacactagagaaaaactgcacatatttatactatcagcacaagggcatcagtgaatctcacaaaagaaaagaggagaagtgtagacaggttctacagttgattatgaactataatctatcttgatgtgaccatggctactatggatatgaccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggccacaatcacagaagcaaggtgctgcgtcacctgtattgggccaatgggcttgtaactttgtctgggaccctggcccatgtggggtgcaccccaatctggtggagcacgacccttggaccctcttggtcatcctcccacctctataaatagttaggtaccccttcagggtttcttgggttttgatagattaaagtttagccattgctacttgcttgcagcgcgcgtgttggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcaagaggaactcagggttcatcaggtggtatcagagttttcgttgctcggtgagttttatctacccataaccagaaaattgccatacaaaaaaaattgtatcctgtacctagccatattgtgccattgcattgtttttatcagtttttgctttgttgagttttgtgttgcattgtcgagtcgtgttgctggtcttagcgtttagttcgtttagagtttcgagttctggtcacgtttcgtaccactgtcatcacccccgccgtgtctttgttgtcgtcgggacctaggaaaacggaatcatcttgttgtcggggtttcgtttttctagttttcagaagtttttgtcggtcggtcttggagttgctgagttgcatcaagggtttgtcgtctgtattcggccgtgcttgtttctcttgcgcgaggaagaggagagaaagaaaagataacagatctgtttttggaggaagttttgcagactagatcaatcaggttggttagtttccatctaaggccaaactttccaaactctccccacgcgtgaagaccggttggcgccatctccttttgtcgcccactttagctgagtccgactccctccctctcacgtcggtttcgcctgttccgagttgtgtcaaacaccttggtgaatttttgtttggtgtcagtttcgagatccgtttcgaaaaacggaatcagtataaattcagcattccatttttgtataatttttaattttggtttggacttttacagttgagtccttgtaattttcatatttacatttgagtcccagtaatcttgcattgaggtccttgagttgtttttgcagaaaaaaaaataaaataaaaaaaagaaagtaaggaaaaggcaggaaggtgcataaaaagaaaaaagaaaagaaaagccgcaccaaaaaaaaggagagaaaaaaaagaagaagaaagaaggaagaagaaagaaagaaaaaaaatcagttgtatttttgagctgaacatgatctatcagagtgtgcctaagttaaaaaaatcagttgtatctttgagctgaacatgatctatcagagtgcgcctaagttgtttctagtgctatcctgtggtatcgcttgtgtctaggctcacgtctctagtacgttctagcctaggaccagcatggtacttgactttgaaccattattcaactttgcattctctgatttgagcatttgctatccctttgctacatatttaagcctacccagagctccacagatctgattgcagccgtacaacaagtgtttgccaaggcatcgatacatccaacctctattggggtgcttggttaagtcggtgtacatcaccattccgcttgctttggtaagaacttgtaagagcttggttaaaagcttgagtgtgtgtgatatttgagctgccactacctagtagttgataggagcatgcatatttttgtgtgtttcttgtttgctactaaccatggcaggattgcgtaagggaatacgagaacatcgacttctacaccttcgacgagatatgacgacttctccaaatgatacatatgaggtacatgactataattttgaacaagttgcatctaagttacccttctatgatgggaagtatgattctgttgcatacattgattgggagctagcagtagacaatgaatttgatatatatgatttttctgatgctcaaatgattaaggctgctagtaataaatttacctcttctgcattattttggtggacttatgttagtaataaacctgaaacttgggatgaattgaaaaccatgatgagaaaacgctttgtgacatcttattacaaatgtactcttcgggagaaattagaacatctgaaacaaggtgacagaactgttagggagtacattcatgaatttaaggtctgtatcatctacagtggtctcaaagagtgcaatgaaaatacaacgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagatcagcacatccaagaaaaggagaatggtatacttgagaagaaagaggatgaagcacctgcgatgtctgaaaaaagttcgcaaggtaaattaaatggtgctgagagaaatgaaggtgagtattctcaaggtgagctacacttgtccacttttcatgctatagtagagcaaccattagtggaatcaattgctgagttgcctttgtcacaagttgatttacttgttgttccttgtgataaagaagagttgtgtgataatgtttcacttatatccatgccacaactgttctactatttctttgtgtgctgattataagtatgttgttcacattgctaatgaagtagaggaacgcgaattgctatcttctttaaatactttgggctatgttcagtttgatgatttttgtgagctcgataatttgaaggagaaattatttgctaaatctgatttgccatgtccaactaatgctatttttcatatctttggcgaatataatgatagaggaatatttttggtgcatagagtttacatttgttcggatttagaacatcttgtagttctggataaaatatgcaagctagagagacatgttactgctaatcatattgtctcgagtttgtcttgttttgattgcaagaaacaggttgttttcagtggactgcgcgaagagcaccatatggaaaaaccgaggacggttttccgtgaagaagggaggatgatgtgaccatggctactatggatacgaccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatcttggaattctatctcgtttggccgcaatcacagaagcaaggtgatgcgtcacctgtattgggccaatgggcttgtaactttgtttgggaccctggcccatgtggggcccatgtgaggtgcgccccaatctggtggagcacgacccttggaccctcttggtcgtcctcccacctctataaatagttaggtaccccttcagggtttcttgggttttgatagattaaagtttagccattgctacttgcttgtagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcatacggttgtagtcggatcgtcaacgtttctcccaaatcgtagttatcacaactcaccgaaagatcgggccaacaacagccttgagtgtcgagaggaactcagggttcatcatatctagatgtttgtaagcctgcacagacaagtgataatggaaattacaagatgcaattttcctttgggggaaaaaaaggaatcaacggatttctttgtaaggttggaaattcagtatcacctcttctccggctggttgttggctgctcgacgccttctttctgcatactttgcagctagttccttgtccttctgttttcatccaagatgc

SEQ ID NO: 61269 - DNA, 10401 bp, Oryza sativa
  unsure (1)..(10401): unsure at all n locations
tgctagctgtttcgtgagtaaccaatcagcacctttcaccaattgataactgaaacagtaattagccaattctaatgtagaaaaatgggaataacagtataaaccaatccgattgccaatgtccaaaacaaaatcagattccccagtcaccgatgctcattttaattcaaggaaaaaccgacactttatgggagaaagttagggataatatatatatatatatatatatatatatatatatatatatatatatatatatatatataggacactcatatggggcaccatggtgcccgggcaccatggtttcaaatgcacaaaatcactcaaatttttcaaaattttcaaattatgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttactttcaactagttagtaaagtagttaatattaatacctaaataattaaaaaagttttatgctcatttgaattgggtatatactcaatttcaacaatggtgcccaggcaccatggagcaccaaacaaatttactatatatatatatatatatatatatatatatatatatatatatatacaccttctttacagtcttgattgccaatgtatcccccattagcattcatagtgttcatgtgatcgatgtacctctcccagtcaaagctaccaggatgggaatacagactattgcactcttcatcagtccagtctgcgaatccgttaggggcgaaagggacatccattggtcttaccgcattagccttgtctgcccttatcgcggtctccttgaatatttcatagcagcgagccttctcctcctcggtgctgtacgaacggttgtgctccttcatccagtcctgaaacctggccttcatggttgcctcatcgaccttcacatcctgctgcttcacagcttcttcccagtcactcacctccttagcagatgcttcctcgtcgtaaggaggcattcccccatgagtgtttgaaagttgacatgatcgagataactagcccactgaactgtgccatctttgtccacaaaccctgccttgatggctgcttccttactcaggtaagggtaaggttccttgacagcccccctgtcacatacatcctctatcccataatataagtcggttaaacttagtacggtctttaaaacaaatctttggattctaatttcttatatatagtataatgtttgtagcaatataaaagtaaactataaccatatgaaattaaattcaaatatcaatccaatgtattattttcagcaaataaaattcataatagttaatcaaatgttttaaaagttgaatcttaaaacgcatgtgtgccttatattatattatgggatttaggcagtaaccccttcctgccttcctcctgcagctggagatgtacatcaacaggtaggtggtggtgggcatggttaggtcacctggatcagagctaactaacgaagagaaatctaaaggcttttgttttgtttttttttcttttttgtcaattcatacctcctgacttgtctgtgctctcgttgaaatacaggattgtggccaatccagccaacgcaatcgtggctacaactccataagcgccaccatcaccaacggcgagatccctctgtatcatacagagatgagaacacatgagctgcgagtgcacacaagaaataaaattttcgatctgagaaccgggtgaaacggacggagatttcaccagggcgcggagagagcgtgctgacctccccgccgtagcctgagtgaagatccccagcgaggactccgcctccgcctgcgcctgcgcgcgtggcgagaatctcctacaggtgagaagggaaccgagggcacggagagacatggtcgccacaggagagctccttcttcctcctcctcctcgatttactcttcgctctccgccgccccgctcgcctcgtcgcctcgattcgactgtagggtgtgagacggacttcgcttccgatggacggggcttgtatggccgaacagaactggaatccgttatcttaatgagtttgaattgcgtccatgaaccgtgatatataggctgtttttatactnnnacaaagttttggcgtgtcacattaaatatacggacacatatttaaagtattaaacatagactaataacaaaataaatcacagaatctgcttgtaaactacgagacgaattttattaagcctaattaatccgtcattagcaaatgtttactgtagcaccacattgtcagatcatggagcaattaggcttaaaagattcgtcttgcaatttacacgcaatctgtataattagttatttttttcgtttatttaatactctatgcatatgtccaaatattcgatgtgacatggtgaaaaattttgccagatgatctaaacaaggctatagtataacacggacacccaacttataataagttgccaagcagagcttctagaaagtatatagttctaggttttagctgacatgacaagtcaatatgaaactcaacatgaaccacacatatcagctttctcctctaatcttctctcccattccagctttcttcctcctctttccccctcgctctctttctagtcttcaagggagcggaccagcgggataagggggaggggcaggggagctcgatcctcttctcgcagacgaagaagatagggttcttggtgagacaggtgtaatatggaacgaaacctctggttgagagaacggtacgagtacctacgagtaccgacatacagctgatagcggaatgtgcaagccgcagcacctggggtttgccaaccatggcccccaacaccatggccacagcgtccgctccatcctcacctcgctttttcttttttcaaatttaagttaactctagaatcctagaaagttttaaattttgagttaaaagtttcaaaatttgtgttggaagttttaaaattaaattgaaagcttcaaattaaatataccttttgaagctgaatagatatttctctattagaaatactcatggttggaagttttcaaaatcaagctaaacatttttaaatttccaatagaaactaagtaacaaattagaaattaaatctactatatgacttgattaaacccaaaaaaaaagaaaggtgacttcatgcatgcaggatacgatatcgctaattagcaatcaggcacgcccaccacctcccgcctgatcactatccgtacggtaagaaatacgcgtccatacgtataaaatatactccctccgtcccaaaaaaaaaaaagcaaaccctaagtttccgtgccaacgtttgactgtccgtcttatatgaaatttttttataattagtatgttcattgttgttagatgataaaatatgattaatactttatgtgtgacttatctttttaatttttttcataattttttcaaataagacggacggtcaaacgttagacacggaaaccagggtttgtcttgttttttggaacggagggagtatatataaacattttacgtacatgtataaagtttgtacgactatatatttaaaaaattatatgtcaaaaatgtatacttgtacgaataaatttataatacataaaaattgtaaagatgtgtaaagtttatacataaatgaaaacttggtatataattttgtgtacttatgtatgtataactatgtatatgtacatataaactttgcatttatccaagtataaatacaaagtatataaatacgtgtacatgactgaggaaccgatcccgcgggtgcagctctagttgtcccccctccggaacttgcctctatagtaaaaaaactcgcgctacttgcattgatattaacgagttgttgcttcctcctcgagagagctcaacggcgacgaagcagcgcgacgcgacgcgacgccctgcggtggcgtggcaacaccgcaacaatggcgccgccgccgccgtcgccgccgtgccggccgcgagtcaagcccgagcgcgcccttctgtgcttctccctcctcctcctcctgaccgccaccacggcgaacgccagcatcaccgactgcccaactacaagcagcaccaactccagccatgtgacgacggtgccttcggggccaacctccgcgctctcctctcctccctttccgcagccgcggcggcatcgtcgtcggggttcgccgagaacgcgaccggcgcggcgccggacacggcgtacggcctcgcgcagtgccgcggcggcatcgtcggcggcggcaatggcaccagctgccgctcctgcctcgacgactcggtgcgggacgcggccaaggcgtgccccggcgagaaatccgccgtgatcatctccgactactgcctcgtccggtactccaacgcgagcttcgccggcgccgccgacgagcggacggtgaagctctggtggaacacggacaacgcgacgcagccggagaggttcaagtcgctgctggggacgctgatgggcaacctcaccgacgcggcggcgcgcgcgtcgtcgccgctgatgttcgcggccggcgagaccgacctcccgcccttcaccaagatctacggcatggcgcagtgcacccgcgacctcgccgccggcgactgctaccgctgcctcgtcggcgccgtcaacaacatcccgaaatgctgcgacgggaagcagggcgggcaggtcatcacgaggagctgctccatccggttcgaggtgtacccgttcttcgacgcccaggccgccaaggcggccatgtcgcctgcgccggcgccggcgccggtgacgacgcccaccggggtcaatggtaagtcaagtcaaaggtctctcccgtgcgcgtttgcacttgcgtcgctttctccacgcgtttgcttgtataggtcgcgaaaagaaaaaagtttagttgtcatattggatatttgatcagatattggaaggagttttcggacacgaatgaaaaaactaatttcacctggaaaccgcgagagcacacgtgggttactatattacttatgactaattatggactaattaggattaaaagatttgtctcgtgatttccccccaactgtgcaattaatttttttaatctatatttaatgcttcatgtatatatctaaagattcgatgtaatgtttttggaaaaaatttatgggaactaaaccaggccttaaccaggccttagtagctggttgcaacttgcaactttctgactctaaattccgaacacttgttctcttcttcaaccgtgttttctccttcaaccttgtcgagtggacagaacaaagtggtttgcacccatagattctgatagtacaatgacttttgtgctctgaatttgtgttttgaccatggtaaaacatgtttatgcaggaagtaatcacacagtcagtaagtctgtgattgtcccagttactgtgggagttgccgtgttactagtggtaatactgctgctaattgccctttgtctgtgcaagaggaacagaaaaccacataagcatatgatgattggaagcgtcggtaagtcctcaaggcttgaaacaactgcattagcattatagcacatctgaagaatatttaagggcttaactcgtcagtttttcctatgaacagatcttggagatgaagacgaaatgagaggctcagaatctctcttgtatgatttgagtactctaagagcagcaactgccaacttctcagaagaaaataagctcggagaaggtggatttggcccagtctacaaagtaagttaagtctgcaacctgacaatcaagttcagttctaattagcctgtaaaagtagctcacagattcatacttgcagttatgcaagcaatgtgatctacattacttgaacttaccgattctgatgctgttgagttcagggtacactgcaaaatggtcaagagattgcagtgaagagattgtcagcaacttcccatcaagggcaattggagatgaagaatgaggtagtcttggttgcaaagcttcagcacaagaatctggtcaggctgctaggatgctgcatcgaagaacgggagaaaatcctagtttatgagttcctctgtaacaaaagcctcgacactatccttttcggtacttcattcagataatctaagcctatttaattttatatatccttgtttagtaagctaatcaacagaatttacatggacaattcagacacttcaagacagcaagaccttaactgggagcaaagattcaagatcattgaagggatcggaagagggcttctttatcttcatgaagattcaaggctcaagatcatccaccgtgatctcaaagctagcaacatcttgttagatgtagacatgaaccccaagatatcagacttcggccttgccaagttatttaacatggaagcgagcgtagcaaacactagcaggattgctggaacctagtaagtgcttcagatattagagtcctctcttgaaaaagtatatctatactaaatgagcactcgaaggaaactcccacgttaacttatgaaagatttgaccattaattagataattgtattatcatgaccatatatcatattaagagtttctgtaaaataaaacaggtggttttaaatcagtgagctcattttagtttttctaaaatatagtaatattttaagaattcggaattgataaatatgaaattgtacccatattgaattctcaatttagtatgtcattgatttaattttaagattcgaaaataataactaagaagttgtaagttgttaatggcatatggtctcttttttcaacttgaatgtcactccctccgtttcatataataagtcgtttggttttttttttctagtcaaagtttttaaaatttgatcaaatttataaaaaaatatatattattattttcaacacaaagcgatcatattattagatttaatgaaactaatttgatattttagatgttgctaaatttttctacaaacttgattaaatttaataaaatttaactatgaaaaaggtcaaacgacttgtaatattgtaatatgtaatatgaaactgatagagtattacattactatcatttggaaatttgagctgagagcattagatatacctcttgttcagcggatacatggcgccggagtacgcgctgcacggcatcttctcggccaaatccgacgtcttcagctacggcgtgctcctcctcgagatcgtcaccggccgccgcaacacctgcctccatgactccgaggatctcctggcatttgtaatccccgcgcaaatcctatctaaagtttaatcacaaacattgcaatctgcaattcgaaagacttttgcatggatatacaaccgtctgagactgattctgctcgccggcgtgcaggtctggaggcactggagccgcggcggcgccggggagctgctcgacggctgccccgccgccggccgccggccgcaggagcttctgcggtgcatccacgtggggctcctctgcgtgcaggaggacccgcagctccgccccggcatggcggcagtcgtcgtcatgctcaacagccgctcggtcacgctgccggcgccctcggcgccggcgttcgtctccgcgagccgtgggatcggcggaagcccgccgccggcggcggcggcgggagatgcgccggcgaggagcacggatcacgaggttcctacggctgctcgatagccgtcgatcaacggcgcttctgtctctgaactagagccccggtgacatcggagattcggaggactgacggctgggcccggcttatgtttctgctctgaatttgaaaatttgttgctcgttttgcattcaaaatttctctcggatttaatgcatttctgtatgccgttcagtgttggagtagttaagtggatatgaaaatgtaatgacggctttgtaatttaaatttttcgacgagcttagcaattcaagtggtttatgtagtacaaatcaactcaactcagtcagaaaaagtagaaatcaaatcccttcccaaattcaaagcacaaatcggctggtattcgtggtagtagacctagtcaaacggcccaaacctcgtcaaatccaggcccaaaagattggcccatgtgttttttacattgaaaacaaatgaaaattgtgccggccaggttggaccagatggcctaaggtctagatagggtgggccgaaacggtctcccgcatcttaaaatttgtgtgaacggacgatttggcatcaaaactgggagtcttaattcagattgcatcaaaataatttattccaaaatttaataatattaaagttttcgtaaattaacaacattgtaaagttttgataggacgaacgatattaccagacaataatatggttcaaaatagtaggggtgggcattcagtatgaccgaaaatttcggtcttgatcttcggtatttcggtgtttgaaaagtgaatactgaatctcaacgcgaaaatatcaggaccgataaattcggtctcggtcttgaccgaaattcaacaacattttcatatatgcaaagaaataatgaaaattttcaacacaaaaatcacaaaaaaaatttgtaaacacgtatgagtaaagactcttattaggttgcatgcctataagaagtagagatgtgaaaattagagtttaatcctattgaacttagtggattgtaggttgcatctagatttttttttttgttaaatcggtcttttcagataaccgaggagactaaccgaattaacctaacaaaattcgatctttcacttcctaggaccgaattaatgaccgattttctctgtctcggtattttcggttcggttttttctgtccacccctacaaaatagcatcaatctaatcccaaaacctaaacacaccagccaatgacacacctgccccacccaacatataagcagcagtaccgaacgaaagctaaagaagtccacaccgcgtcaatcgccccaacaaactcgtaaaataaccaatcaattcaacagcttcctggaatctgaagaacaaaagttgtagaagagcacacagcgattctgacgaggaccaaggtcgatctctagaaaatctgtgctcttctgcgcgctagctagtgtagtgctgtgcaattgcatatgggcgggatggcgcaggctacagatgagtcgccacctggcaattttcctcttctttctctgattatctcgtacgttggaccgatcgacgagtggttccagccttccagaaatcaagcacggcgacaactaatatagctgtcgaggaatcggtcctgtattattcacttcggtttttaatctagacgctctgatggattgattaactgcgtacgtggttcaaactctactgttgatttgcaccataagagacgtgtgctttagagtactactctttggtttccttcaagtcacgaccagttcgttatctttgcccgatcattttgcctttctgctcggttattcgtaacgcgtcgacataagtatatctgattcgtaactgtctccatctttcgttacatgtaaacgaaaagaaaactgatagcctatcatgcgcgccaagctatggcttacctaagccaacgcacgcagccaccccctaccaaacagaagcttctctctccctggcaccacaactaaaagcaggtacaatagcagactataaaccagctataaacatatttcgatgagataaaagagaagagagagtagcaacgagctatagatttgtagccagctgcagcacggactccaagatacatgtgtgtatgacaggtgagaccatatattaattatgtagtatatgtttatagctaactattgtacaaattagctattaagttggctatagatgatttggagccggcagttggctatactattaaacttgctctaagagcaggtacaataacatgctataattaagttagctaaaagcatatgttaataagataagagaagcggactatagatttatagtcagctgcaagcctatagcacggactttaagacgctgtacgtgtaattaataatgatgtagttaacgattgtataaattaactattagattgactgtagatgatttacggctagtagttgattaaacttgctctaaacaacgggagaagccttctagatcatcgtgttgaaaaaaaatggcaacagccaacgcccaacggaaccgcccaagcccacacgtcgcgtttacctctccagcacggtcactggcatgtgggcccatgagaaagtgggacccacatgtcaatctgtgtccgccccactaccgcctctacaaaagcaggggctgcaggaat

SEQ ID NO: 61270 - DNA, 13470 bp, Oryza sativa
gacggcggctgccggcaaagctaggtgagtggctgtacactgtacacggcggaatttccggcatgaatgcagacatgcagggatacgtagctatacatatacggtgaagtattaattatcttggaaagcaaattttgcatcattggtggttggtatcatataggagtatacatgtcaattaacagagtcaatcatgcagtttgatgaccctagcaacaggagtcaaattaactcttaatcatcttgaaatctttctccaattatgagattataatcatcatgtagtagctgtagattttgctagtgaggccaattattccacatttactacaactgcattagatccaactcttttcttctttctttttgatctgcattagatccaactctacttatattgtaagacgattacattctttgtggaaactacatgtgtcatctagtcaccgtgttctttccaaattccagcacagatcagtcatagcccctatagaaaatccagtgcatgggttgtaccattctttttaagtgaaacagcactaaaaggagtaatcagtgcatgctcctttttttttctttgtcagcatcaatttcttttacaattccaagcaacactacagtccttttagaccacatgaccctaaacatcctttttgacttagccagcttactgagtcaaaaatatcgatcaattcgtcaccaggaaatcaatgaaacatgggtcaggggatgacaatctgaccaaagcatccacaggatttatttgactaaaatgtgttaatttttttctagcataaataaattactatcttagtatttcagatgctggactgacaggcaatatcactgtagtaattaatggttggccagtagagtagcatgcatgatataacaaccaccttaaaattctgaatttttagacgatggaagcaacttctgagcctgaaatctgaattttatctgaactttcaggatggatgcgcctctggccgtcggatgctggccggcgttgtggggcggcggcggccgccgcgaccgccgcaagccggcgaaaccggccgccgggagacgggacaccagagtggtgacagtatgagccaagcataatcgatctactccttctattactactagcagagcagctagctttgcttaatggctttagacttcagttgagatgttcctttcctctttgtaaatattcctctactcgtttttttgtagaccgtgacactgggtgggtcggttcgtgtggacagtgagtgaagtttattggaaatttgggatgatcgtgacgtgtcaactgcaggggtagtacggttttgtgcctggattcacggcttcttcttacccgttttccatcagcgtattgcacaagtgatgacagtacatagttgagagaaaaacgtggcaaggcctctgcatctaccttgagcatttccaaaaatgctaacatttaaatctaaaaatgttagtattagggtcatataaaaattgggcaaataaattaccccgccctctaacaacgtctctaaatttggttttttaaacggcacatcattcgtgtggagggcacaacactaagaacatgggattgagattccgtgacttagtcattccctaatatccgtgttttttttctctgacttaagtcgtataattttgagtcactgacatatggattctctttgttgtggactcacttgccaatgaccttagagcatgagacagtgtcggtttctcgtgcgtacgctcactattgggggcatccatccctacctcaaatctggcttaatgatttggttaaattgaaaatacaaataatttgggatattttttcgccaacacagaaaatttgggactggatttaggcatttgttggagaggtgattttggccttaattcacaacaattataaaactgcgaaagatgcttagacctccctgggaaatgctctcatagaaaaaaagaagagttttaataagatcgttagaaaacagaagcagcttttctctcgagttcaatgcgtgatgttgtcgtgtgaaaaccgaaaaccgaatgtgagtgtgggagtgagtgagtcaccgaggaaacgggtccctgcgagtgggactgagttaaagctggcacgacacgacaccacacgacaccagcgatcgctgtagcgtgcgccgcattccgccggttttgcagggacagccacgtccaaattcgaagctgaaatcagggaagaataaagttgtataggagaggcgcacacgggccaatttcggcggcaccacgcgccctcacaaatttggcaggcagcccatcgaatcggcatgggccatggccctcccgttcccggtgccccgcggcgcgcattgggccgtgacttccaccgcgcacgttttggtgggcttcactggtgaaatggcccgcgttgaacagccccgcgcccccgcgccgtacaatgcagcatttctgaggaagaagttaaccttggcaacggtattttctctctcccccaaaataggtgaagttttaaacttttacatatgtattagtaaaatagatataattaaataggaaaatgatatgactggtcaagaaaatgaagtagaataagaatttgaatgatataagattgtaattggttgagaagaaaatgcatacgacgaaaagctcagattcacatttggacatagctggcactgtggtaacacattcacacggtaatcacagagatagagctggtacacatatgtactgctcctaattaagtaattactaccaggctaacactgtctttcagtagcaaacaaagcttaaacacagtactacagtacttgccatggatgaccccgccgccgaacacttgcccgtaataccagtccccaacggctagtttcaaccgttcactccgcccgcgtccgatcccagccgttgaatccacgccgcgccatcccggccgtcgatcctctcgaccgttggaggcgtcgccctccgctccggataaagctcgagccccccaccgcgccgctcctcccacgccaacgcatctccgcgtctctcctctccgatccaagcaaatcaagcaagaacaagaaattttagagagagagttggaagagcgaagagagaagaggaggaggagaggacggccgcctgcttcggtccgggagggagttcgccggagttcttggcgttcttggagcccggaggaggaggaggaggagcaacaggaggccgtacgcatggcgacgaggcaccagcgcgcggctgccgctccgcagccggcgaacagaggtgagcggcggtggctttgttctgtgttcttgatttgggttctttggggggacttgcctgaacttggggttctttggggttccaagctacggatttttctgtttgatgttccgaatctgtacgattcaagcggaaaattttgagttcttggtagtcgagtcttgcttggtgagagttccaggtctgttcgaatcctttttcaagaacggatttatgttgcgagggccaactgattccagtttccatcctttcttgcccgattcatgcaccaagaacggatttttgatgctgcccttcctgtgtttgattaggttttcttgatctgcttgtttcgatttatccccgtgtaaacgcaacccctgttgctaatcttcttctccggcgaatgggcaggtgctgcagtcgcagcggggaagcagaaggccgccgccaccgccgccgccggccgacctggtgcgagaaaccggcaagccctcggcgatatcggcaacgtcctgaacgcccatgtggtcgacgggtaaggagcagcacgacatcatcgtcgccaaccttccccgattcgttcttcctctcgtttccttctctgaaaacctcgtgttcttcttgcaacagcaagatccagctgccggaggggatcaatcgcccaatcaccaggagcttcggcgcccagcttctaaagaaagctcaggagaacgccgttgcggcgaacaaggtacggagtgagacacaccccccttctgtttctcgtgttcttcttgcgaattcagagcggttgatttgatccctgatttttgattttggtcgcagattgtcgtgcagaatccggccaggaaggagccagctccgaagccggcaaagaaggtcgtaccccgtccggagaacgccgccaaggccagcaccggcgccggcgtcaacgagaacaagaagccgtcggagtcggagggcgccggcagcagcagcggcggttcagccctcaagtactccaggaagaaggtcgtgaacacgcttacatctgtgcttactgctcgttccaaggtgagtgatcgatcgaacacctgtgcttgcctgcttatttctgcataattgcactgtagctgaatctgaattcgatgttgttaatggcagcacgcgtgtggcattactgagaagccaaaagaagtcgtcgaggacatcgacaagctcgacggcgacaaccagctcgccgtggtggagtacatcgaggacatctacaacttctacaggacagcccaggtaaacctcagattcttccatcttcgtttcagtgaagctttcctcttcagatttgttcagaaactgacagtgttgttcttgcacagctggagcgccggccgacagactacatgagcagccaggtcgaggtgaaccccaagatgagggccatcctggcagactggatcatcgatgtgcactacaaattcgagctgatgccggagaccctctacctcaccatgtacgtcatcgaccggtacctctcgctgcagcccgtgctgcgcagggagctgcagctcgtcggcgtcgcggccatgctcatcgcctccaagtacgaggagatgtgggcgccggaggtaacgcagattcgattgattcaacaagacgaacaagaatcccaatctctgcttcacacttgtgatgtaactgaacaaaactctgcttcgctgcggtgaacggattttttcaggttcaggacctcatccacgtctgtgacaacgcctactcgcggcagcatatcctcgccatggagaagaacatcttgaacaggctgcagtggaacatcaccgttcccacaccttacgtcttcttgctccggttcatcaaggccgccggaggcgacaaggaggtaaaaaaaacaagaagaagaaacaaagaacttgatttcatttctggtgtgccatggaaattgtaactgtattctgatcagagacattgtgtcttttttcagctggagaacatggtgttcttcttctctgagatggcgctgaaggagtacggcatggcgtcgctgtgcccgtcgctggtggccgcgtcggcggtgtacgcggctcaatgtacgctgaagaggagtcccctctggacgagcacgctcaagcaccacaccggtttcaccgaatcacagctcaggtattttttcaactttctgaatttccattttccctgaaacctgaactttctgaacttccgtttttcctgaacctgaagtttctgaacttttcaatgatctgtaaactaacattagttctgattgttgggatgaattgattgattgcagggagtgtgcgaaggtccttgtcaacgctcatgctgccgctcctgagagcaagctgaagacggcatacaggaagtacgcatccgagcagcttgggcgtgtctctctgcgccctccggcagtttgcctagcctaggattagtactgttctggattcggtttagactgtgatggaatgtcgttcttgacagtatttaagattctttcgtgggtttagctaattggatcaagacaacttgagagcgattgttgttgggttttttgcggggttactctgaactctcgagtatactcatgtattcagtactgtgatacaccttggtgtaactactcttcataaattcttttcataagtatgaattgaatgaaaagtattctttttccataattcttttatgtctgccaatttacttgcaaaaagatgtgtgctcaagtataattctgcaatgaaatcaaacttttgaggctactgaaaccaaatgattttataattcttaactctgcaaataagcaaatgtgctgactatggaaggtaagttatatattggttccttttctgaacttgcacagccataaaagtttccaaatcaccatttgaatatctttttttttctcctgtaaatgaactagaagaaactttgctctggaagagaaatctagtactaccagtagcattcaggctgtgtttagatccaaagtttggatccaaacttcaaacttcagttcttttccatcacatcgacttgttatacacacaacttttcagtcacatcatcttcaatttcaaccaaaatccaaactttgcgctgaactaaacacagcctcagtttcaaatagagaacaaactaaaagcttatttcaaataagtggtttcaggcaaacaagtttcagttcttgaactctgaaatgtagttgatcagagacgtcacgtctctgtaggaagaaccaccctcttgaaccgcggcgcgagaggcctctcgcatcagcgaagctctcctcctcatctccttcgcctcttccgccgccgccgcatcggaatccatcaccatcagcctcctcaccgccgcggcgatctcctccctcccgacgacgccgctgcagccgccgccgtccccgttctccctgaggccgtacccgatcctccactcgtcggcgacgagccgggcgacgatcggctggtcgaacgctatggggagcgtcagcatcggcacgccggcgtgcaccgcctccagcgtcgagttcatgccggagtgggtgaagaagccgccgacggaagggtggcacagcaccttcagctggtccgtccacggcaccaccatgccgccgccgccgcggaggatgtctcgcgcgccggagtcgccgcggagcacccacaagaacgtgaccttgctgtcggcgaggccggcggcgatctcgtcgagctgcggccgtgacaccgagaggaagctcccgagggagacgtacagcaccgagcccaccggctgcgcgtccagccacgccatgtatggctcttcttcctcgtcgccggcgtggtgttcgtcagcttggagcgccatgtatgggatgcaagggccagccgagaacgccgggtaagggaggtctcgccggagagcgtccatggcgttgctctcgagctcgtagaaggaggtgaagatgacgcactgtgcttttctggcatgggagtaggcttcgaggatgaggtctaccatgttcttgttcgtgtgtgtgggctcaagatcgctaaacctgatcgatttcagcccaggaatgtagtttccgacctcatcgccatctgcatcggatcgagcaacaaattttcatttgcaacgaaatttacgatctttcatgatgttcagagcttcgtaccggcgatgtcggtggccgtgggcaggcggtcgaagtgatagtgcacggagaacatggtggcgctgagcggcgagaggacgcacaccggcaggcccctccggttgccgacgccgaccgcccacggcagcacgaacgtgtcggccacgatggcggcgggcggcggcggcgccgcgccgagagcgaggcggtcgaggaggcgctcgaacggcgcctccatcctggtgtacacggcccgcacgaacccgagcatgtcgccggcgcggccgtgctcggagggcacgacgttggggatggcctcgaggcggacgccgccctccgccgccgcggccgccgcgccgccgagcaggccgagccactcctcggtgacgacgacggtggcggtgacgccgtcgcgcgcggcgaggatgcggcacaggttcagcatcgcgttgacgtggccgcgccccgggtacggcaccgccacgacgtggcacggcggcggcggctcggccgaagaccccattgcacgcacggcgcggcggcggcggcgaacaagctcggagctgcacaaggttcacgaagtcaaagcgagaagcgaggttctgaacagtgagacatgatccgccatgggagtccgtgacctcggcacccgccgccgcctcgagaatcgtgatgattccaacgctggaatcacgtgtagtaggccaacaaattctggccaacctggagcccaaggccttacttagcctaatgggccggcactgtgggctttcgactggaccataagctttgcgggcattgtgggctttgcttcccaagcttcaacttcagaagagcagtgtttgaagggtttgtacttaaaatgtgtgagttgagtttggacttaaaattttatgaattgatatttatatatattgtacgaatgttgtcaatttattttataatttttaatagctatttatatggttttttaagacatatgagaggacatccctaagggtttaaaagagtttcttgtgtttgaacggtcttcttttttttttctagttaaagagagttttattaatgactgaataatggattatgttcctgatttaagaagtataggattcttgaaggagaacaaagtctccactccgcataaaacctagtactcattgtcagttgagttaaaacatgtgctaccctatttgtttctcttcttatctcgtgcatttgcatctgttagaataggtgttgaatatactagtcctatttggttacagttggacttggaattgtaataggtgttagggggtggagttagagtcgaattctgtaacccggcatctctcttaaatagagaggggggcaccacaatataaccatagcgactacaatgtagcgtagacacgcagggagaggatgtcggcgtggccatggactcgtagcagctaggagctatattggttggggaggagcgcccataatcagagccccggggatgtaggcttcggctgaacctcgttaacaaatatcgtgtgttcctgtgtcgtcatctggcatgtcttgggtgatcaatgattgaagcgatcgggaaggttagtcgttgttccgctatatcgactaacttttataacaagtggtatcagagctgaaggtttcagtattggatcaagaagacatgtggaggaggaaacacgaggcagggatcgcgcatcgacaggagatcgtcagccgtggcgatgagatcgatggcgacaatgaggacattgcggaggcgatgacctcgctcgcgatcagaccggcgatggcggaacgtgaccggaagacggggccgggcgtggccgaaggcgacaggagagattggaggggtagcgccatgtacggcgtgcccgacgcccgcggcgaatgcggatccgcggcggcagggaggccactgatggaagggcgaaactggcgagcgtggcgcggcgcggcggacgtgtagggccgatgacgacggggtcgtggacggtgaacacgagggctgcgactgcggtgcgtgcggaggcacggacagtgcgtatggagtatgtactatacacatgcacaaaatacacgtgttggcttacagacgaacaggaagccatgggcttaatgatgcagacgatgacgcagcaaggaagacgataaaattgagttcaatgcagaagaagacgcagatcaaacttgactcggagaagatgtggattcggagtcgacatcgtaaaggactctgtttggtaggcgtggatcggagttaggagcaaactcatgtatcgaaatcggcagagcggatcgtggactcgtggtgcttttggcttcagttcgtgtaagaaaacagggcaattacttggctgcatgcaatggggattagtagtgcaagtttgggcatggactatggtcatgtggatcattaattgcataaacatatcactactattacaaggtcacgtgaaaagcaccagcaggcatgccgttctcacgtgggcttggtggcgcacgagaggaggttgtgcagtggagttgcaagctacatcaagcagggcacggagatcaaaacaactaaacggacttgatcagaaaaattgatggatcaatgcggtggacgagatggcaggagtcaacttgttgcgtacggcatggacagatcaaattgacctggagtttgggacttggtgattggtgcaaggctgtgattcagcggagcggttcatgggcacaagacaacaaacatggtgtagatatatggtgatcaaggcaatgcaatgagtatacttgtcgagacaaggtgcgtaagatgtgcatgtatgacggttaaactgggccggcagggtggtcagaccgatggactggttagactgcgaagcttggacggttagatcgagtacaacggatagtgattcgttgtagaaacttgtgaatggattcagaataagggcaagaagtttctacagtctggatagtttgcaagtgcaaaaggcgagtagactggtggcaacaggctagtcaggtcgcatatcgaattatctggcgggaacatgatatatctgggattcgacgaggagttgagatatatggagttaagccaggactgaagaaaaggacccgggcaacagcgggtcaaatatcgttgatgggatcagcgatactgtttggcagtacaggctatatctaggatatgcgggtcggtatgatggggatatatggaaatctgcgtcactgaagaggaagagcgaaggctatcgtggtaattcttcgggtgatttaaagcaacagtgattttctcaaattatcaggaattcagtctacggatgcgggaaagcgtgaatgatggatttattagttcagttcataagacgacaaggaagaaagggttcagttcttcatgtctggtgagtttggtttatctatttggtgatgacaagggttatttatccatggattagatcaaatcaaatttaagacgaagatggaagtgaatagctaagaaggaattcaatttcgcttcgcaagacgactgagatgataggtgagaaggtggagcactgttgcaggtggattcaagaggaagaaattacagggatatcggagtctcttgaagacggtgggtctggcgtagactcgtcgggcggctttgcggtgaagctgcaaagaagacaacccaagtctggaggacaggtggatcggcatggtgattctactacttctaggtggcgtatatttgtcaaggtggagtttgttaggataggtgtcgaatatactagtcctatttggttacagttagacttggaattgtataggtgttagggggtggagttagagtcgaactctgtaaaccggcatctctcttaaatagaggggggcaccacaatgtaaccatggcgactacaatatagcgtagacacgcagggagaggatggcggcgtggccatggacggctaggagctatattggttggggaggagcgcccataatcagagccccggggatgtaggcttcggctgaacctcgttaacaaatatcgtgtgttcctgtgtcttcatctggcatgtcttgggtgatcaatgattgaagcgatcgggaaggttagtcgtcgttccgctatatcgactaacttttataacagcatctttttaagacattgtatgacacctttgatttttgcaatcgtcatcgaccaagacatctcaatgaaactttatggtttaagattctccaacaatattagcatatgaatctattcaatacctacccaaagaccgaagtccttctaaacatgctagtgcttcagcttgagcagtgaaaccacaaaggtgcagggttttatgcgcagccaacagcaccagtcccctacaatctttgattctactaaattcactacataaattattaacgttcgccttaatttgacaatatgccctaaattctaaaacactgtcgcttctctatttttctatattattttcttattgtaaataatttgctattgagatgtcaatgtgtcatcggtgtattgtacattgcgcctatagattcatgttatgtgactatcccctcaaatggaggtccagttcagcctcatatacctttgaagtaatatctatatggtaaaaatccgccgaaaggttatgtaccttacgagtatacccatattcatggtaaaaaaatccgccgaaaggccgctgccttcaaaggatcgatggtgaaggttgcgtgcattgagatttgagaatacctgaatctctctggtgaatgtccacgaggcaccggttataatgggacacataagtatactttcttacctgtaatataaaaaaagaactagcatatcatgagcatcattttgaagtctttttgaagacaatgaaacaatgtttacagttttgctctctactctacaaatagtgagcatcttttctccccatttcccttgcttcaggaccaatatgataaatccaaccatcacggaatatgtgctcatgtaacaaaccgcaagatcgatcgcagagacctgattgacgtgctggagcgatttccgaccatgcactgcacgattaaacaaaacgtaattaggcctgaaaagtggcaattaactcgcctgtcaacgcatcattctccatttctccccaccaaaaaccggaatcagagagtgagagagccagtcactcgccactgccgtttgtgcgctcccatctgcatccggatgccactgctcgctggtctgtctgtccataaatataaatattttaacggtttaattttgtttagaaacacagtgcaaatgtatgcacattcacccctatgaatgtatgcacacgtcctaccttatgagcacctccgaaacattggatcggcatatctatgagcatctccgaaagattgggttggtatattttgagattgacgaagtcagctgtcaatgagtatgtcgcctaccactgaaaaaaataattatctataaatacgagtacacggtcaaatatagaatttaaaccgagtgaactggttccatcataatgaacctaaccagttaagctgcgctcacttagctaaacagtttaaaatttgtttacaaatataagtgcttagagagtgttatgtatctcgtcgattgtctcctattcaaagttttttatactctcttcaggctgataatacttatcattttagacaaaactaaggtcaaactttagaatctttgattataaatcatttttaaatatttgtctttcaaatatggtgagtacatgtatagtttagtcttaaaagtactttaattaaatcatatatttgttaccacttttatatatattataatagaaaataatggtcaaaattgtttttttagagaccgtgctctttttcaaaacgataaatattatcaacccggagagaggattttacttccaatcacctcctaccctaaccattcttctttttgtaatgagcgtcgacatcagagtttttctaattacttgttaaaagatttaaaatatttatatttatgaactgaaagagtcgacgagtagtctagtctgatcactatgtta

SEQ ID NO: 61271 - DNA, 4551 bp, Oryza sativa
tgactaaatatttttaaatttttcataaatttttcaaataagacggacggtcaaacgttggacacggatatccacagctacacttattttgggacagaggtagtatttgctgtccaacgtgttgtgtgttgtgacatgacatgacatgacatgacatgatcaaccctctcgttgaggtgaatctgtcagtattacttatcctacctgaatgctatcagagagaagctaattgccctaagctttgtttgctgatacttgttctgtttctgacgaacaatagagaacattcactttttgaactttgataattcatcttcttttatatatactgaatctagaaacactaaataacattatgttattaaaaattattgtgctctaaatataagcatcaaactattttcacgttagtctaataatttaaaaacgatcgggatcaaagtggtcgctatttagaaacggatggagtagtaattaagtttgaaaaaaatgctgtactatcatgtactactacactagtaggattttgcaggttatttgctccttggctagctactgtttgtatgtcgtggtgtttgtactatgagcttaagagtgctaaaaaataaaaaaaaactcttttttttgaaacctaaaaataaaaaaacttcagttaccaagtgatactgacatactgtaagcatggatgaggacaagtacagcttcagttcaggctatgtccagattacagaagatacgaacgacgtgagtgcgtggatgacacagacagcaaaagccaaaaagagatgcttaactccataccaattatgtcgtatttattaatagaagcacctttcacatgatttgtataagagtatttactcctatatgaggtgatcatttattccgtttcaagaactagttgaatgtttatgttctgatacaaataaataaaatgtgcttacaactaattaatgtgattgtgtcaaagattagcatatacaaatataggtgcaccaactttaacattccttaatgcgtacacccaatttttgggcttttcaggagaaaataagcttctaaaacagtcaagtgcactaaaaagaagtaaaaaaatatcttttgtttgtttgagttaagaagctgaattgggctttggtttgaatatatatgcatagaactatcagatcatccatatgttctctgtctagtctcatcgaaggagtgaataatccgtttgaactttggggtagtatagctttccgccatggactccacacaaaagaaattcctttcttctgctgtgtttggagatgtagctgtccgaagccgctgaagaatattgcattattcttttggaaagtgatgtagtgaccacttgctggttctcatctcaaagaaacaatacttgcataaaacagaggagaccatgactcaaaagtttgcctcatatattggcttgtctagtctaggccatgaacaccatgcctgcctaacaattcaactttgttgtttaaatagcagttatattgggaaaaaaaacacatgttataacacgcgagaggagggatatattagctcaccaccatataaataacctataagtggtttgcaagtcatcataaaactttgaactttagagcttgcttatttgagacacggttatacaattttaaattttagagaataattttagcattaatataaggttttttttgtcctttttaattgtcatttggcattggctttagaccgccaaaaaaaggcacaaaagttttacactaaaattgcttcatccgtcaaccgagagagatgtgagagttgaagggatagcagggagaactcaccaatgactacgacaatgacttcctatgtgagcctctagatgtcgttggcatatgaactctggcaaagcatgtatcaccaggttaggttttcagggttggtcgatagaggggcaacaagggtggcttttgagtaaactctgaggtggctgaggaccaacgttagatggtggagatacgaggacgagcgatggcactgaaattgtagagatggaagagagcagtgaatgaggttggaaggaggggcaaagaatgcaatgtggttaggaggaatgcggcaatagttgctaagcagcgaggagagaatcgaagtgttgcgatggatggttacagagagtgagaagagttgactagtgttagggttatatgggatgtatgaatagagtaaatcttggcatttaaaaaagtgacttgcatctaaaatatctttagggtaagtgatcaatgtttttctttaccgcagcttgtttttagttggcttaatcatgtatctttgatttataaactgcacccaaaaaataccttccaaaacaacttttatggtgtgtttgaaactaatatatgttatcaacttctactcacttgtttttcacgcgtacactttaggaattgtttaacagtgtgttttttaaaagaaattcataggatagttgatttaaaaaacagggaatatttaatccatatgttaatgagctaatccgttttcgggaccgagcgcaccctaatctccacagagtgacagaggtgcaccgcaaccagtaagtatgagagcatcagcatgcaatttcaagctccagcaaagctgccgtcacggcgtgattctccgtgtctgctgctctgctccacgtattaacgcattgcaaggcacagagaaccctctacctcatttaaaaatctgaattgtgcttctccttttccccttttttttttttagaaaaagataggtccggatttctactcggaatccactaaaatggccattgagcaggagcgcaaacattttcggaatatacgaatccagcgttgcactggcccacccaaagtggggaccaccttactcacacaaatttctttcacagagaatcaccgaaatgcccctgcccataaaccctataaattgactgataagcaacggccatttcagctcagatcagctcaattcagagtgtgtgcctctcgatctagatctctgagttcttgccatctttaatttgaaaccgaaatcatcagctgcaatcttcgagattaattaggaagctaagatcgccatggcttcctgctgcggcggtttcatggagaaggccaagccctacttcgccatgatctgccttcagttcggctacgccggcatgaacgtgatcaccaaggtctcactcaaccatggcatgagccactacgtactcgtcgtgtaccgccacgccttcgccaccatctccattgctcccttcgcgctgatcctcgagaggtatacaatccgttgttttaacgtgtactcgtatgtacccttattgtcggtttaagcttctggatgaactggtcggtgcacggacttgattgttattgtacattgatcatatgatgtgtaacggaagctgacgtgtcgctacaaattaatggcattatgacaggaaggtgaggcccaagatgacgtggtcgatcttcttccaaatcttcatcctggcgctactcgggttagtgagacttgtctacttacagcgtaattacactataattatactataattatattttaaagatttttaataaaagaaatcttatacgcaaactccattgcgtatgatcttgcagcgcttttaataaaaaaaatctaatgaaggattgattatgtttagtgagacttagtctagttataatgtagttacactacaatttgtaataagaaaatcttgcagcttatgttttaaaagatagtctcatatgcaaactctaatggaggattgattatgtttctgccaaagaaaaggaaatatttgccaatgaaaatttgcaaaggaaaaaaggaagcatagcttgtctctggaatgacacattggattcacctgttcttggtttgttggtgcagaccggtgatcgaccagaacttctactacgccggcctgaagttcaccggcccgaccttcgcctgcgccatgagcaacatcctgccggccatgaccttcgtcatggctgtcatcttcaggttcgttctccaccacgtacgatctctctcaatgcatccatggcgatcgagagctagatgtgagctggtttgacgttaatgcatggtgttcgacaggatggagaagctggagctgaagaaggtgaggtgccaggccaagatcgccgggacgctggtgacggtggccggcgcgatgctgatgacgctgtacaagggcccgctcatggagatggcgtggagccggcacgccggcgccggcgtggcggaggcccccgccgccgccgccgccgccatctccggcagggactggttcctcggctcgatgttcgtcatcgtcgcgacgctcgcgtgggcgtccctcttcatcctccagacgcacaccatcaagcagtactcggcgcagctgtcgctcaccaccctcatctgcctcgtcggcacgctccaggccgtcgtcgtcaccttcgccatggagcggcgccgcccctccgtctgggccatcggcttcgacatgaacctcctcgccgccgcctacgccgtcagtaccatcct

SEQ ID NO: 61272 - DNA, 9757 bp, Oryza sativa
agctatcacttgcccacttccaaaggcgccgccgccgctgcggaggcggaggagatcaccggcgccggagaagacgacggcgacggcgacgatgacgcggagcgcagcaagaaccaccgctcgagtggtggcgtgaggtcatcatcggactccaatggacatggagctagtgcggtttgatggacacctaactccccaataatttggttgcggccgtcgacgcgtcgacgcgacggcgaccgtcgccatcgccatgcgtgcgtcgacgtcgatctctccgctttaagatatccgaactgttcgtctacggcgcgtgcactacgacgacgatggcactaagggctcgttaaatttggaaatggaggtttttgtttggtaggaaatttttgatgaacttttactgtgttaatttccctgcaaaatgtaagcgtttgtcacctcgtcagatgttcagaatggtggcatgcatatctctgcttttttttttatcatgtttgatcaaagctgctacgctattttgtactggtttcatcctctgtccatcagagagagtgtattgtgttttgtaaattttaaactcttcttttctcgttactccacgtttacaaatagtacatatcgttttgaacatcaacacagtcatactaacttcaactttttaccaatgtttaacaatttgtcttattcaaatttttttgcaaatacaaaagtatttatttcatacttaaagaatatttgatgataaatcaaatcataataaaataaatgataattatattaaatttttaataagacgaatggttaaacacatctaaaaagtcaatgcgtcatatattgaaaaaccaagggagtatttaactttggcgctatagctccaactattgtgtctacatcagtttggtggttttgctgtagacaactggataagactgaattcctaaatgctaatcattatcaaacaaaataaggcagagttgagtacatcagttaaatatataagtgcactgcaaagcatccatacttgccagttgccacaaaagattcaccaattgaaagatcctttgagcatctccacatcactgttaattaccatactgtttgcaaaattgcatgtgtggcgtcagccaggaatatgtctgatggacttagattcagattccactgagaattatagtgccaaatttgttgctttctggtaactggagcgatcactttacagcttgaatgctagagcaattaaccagagaaccatgacagtactagttgtgaggtgagatgaagggtagtaaaaaggacagaacatgcttaccacaattcttgattatcttattgtcagataatttgacagatatatagcatgaatttgatattatctaaaaagatgtagcatgaattgacttgtccatcaatggactagaacaaactgattgagtgattgaagtgaactactccctccgtttcacaatgtaaaactttctagcattatatgtctagatttattaacatctaaatgaacgtggacaatgctagaaagtcttacattgtgaaacggagaaagtactgaagaaagaccatatatataatgttgttcatggataactcataacttgactatttgcctctaaaagtctcaaagctaagcatgtataaaattgtggtttagaatattggccttatcttgaagcaagaagaaagtacatataacttcattccgttatcctattgctaacaacactagtgtgtatatatactgtttttagctacagatgcattattagttctctttctggtgagccatgccacattgccactagctctttgctgctgacatcctgatatgaatgtataataaagtgatacggtgcactaaatttacaggccttccgcccttccgtattggatgacactgagcaaatagcaaaaccttgtactagtcatactactttcagtgcaaaaccaagaatggatatcaaactctatcatgagagggagttgcatagcaactcttatcatgagaaggagatcataactcataagcactattaggaattgcattttttttccttccaaatttcaggtctctgacggtgggtatggccgaaattttttaatatgtttcaagttagcaaaagattgttcagattcagtgaaaatcactttaaaactcgcaatttttttcattttaaatttcctaattttttatccttcttttttcaattccaaaatgtagacccctacttaccacataaccaatcaaagcacctgcagggaaaccactaaccaacttttcaaaatcataactttttttttttcatacacaattaatgatttccttacacgcgcacataccaaagctacccaatatacactactagtttgtcaataacgaacacttcttttcaccaaaatcctaagaaaaattccttttgcactatgtatctacacagttacatctactacaacctgctgcaccaacaggtagacgcattccttcacagattatcactgcattgagctgcaagcttatcggaaaaacgatgagaagaacatcgctttcgcaacaggcacgcatgcgtgtgacatctgaataacaatgatctctcccattatagaattataccaatcaaatgaaaatctttttcttgaaaagaattagcctgaaaattctttatgcagtgtatcacaatttggtgagaattgctagctcaacgacggcaagttgctgcttattcaggtatccctactcagatagcaccgagacaatgcacatttagcttggcacaagtaagcccagctttgcctctctttttttctgcctaaaaaatataaaaattgtgactgtgagagttggggtttgcaactttaaattggcaattgacgtcttgcagattcagttgaaatgggagagaaaacttaggccaatggcagtgagagttcatgcaggtgagttagatccatggatggagcataacagttagcacggaatcttcaaaggggttgtgatgtcactcaggggtttgatttgggtttggcagataagatgaggtgtcgattctgggatgtagtaaaagccagagttcgatctgtttattgttctgcatgagatgagcatctctaaactctgggaggaagaacaagtgttaggtattgtgatacatattttatcttggtttccattagcagatttttcaaactactaaatggtgtggtttgtgtaaaagctttctatatgaaaattattttaaaatagcaaataaatttattttttaagtttataataatcaaaaattaattaattattctctaattgtttttcatttcatgtgtgttaacttaatattcatttttgtcaacttcaaacgggataaccgttgtggaactggattggttctctttacataacaaaatatcgtttcttccgtttccatatatcccacttcgaatcaggattaattttttctccattgctgggccgacatgggcctgcttcgtttgagagatgggccgtgcgacgatagaagcaaaggacctctcgtcctctccgagccgtgtgtaataagttcatctcaagtcccttaattttacaccgagtccgattttcgttcttagaaccccaaaaccagatacaaccggccctcgaactgtcaaaaccggtgaaaacgaggtccctagcggttttgaagacggttttggctgatgtggcgtctacgtggctggtttgactaggtctccgtcccatgtggtattgatgtggcgatgacgtggcaattatatcttggaaaaataataaaaatcatgggcccacatgtcagccacaaaaaaaatctaaaaatggtggggcccacatgtcatctggttgtcgccgtcgagcttgtcgatgtcctcgacgacttcttttggcttctcagtaatgccacacgagtgctgccattaataacatcaaattcagattcagctacaatgcgattatgctgaaataagcaggcaagcataggtgttcgatcgatcactcaccttggaacgagcagtaagcccagatgtaagcgtgttcacgaccttcttcctggagtacttgtgggctgaaccgccgccgctgccgctgctgccggtgccctccgacttcgaaggcttcttgttctcgttgacgccggcgccggtgctggccttggcggtattatcgggacgaggtacgacctggccgacttcggagctggttccttcctgaccgggttctgcacgacaatctgcgagcaaaatcaaaattggggatcaaaccaaacgctctgaattcgcaagaagaatgaggaacagaaggggtgtctcacccgtaccttgttcaccccaacggcgttctcctgagctttctttagaagctgggcgccgaagctcctggtgatggggcgattgatcccctccggcagctacatcttgctgttgcaagaagaatacgaggtttcagagagggaaacgggaggaagaacgaatcgggaaaggttggctatgatgatgtcatctactatatgattgtgtgcgtgagatcgttgtcttctactccggatcagcgaataggccactagttattcaatacgttatcagcacgagattgctcatacgctaatcccggtaagtgttctagtagatcaattgatttcagtactaatcagattgatatgttatctgtgtactgctcgtcgccggccaacacgaccgcccgctcatgcgcacctgcacgccgcgctcgacgcgtggctgatggtcgccggttacgacgccgcactggagcatgcacggcagcaggacgcatccagccgcgcgtgcccgaggcaaccagccaggcggctctaccacacgcagtacgcaaccctgcggctaggatccaggagcaaaggatcaagcagacaagcatacatgcacatgaatgtacagattggtttatgaaccaatctagtacgtgcacgtattgatcttcaccaagcctataacaacatgggtgtgcaacgacgtgtcgacagtgctgggctatacacagctacaccagcacgcaactcgtcgacgccgcgtcgccgatacgctatgcggacgtgcataagcggatcggctacctttacatcggataaacgagataagtatcggtttcatctattctaatactttgcagtagcgagagtaatatgctagatcatgcctctagtcgttttattttctcgcatgaatagatgtatttgtctggccttagcggcgactcttctcttgttatatcgctgaccacgaagtttggcaccacgcgcccgaacgcgcttaccgtgcacaccagaaggtgcacatacataatccgttgaattgaatgatggagtgctgtcccgaacgacgacacctcacactcggtaacacacgacaccacctagaagttgtcgtctatctggctaacatagtcgtcgatctatgaatatattaacacactcgtcatcaccgatcttatggatcagcgtgcttgggacaatgttggttgtgacttgtatgttaataatccgttatattgctatctatatgaagtagatggtaacaaatctgagtcatcagcacctgcatgcgccgccacctgcacgtagcgacacccagacgccaccacatgacgtcttcccctttgtcaatggttgccgaatcaatccagagaccttccctcgtcgatccgccatctgaaacaccgactcgacggcctttcgaggccatccgcaacgcaattgacggccgtcgcccgtagcgatgccgaggagcttacgcccgcctccccttgccgccgatacgcacggcatgcctcccacgctaccgcacgcggccgggacgagggtcgaagccgccgtgagtgcccgccgccgatagccgtccgccatgccggcatgtatgccgagccgagtttcgtcgacacgtaacatggagctatgattgtcggacgctggtcacggcctgatgccaaagaatgccggtgtcggtgctactagatgttgcaccgccgctccgcctctgaccatggcaacttgccatagtcgtccatctctaccgagggctcactagcacgtttgcaattggttccatccgtcgtctccattgaagaatatcaattagatcatacctcacccacttcttgtaggagaaggtcgtagtagctcattgggcaacatatgagatgggctggccagattttcaagctagccagtataaggaggtgggccaagtagaaattggcctattaaaaggagtcgggcacgaaccgtgattttggtccgaaaacggcattttatttcaaaagtccttggtttccaaggcattatgcagaactcggaaattatacggataagtcctatgggacattagaaactacggggaatatacattcgccatttatactttgaaccttcatgaattgggtttacgccaaatagagaagaactaaggatttataccttagtcccgtatttctaagtatttgctttaactatttagttagtttcttgaataacataatcaatcctagaaacattgtttttaggcaaaagagcttccatgaacttgtgaaacccttgttttagcaccccttttggaagcatcatattttatggtttatttcctggcaattgtttgttttggggtaattgattgttctgtgggttagtagttctgtaaattacacatacctttgaatagcaaaaaatcatgttaattgctaggattgtaataaaaggtgtgtatagaaaaccattctttactattttgtactcgttttgtgcactttatttactagaagtaaaccggtagaaagttgcataaaaggacatcatgtaagtagttgcatgtagcaaatacatttattgggcaaatgagtaatagaattattcatatatcttctctttgtgtaattgtcgccacatttgtagaaggcacaattatatattctccgtatagaataaatgtatacactcatcatgaagaaagtatattattgacttagagatatttcttagtgtatgactatcatagaagataagttacaactaatttatattaattgtgtccaagtagatacaatgtcatcgaatttgtgaatatatagacgagaagtctatatgccaatatgccctacacaaaattatctatcaaaagactatgtacctatgcagtgtctatagttaatttgattgataatgttatgtccattttccacgtataaatgaatttacaaatgaagtattgtttttatgaatgtatgcacatcaattttggcctatatgcaacatgtttagttgttagaattaatacacaagaagttgtattactgtcaacatgtgcatttgcacgcacatatatgacttatactattaatatattcatgaagaacatgcatactcaaaatttgtggaaggaaaggaatttggtgtatttgaatttgatgttcaactcagggggagatgaatagtaatgacagtaatcttgcattcgttcttttgagatcgtattttacaatacatgagttacattacagattagattaagttcaatatgaagaacatggttaagctcatgtagagcttctttatcttttgctttaggcatagaagcttctgcattagattactgaatatttttttatataggtcatctcaccttacctatattgccttttttttacctgtagtaattctttaaccttttgtagaataaaattgtaaattatatgtctaacattgaatgtaaatatttgtcttgcctattatttgaagtatttttggcgaatgtattcttattatccactaagcctcaatcaaccatgtaggttggtagttctaagtgcattgacgccatattggcatacatgtagagctgttcacttatgcacatgaacaattagaatatttatgtttaagcattgaagcttaaatatatccacctgcaaccacattatttctttttagaaaagttgtaccatgaagtcacaacaaatatgtgggtttcacgacaactttttagtaaattttcttatgattggcgtgaaaagggggaggaatatgtgtattttgcaaattaatttcagaatatttataataaagaagcataagaaattgtggatatgtggcaggcaaattggtgtgttataggtcaaatgctagaagcaaaagatagcccaaactattagcgaatcatatttgggataattatgaattattgtcacacaacgaagtgtgttatttattggccattgaaaattgcatattcatcaaggaagtatgaaattgcatatagctatttaaaagctattggtttacttgtagtaaacaatatcctaaaaataattaatgaccttttggattcgaatgattctgaatgatcaaatgacaccacatttactttggcgtaatgaataaaagttagacatgtcacccaatttatttattggcatattcaagaagaataaatattctcgtagaataatgtttgggtgatttgaaaagttccatgatggttaaactatgttcatagattaatgttttagtgctatagttatgttcttgaagacatcatgaagttatataatactaacacatccatcttatgatcatatctatgttgcataaatataaacatgaagtttattgatccaacttaattcaagaattgaatatagtatgagtaattggatcaagtcttgggcaaataaaaaaaagttagaaaatagagtaattttgtcgactagtggatatttgtttgggattcattgtcgcagaataataaccctctatgaattggataacctacagtattagggatgtgcaatttttcatgccattgcattaatttttatgttagctcactgcatataatatctttaccccctttattttgtataagtgtgtgttcaatgaatgaacattttcctcatatatcaccaccataacatacatatatgggcctccacatgaagttggggatacaaatggaccgaattccattaatccagtgcctatgataggggatttttgtgatatgctattagataaagatcgaatatcggcatcagggggagaaaagcccatgtgttaaagatgccttatattttcaagaagaaaaagatctttataagtaagaataacgcacaagccaaactaaactagaaggtttagtttattctcctgtaagccagaagcgggagcttgccagataattatgaattaaaggagtaatcagaagttatgtttacttgtagtaaactttctgctaacagcggtataccccgggttttgaatagtatatccacaaatgcagagtgacatgttagtcaatgttctaaaatctacggggacgcctgcggattctaagatctaacgactattgtcaatgtacccattaataactccttacaactattgtagagtaatcaccatgaaggtgaattgcctcatgaagaggttcatcatgaagatgaaaacccagaattaaagtgcgcacatctatctaattctgggatgcggaacaaccatatatcttatgtttgggaaatgactaagatatggtttataatgaattaacctcacggaatgagtatgtggagaaaagaatagttatcgacaacatcgcctctatgattgctaatatttctctaatgagaatccggatccggaaccaaagtccatggcagagttgcatagtagcactcatattggttctattgaagaaagcaatgaggttgaaccatagtcgctaaata

SEQ ID NO: 61273 - DNA, 4032 bp, Oryza sativa
aaaatgacttccggaagaataagttgatctctgtaggactatgctaatgtatgaattgccggttaatctccatataacaccaataactcgtactcccatgaagtggacagacccgtttaaacgaatgaattggtccactagcatgcaagtggatcggtagttttctacatactatgaaggtgtaagaatttatatatcatgaagatatactttttgatggtatttggcaatcttattaattcccctaatgccaaaatatagaccagtttatgtcactctaagtggtttaagctaattgttgaagattagtgaaacaatcaaactggtaatgattgataaatccactaagagaaagttgcataatatttaacctcttgtattgagctaattattttatacataccgcatatgtgtaacgttgcaacttattttcccatagtcctccgtaaggataaaactttgtttgtattgcacatttgactaagtggttatacatattgctcctatacgttgatttatttctcatgttcatagtaaaacttatgaaataagtaaatgaaagattaaacattgtggtaattttattatcattgttttacacattaataaaaatatggttatgacattggaacatgaaagtttcaacggatgtcttattgagggggagcatatatgctaaacatttattatcatacttaagacttggaagtcttatatttgatttaccaagaattaatcaaattaatctttgttttgataatttaccttgaaggttactaccgctatattgttgtgttaatccaagttgattaatacaataaagcatatagatcattggctatttatgaagaatgtatatcttaaagattatgcgatcaagaagatcgtgtgttgtactctttttcccttagtgagtttttacttgaatatttctcacgcaaggtttttaacgcggcaacaagtgcgatataactagcgtgtacgatgtactcttttctcctatccttttctcccactgggtttttggatggagtttttaatgagacatgtgtatagcgcggtattcgcccaaggtggagtgttataaaactattatctcctgccagagataaatatggactcataccaaatatatggaaacgtatcctaataggactcttcctattataggtatatatattgagagagatggcttgagaggttggttgatgtatccacatatgagaaagcaataaagctgtgatgcctctccctatatccgtgttcattattcatctactatatgattgtgtgtgtgagatcgtcgtcttctactccggatcagcgaataagccactagttattcaataattgcaaccctccagataagcagcggagttcagacagtgtggcaacgactaaccgtacattccatctatttttctagaacattcatcttataattactagaaaaatacctgtacgttgcaacggatgaagttattttaaattttttattgttattgtttggttaagatgaaattcactgtgttaaattcacttggatatatattttgttagaaaatcatgagttgtaattgggagtccaatcaaattaacatgtgaatttttaaagatatttctttacgattcttctgtatttgcaaaagcgaacgaacttaaaaatcgatttaaatataaatttgtattttcaaaaacgaacgaacttaaaaaatgactcatatacagatgacataccaaagtattagtaaaaacatcttcaatttttataataagtaaagatacagatatagatataaggtataagctatccttagaacacctttataataataaaattaaatcacaaaaaaagtaataattacttttttttctgaataagccacggagcatttcgaactttcagtacagacttgacaccatgcgccgagccaccacctaccgtagcgtgtacagtgtatatacaaaacccaggccgtagagccggtcgtcccatagaaatcaggcccacaggaacccagaacgcatctctcgccaaacacactattccaatgaaaagtttgagtatgattcactcgtgccagatttgtgcagaatctgcagcatgttccaactgcagagctgaaattagtttgtttgtactactctgaatgggtttttttttctttttttctctagacattgtttctttgcacggtgattgcaaacgcagtcctgtagccagtcatctgtcctccttgggatcttctgtgagtgttagcaatggcccatgattagaccacttaagtaggcccgtagtattttcagacaaagaagcaggcccgtaattaaggtaccacagcccgcatttgatttgaaagcagagtcctagtttcaaatttggaattctgaaagtttcaatggatctaccgtaaaattcaggtaggattccagcgattttcaatgtttttcgtgaacgcgcaagagattttcaatgtatcttctggaattcctttcttcgtagtaaattcgatcagctcaccttctcttgttctgtgtagtgcacacagagtatttgtcgctctcgtacgagtcaaatgagacgcaggtgtcgttgcaatgcaaccctccagataagccacggagcggagttcagataatgtgccaacgactaaccgtgcattctatctgtttttttatatcattcgccttatttcaaatataaacatatatgaataaaaaagtgtaagctatgcttagaacacctttaatggcaaaattaaatcacaataaagtaagtgttaattaagtcatttttctgaataagccacggagcatttcggaaataggactttccagttcaagcatggtttagttttcaactttttctcaaacttttaacttttccatcacatcaaaatcttcctacacacataaacttccaactttttaatcacatcgttccaatttcaattaattttcaattttagcgtgaaccaaacacaccctcagacttcacacctcactaacacaatgcgccgagccactacctaccgtagcgtgtacagtgtatatacgaaacacaggccgtagatcccgtcgtcccacaggaatcaggcccacagaaaccgagcacgatccatctctcgccaaacataaaaaaccaacacactatgaaaagtttgagtatgattcactcgtgccagattcgtgcagaatctgcagcatgttccaactgcagagctgaaattagtttgttaggagtagtactttgtttcatgtaaaccactaactcatagtagtacaaaacgttctcaaggacccctgaactcgaaattttcgtctatcgtatttcacaacttttttttttgaacgagtcgtatttcacaatttgcgcttcttgaattttgctggtttggaacttttttgagagaaagtaggagtagtagttttggtcaacagtgtttgtgatccaagtccactgcaagcttggaaaccagcagcagcacctggtatcatcggtggttggtgaaactcggtcttcttagaactaagcaagaacagctcactggaacaagctcgcccacttcaaccaagcacttagcagttaacactagtaagtcactaacacacgaccagcccatgttttatcacagaaaaaaacataattaacattaaattaacctcaaacacactgtttgctctgacaccactaatagtccaccaaatttataatcctcaagaaccaagaggaaagaaaaatagcaaaatgagcttatgtcaaatggttagtttttctgtgctgaaactagttcacattttagacttgatatatgtacggttaattattttcttagtggtaagcgatgtatttgtaaatatcgacagcaagacatctgtgttcacttcatcatatcctgactcaatctttcggggtgcccataagaatagggtttatgcatgtattcataggaattggtgtgcgctcattgtgagcatctgctttagggcaggtataatagcacatactacaagatgtaatatgcgtgtgac

SEQ ID NO: 61274 - DNA, 7672 bp, Oryza sativa
  unsure (1)..(7672): unsure at all n locations
ccccccccaaaaccaaacggaggcgagctcgccgccgttcaccgccgccgccgctgccatggacgtcgcgtcgctgctcccgttcgcgctggcgctggtggcgatcccgatctcgctggcgctgctggaccggctgcggctggggcggatcccgccggggccgcggccgtggccgatggtggggaacctgtggcagatcaagccggtgcggtgccgcggcttcctggagtgggcggagaggtacggcccgatcgtgtcggtgtggttcggctcgtcgctgaacgtggtggtgtcgacgtcggagctcgccaaggaggtgctcaaggagaacgaccagctgctcgccgaccggccgcgcaaccgctccacgcagcgcttcagccgcaacgggatggacctgatctgggcggactacggcccgcactacatcaaggtgcgcaagctctgcaacctcgagctcttcacccccaagcgcctcgaggccctccgccccatccgcgaggacgaggtcaccgccatggtcgagtccgtccaccgcgccgtcacccagccaggtaaagcttcaagaattttagtgttctttgtgtaattttgagcaaggagagggtgcttggtgcaaacgtggttggtatgagtttggtggttgtggcgtccttgtgtttggtgacgaattgttatgtcgtgttgactctcatgtgtcagctaaattgtgctgccttagatcagcgattgccgattggtactactagttgttttgcaggcttattggtgctcaatttgcatcgctccttgagggaaatggccaaggcgtggtctgccatttcgtaggcttcgctacgatatgctgtgcggatttggtagtggatcctagaggaaatgctagctattggtttgatctggtgggataataaactaataagaggagttgaactgcctcgagtgagtgggtgcatttctctgagatggatcacatggtgagcacgttgttagagagccaagctaagattttacttgctgaattgaaaatgtaggtaccatgaaactaggtagtgatcatactctgcccagctgtactgctgtagtgtgctgactgctgagagaccttggccctggggattattggttatgagctatggttcatgtcaagcagatatcgtaattggtatagttatagtaaagtgggcttcgtatgacttccagtatacacggggttggtaatcacatgctattttaagcttaagtgaagacagtttggtgctttctgcattattgttcattaaggcacttcacacctctctagtggacaagaattacgctattccctttttggtatataagtttgctctgttgttggcatgctattttagctcctcacatgataagtactctacttgctgtaatgtgacaccttgctagttgaaacaatactatgctgtttaagcttcttactggtatgccaagcattctcttgtgatgttatgttgtaccagtttgacagtcaaaaaaaacatgtttggcaacaaccttgtttgaactggttggaagtcttttttttttcttctaagatgtttgtacattttgatagcattggagtttttacagactaaaattaatgagctgctattatgtactttgcccatctgtctcaactgtgctgacagttgatacagcttatcagcgactcttttcaacttatttctgactttgcaaccaattttatgttccatttgtgttgctgtttcaatgtagtcctcaacattgacctagccttctctctattttccaatttagtttacaagaattaagccaggctgtttagaaaaatgaatgaatttagctttatttatactctgttggaaaaaaattttggcctacaaatgcatcctatgaatacctggtgtcaaactgtcaattgcaaatcgatccactagctgatttgtttacatgtgtacataagttagcaaagcttttttttttgttggcctaaagccatgatgggttacctcaagaaaaaagaaaaagaagtatattgtgcacgacatacaataatggaacaattacctagcacggtaagagtctatttgcattggaatgaagtttttaactaacagtcattttatcgatgtgctgttttcaggtagtgaacataaaccaatcgtagtgaggaatcaccttgctatggtggccttcaacaatataacaaggctagctttcggcaagaggttcatgaatgcaaatggtgacattgatgaacaagggcgtgagtttaagactattgtcaacaatggaatcaagatcggtgcatctctttctgttgctgagtacatttggtatttgaggtggttgtgtccacttaacgaggagctttacaagacccacaacgagagaagggatcggctgaccaagaagatcatagatgagcatgcgaaggccctcaaggagagtggtgccaagcagcactttgtggatgctctgttcactctcagagaacagtatgaccttagtgacgacacagttattgggcttctatgggtatgttggatgttcctttcatacttatcagtatctatcctttttgtcatccaatttcagatatgataccctactggactattaatatcaatgctctcccaattacttttacattatttgcacacatgttaaatatcatctctcaaagtcatggagaattttttccactctagtcagatttggtacatagtttgtgtggcatgtcactatcttagggttggtgaagtatggtggtatttggaaaagtttctgtttactttctagttggaagttaggttgtgttttatggtttcaatcatctacctactaaaaatgcgagaaagttggaaaggttagaccacttagctagtggcaactaccaaaagctttcaatggatgcctctgcatgcatttccctatcttgcatcgcacatggataatttgcatatcaagtttgttcagactaggaaatgaataccataataatggaagataaaaaacaaaatcccgataattgtcatgtgcctgaattttctgtcctgctaactccattacatttgtgagttcttaccatccctgttatgttccttgtgttcaggacatgatcactgctggaatggacaccacagtgatatcagtcgagtgggcaatggcagagctggtcaggaaccccagggtgcagaagaagctgcaggaggagctggaccgcgtcgtcggccgcgaccgcgtcatgtcggagaccgacttccagagcctcccttacctgaacgccgtcgtcaaggagtcgctccggctgcacccgccgacgccgctgatgctcccgcacaaggccagcacgaacgtcaagatcggcgggtacaacatccccaagggcgccaacgtgatggtgaacgtgtgggcgatcgccagggaccccaaggtgtggagcaacccgctggagtacaggccggagcggttcatcgaggagaacatcgacatcaagggcagcgacttcagggtgctccccttcggcgccggccgccgcgtgtgccccggcgcccagctcggcatcaacctcgtcgcctccatgatcgggcacctcctccaccagttcgagtggtctctccccgagggcaccaggccggaggacgtcaacatgatggagtccaacggcgtcgtcacgttcatgagcacgtcgctgcaggtcatcgccaagcccaggctcgacaacccggacctgtacaagaggttccctgtcgagatgtgatcgaacagtttgctttgctgcctgctgctgctggttatacagacagactggagttctgctttcaaagtttcagctattgctcatgatgttgttgttgtaaaatttgaggtgttaattgccttgtgaatgaacgaatcaatcaatctcgtaaagttatcgagagcagatcgacttttgtaatttgtacaatatgactatgtacttaaggtgttttgttcagatagaattttgtaatatgattaacacgacaagcgatgtattttgaggtgtcattaatgaataataataatgtaatgtaatctgcaatttttctttttttttctttctgttctgtttctgttgagaaacaaagaattaagataattatgatgatgataacatgacgtgggggcgaccttatcttgaggcacgtccaaaaacgtctgcggttgttacacctaaacccagataaagcaaagagcccaaaacgagcgaaggacacgagacgcgctcccagccgtcggatccatccggagcccccgaaaacggacggtggatggagacgccagccccctcacgtcacgccacccccccccccccccaccaaactaacgtggggcccacaccatctccgcttcgggggtgtgatggtgtggatggatagaaccaacggctgacgtgtacccgaacgcgcaacgcgggggagtccaagctaacgtgggccccacacccccctttcccctcctcctctctcttcagatccgcgcgctgaggtcactgtagaacacggcggtggacccggtccacgggattaagccggtgtagtgtagacccgtctgggtggggcccacaacattggtggatcggtctatgcaccgggtccacggaacgggtctcgtgtagaggctctctctctctctctctctgggtgggggttgggtttgcttcgctcgcctcgctttgcccgattcggccggggtcagggtcactggccgagcaaattagggtggaaaattttttatttatttatttccgcaaagaaaaaaaagttaaatatccagtaacggaaaccctaatccccaaatcacaaatcgattcgattcgctatttaatgtggtgtggttttcttctccgattcgatgtcctcctccgctccggccccctcatcgatcgagctcgcagccgccgtgttccccgccggggaaggtcgtccttgccgttgggtggtgttcccggcgctggattgacgccatgaggaagaagctggacacccgcttccccgcggtatggttcatatatgcgcggattttttttttcagattagaaattgttgttcaggtgtagatcctgcatgcgtgtatatagattctgcgatcgtgattggtatgtttatttttttcacttttgcctgagatgtgtttgttgcatgcacgcttgttttcggtggttaggttttgctaacaatttgatgcaatgaaattatggtgcatgtcttgcattttatctcccttgttaggcttcgcccatccacatattaggaattattttttgttgtaatttgccggttattttctatgtttgtttgcgagcatgatatatatttttattttgttttaacggtatctttagtgagataagtaatgaaattgcggttttgtgtgggtgtgattctgtatgaaactggcttattcgatacacatatccagaattctggagcctgattggtaattatgatgtgaggtagccagtgagtatttggggattcctaaatccagtactcgtacatttgtcatgtatgaggatgcctgatgtgagaaattttggtttaatttgctgcttatttgcataatttgtaataatagactctgttccatgtggtcccacctccaactgtgatcattaaataaggttatgctcctgagcttcatgggaaaaattagttgcccatatgcattaacattttactaaataatacattatcatgatttgttcaataatacgtcagtctaatcatcactattaatagtaaagaaacgtcaatgtgtgttttacagttctaatgctagtacggaccaccaatcatgtacctcttgatccgaattagatgcttagatccatatatttgatgtaatgtgcatttttccttgcatggatgttccctcattttgttaaagacacatggagtccttaaatagaataaaagtgcactatttatccttttggcctctgcactgtagcaaaatggtatcatgtagaattctactacttgctgcgggtctgctgtacaacaagttgtagctaaatccttatatgcttaaagccatgcattctgaggagatgctttcttaattaacctttgctcttacaaggacatgcagaatcatttctttatatatgttagggctaatgcttataatctcatttaacatgcccttaaggttgacatggtcggagctctttagtatatgttagttgtaattataaaaattgcatgaatcagattcttttattgttaccagtgctctttcagacaatattcttattttgtttgatgtctgtcatgtgttgcagcctcggattaagaaaatcatgcaagcagatgaagatgttggcaagattgctttagctgtacctgttctagtgtgtgagttttccactctgtttaatcttccttttattttattatatagctatttaactctcagtaacttattagtattcggtttagaggctcataattattttcgctacaaactgcactcctttctgccactaagagttaagtagcttatattttagaggccaaaacatatgagccttggagtctatgtaacaggaaatcatgttctgaatgataatcgatcttttcggtttctagattacaaatcatactgcctgcaaagcattattgattgtattagggaagacatagatcaaagctggcaattattgttgattaagggggaggggggcaggcttactaccaaagtatgttaggtcttactttgggctgttgtaatattgaaatcaagtgcatttgtacatgtactgtagacttactccctgtgtcattcacaccatccttaatcatgtaagcccattctccttcaaatttcacattgcatgtcaggtgcactatcaccaccacatctttattttggattcatctctagcgacctagtctacatctctgccatattagaatcaaccgatcctgtatgagcctgcatggccatgttttctttattcccctgatatccacctcgcttttttttttttgcgtgagtcatggtggcagaagttggggagcaatggggttggcattgttggttggataggaagagcagtcagatatgatgggggttgaatttggtgagggtgaggggaactagagaagggagattttggagaagagtgtaggagcgggagaaccggtgtccacatggtgcagcactaaagaacattgaatcaagtggatatattacagacaatttggctttatggcacggtatggattaagtaaaaacatttggatgtgagcccatatttagctttcctggaggaagataaaaaggtaaatgagtgaatgtaaaaaaggataaaatagctccatgcaaaataatatcattgcaaggtatagatttaatttatttgtttgcacttgggtgctttcttttctcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 61275 - DNA, 716 bp, Oryza sativa
cctcgtggttatttgcacaaccatgtacttcagaactgtacgtttgcaatacaaactgcatgtgtctaacagcttttcagaaagccacaagagttagaactctaaaatttcaagcctgcaacactaaattctctgtgtctaacagttttacataatcgtagtactatgagtaaaagatgtatttatacacttttttttttgaacaagtatgcatactagtagcagtcccgcaaaccatagattggactaaaataagataatgcacaatcaaggtagctgcccaaaacatataataatagcttgtttcacataatgaaatgcattccagtaggcagtatgtatatacgggtttgcgatattaaaaaaaaagctagagataccaattagtacatgcaaagaactcaatgcgtacagtagccaaatggttagagagcattctggtttaaaggttgcaggctacctatgtgtatgaaaacctcagcaacttgattgtgtgacttttgtatttgatgacggacagtctccccaatatcatgtgctgcactgacacttaagaaaggatatacctacaatacaacagatatcataatcaatttctcttatttagcacctaagcacccacattacaaaactgtcagggctctcatcttgaaatccaaaaaaaataaataccaaagcaataaactaaatcacaatgccatgtacctcaatgtgta

SEQ ID NO: 61276 - DNA, 2476 bp, Oryza sativa
  unsure (1)..(2476): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgcaggatttgttgtgcactgaaagggaagagaaaagatttcacttgtcaggcacagttagtgacgtgacctgttcttaatcagtagcactattacacatcagaatgctcaccaatgagcctgaaatcctggatccctacaaatatgtgctcaaaatgatgctcttgaggaaaaggtattcaaacacctaccggttagaacaaacaaccaccggtttccttgtgttgagttgaatagtagtagcactctactcacagagttgtcaatgtgagagaatagtagttagtacatgccaagcatgcacacaagccggcaatgcttttgagtcactgacacatatgaaccaaaaaacaaaattgccttctctgatctgatctacctaagcacattccttagagtggaggatgccctacttccatccaattgtcctaatcaccaatggctaattaacaactagccaaagcattggtttaagaactaattactataaataaatctcctacagttgaagatccattagctaagttgcccctactgatatgtccaccactcccccattatgtccccatcagccacaatatataaatcaagattagattagtgaacaaattacatgtatttaatcttgccatcacctaagctgagctgagcagagcatgccggcataaatcattgacatgtggacaaggccaactctttatattcaaaagccttcaaacaaaccggccagcttggcctgaccctaaactccagctaaaagttcataagctgagctatcacattaagattattaatgatcattatcgggcaaacatcatcagagaagagaaaaaagatgactaacccataacgattaaactaatacataagattatgtatggataaagtaaatctatgggtatggtcccctgtaaaaagccttagggcctaaagacttgaaagtaacagttttcagcatttctggaatgcatgtagtgtttcttaaaacttagatcttatattggtccttttaaattctagttttatatttaaaaatgcatttgtgaacataagatttttcttttcgcatctctttaaagggagcaaaataaaacaataagataaccaaattaaagcacgggagcacaagccaatacaagaaatgggaaataaacactattagtgcgcgaaaattagctcgtagtctttttctatgtccgtgtttacgcattccgattttagacacataaggcatcacaatttctattgtaaaattatagtaaccattaatgccttaacacttagtggaatatagccagttactaaactttaaactagaaaaaaatatagtatattcgtatccatcgttttaaaacattaaaatttcaattgttccttatagaatctacgtaagttgttatgcttataaaaactaacaccctagtccgccgtcctagagaaagatgcagcatgatgagagagccatcctcaatcctcatagcttctcacaaaacgaagagatgtagcaagaatattctctacaaaagatagaaccttctctatccatagaaaaataattagtacttatagtagttatgtaatctgttatatatatgtatatgtctttgccttatacaaaatgataagagaaaaacatatataatttggcgtgtctcattacaattacatgctctagttaattagaacagtaagagaggaagtgaagaaaaaaaaaaggaaaaagaaaaaaaaaagaaaatgctcggtgaaggagagctttgacctctccaatggaggagagtgtaaacaagctactctacctctcctcaactactacttctcccggccggcctggcctgctagccggcggcggcggcggcggcgcgtggcgttcacatgacgctgcaggcgttggggttctcgtcgtcgaacatgcggtactcgtcctgcagcggcggcgcgtgcgccgtccccggcgggctgtagtagtcgcggtagtaggtgtccggcgacgagtgcgggtacggcatgtacaggtacgacggcgaccactgctgctgcattgcctgcggctgcggcgacggcgacggcggcgggtattgctgctgctgcggcggcggcgcggagtacgccggcggcggtgggtgctgctgcatggagtacgccggctccggccgcggcgcgtagtaggagacgctcgtcgtcggctgcgccatgtggtagctcatcaccggctgcggcgcgccgtagtacgggtaggggtagtgctcctcgtgctgcttgtgcgccgccggcgtcggcgagaagtgcagggacctctccgtcgttgtggcggcggcgggtggcgcggcgtcgccggcg

SEQ ID NO: 61277 - DNA, 1564 bp, Oryza sativa
aaaaaaaaaagcaaagatcatctcagcatccccgaatccgaatgcccgcccccgtcgccggcgaagcgccgccgcacgcacgcacgcgcgccacgtaccttcgatgctcctgagcaccttcctgaccttcttcttgcatccgaggcagtggatggacaccctcagcaccacggtccgcagctgcaaaatcacccaaccaccatgtcagcaccggacgaacacctacaaaaccccaactccaaccatccacatcggccggcgtcgcacgctcacctgctgctgcgccgcggcggacgtcgccggcgccggcgagaccgcatccgcagacgccatggatggagcgaggcggattggatggatggatggatcgagcaccgttggattggtgagagcctttcttcggtggcgttggggggagggagggagaggccgcgtcggggtggggctcgtacttatactcggtggcggtgcggctgcgtgtgtcgctgacacgtggggcccagcccccgcccgcccttctcctcttttgcaactgtagcggcggtggttgttaaggacgggggagactgtggcggctgcgtgtgggggaatagtctaccgcggagcactgtgacagtaacagtgtgatacggaagtggattttttttctcccttgttttgtacatctcgtttaaaaagttataaaaaaaactattaagatagatcaatatatgatatatcttttcgcaaacatgcgagttaaaattagacttatactgttcgaaacaaaaatagcaaatttgaccgtgaattacgcgtttagtcaaatttgttatttttgtttctacttgtataagttgaatttgaatttacatgtttatgtttgtgaagtgacatatcttatattagtctattctactaatttttttaaaaaaaatttgtaactttttaagtgacatgaaaataaggggatatccccttaagagttgaattgagttttccgtgtgatactaatattaatattattactgtttttctttaggggaaaacacacatggaaatgttccatgtgacgtgaaaagacgcatgaaatttgatagctttgtcaagcagagccttaggtcatggatatttttgttaccatgtatacgaaaatgtgtggtagtttcatcgaagacgagttctaggagaaacgcggacagagatagggggtttgacatgcatctggtattcatcttccacatatattcacttgataagattgtgctcacggacttatcttcctcgatctggtctcataatttttcaacactattaactgaagttgatggtatatcttcctcctcccccgccatttgtcatattgataccacgagaagtttggtaggctctcgactcttgtattctcttcgattttaagaattggggagtcaagctaaattctcgttgatccgagaaacggtggaatggaatggattaattggagtgtatctaaaaatgaacgggactacctatacatttgtcgacaaattttctactaaaaatttgacatatataattataatacaatcatagtgtaattaca

SEQ ID NO: 61278 - DNA, 7887 bp, Oryza sativa
gctctgtttctttcagcttgagattattataatctagattattgagtcagattactataagctagattgttataatctgtgctgaataagcggttagttgtttctttcctagattattagagcctaaattattgggtttgcaagtctaaagagagagtggggtggcatggtgggtaatttttcacccaataatctggaaaaaaaactcacctaaatgagcttatcagattataataagctacttcaataagttgtctgtttcttttagcttactcccaataatctggattataataatctcaagctaaaagaaacagaaacaagaccttaggcaaccaaagatgttacaggtcatgttccgtttggctaattggctgagctaactcttcgttttccacaaacatgtttccaaacagctaaatagaaacatattttataaaaaactttttcatatacttatgcactttagaaatcaaataaatctatttttaaattttaaaatttttaatacttaactaatcaagctttgaacttgtttcgattcacatgccgctgataatctcagcctaagagcatctccaacagcctctccaaccctggccaaaaccctccctccactagccaaatttggccactctatttggctggccaatggtgggccccacacaacccatcttctccatccccaattccccacacgacaaccgcacggaagaagcacgaggaggaggcgctcgccacgaccgccgctccgctcgctgtcgccgctgccagcccccgcgcggcgcggccgccgtccctcgcacacggtgcggccaccggcctccgctcgccgtggccgcccgcccccgcacggcgcggcccgctgcctccgctcgccgcggccgccgtcccccgctcgccgcggccgctggccccgcgcgccacgcgctgcgcccgccgcatcagctcgcagcggacgtcgtcccccactcgtcgcggccgctgccgccgtccgtcacgcaccgcgcccgccgcctccgctcgctcccagcatgtcggcgccgcgtgcttccagccaacacgagaaaaaagagaaagaggggaaggaaggggaaaaaaagaagggagaggctgacatatgggtcccggtgtcgtagaatcaaagtagagagggtagatagagaggctgttggagtgaacagcttagtttgactagccaaatcaaatagagagttggctatacagatgtttggagagttagatttgaagaagctgttggagatgctctaacattccaaccgaacgcaactagtttgacaaccaataaacccttgcataagcaactagtgtggctgacttggcatgattagtgtccgtggcatgccttgtgattggattctgaatgattggagcaatttgcaagtcaattaagtagtaacacttatgatttacgaaaaaaaaattacagccacagattaatttgtaatagacacatcttaccccccacataagaaaatcagaaaaaaaaaaggagaaagaatatagggacccacattccactagccaatacagctgctaggttgatttacatcagctctgggacgtagggaccatatctcgagggcccaccagatgggccgggtgggcccacggtccacgttcgtctgatctcgatgacatgagcatcgcacgaaatggcgacccctcctgtcctgcacgatggatcgttgtatgatgacacggtggactgcaccaccccaatggatcatccatctcatctcccactacaacgtattactactaattattgtttttttgttaaatggctaaatgacagaattgatgaatgattgatgctaatcactagtacatccgttctataatataatataattgattttatctgttgtaacttgtctcgcaatataagtaattttagtgcgctggttgtcacattaatcaacttcaattcggatttctttctattatcttcacttaaccaattctgattaaatagggcatcttagtttttctttctctttatccttaacctctctaaaaactaaaacaataccttatattatgcagggagatagtattcaagtgtacatgtaaatgaattaacttattataaagtttaaaatggatttataatagattgtaagaaagtcatatataaaagagttattacaaaatggagtttaggaagcatacatattcatatatataattggctgtaactcgttaagcaaaggctgcgatgttatattttattatcttaaaaaaaacgtattcatccattcatccattaaggagaaaagcgaagtgagaatagctcaactggttaggttccttgtggtggaaccagcccacccgggttcaaatcctagatttgacacggatgctcgtatttacggctaattattctttcagtagtaagcgacgtacccctcgacagcgaggcgcctatggtgacttcgtcaatctcaagacatgccggcccagtcttccgcaggtgatcataggggtagggtgtgcatgtgtgcgttcataggggtgagtgtacacacgttgtgagcgtctgcgtttttactgtgtttctcaaaaaaaaattaaggagaaaagaacagccatagttttcttttccttttttcttttctttttcttgttcttcctctactcctcctagctactataactccctttttctcttgggtcctgagatgtcgataaggctctagctaccgacgactctactacactgtacaccgtctctgtactatagtacgcaggcgctgttacttgccagtgcaagatatggatagatgctggatatgcataatcgagaacttgataggcgtccttttgcccctttctgctggccattgccgtcacattcgtcagctaatagctatagctaaagctgaaatctatcgaaattttgcatgcgcagctgcgccacccgtggctgtacgtgagagacccggtttccgtggtcagccttgacccggatggcgttttcgagttcttggcacagagagacacgcagtttgctcaacttgcattctgcttgcccccctcatcgagcgagagaacgagcgatcagcattggagcagaagcagaacaggggcatgttcagtgagccctaaattctgataagcagccaattttgaaaatccgaaaaagctagaaaacgttttcagtttattttctagattctacagttatgttttcttaaaatctaaatgaaaaaggtacaccagttaagagatctagtttcttttttattattaagaaaattgtagttgctagaagctcttcaaacaaaatctggggtttaatttgttctagcagtcgcaaatcagctgcgaatatgaagcattatcttgatgaatttgatcggataaactgtccgtttcatcgtcgtctgttgatgattccgtcttcgtttatgtttgcggagcaaacgcgcgccctgcactgcatgattcgatcagaacaatggggtcagcataataatgcagaccgagatactaatatagtacaaggtgttcattagttgtggtttagccgtggtatggtaggagtgtcacacactcatcgtcagctctcagctatatatatatatatccgagcttaattagctgatgcatccgttctcgcattcaacttgcgcttttttcctgatcgctttcagcgtcgacggagacggcagctaattggcttggttgcgactatgattagcacgtattagtatttatacgtaaatatcgaaatatatttacatattggagttttgtttagttttctctctgtagcggccgggcgagagagaacggcacgcctctccctctgtttcagtttttatttttcgtgtgtgtgggtctgaatttatgaagggtgtaccaccaagtactggacctggatcgtgacatgcgtgtcgtcgtacgtatacaatgcaaccgtatagaaattaaaggggtgtttaatttgttggttacagtcgaggaggagtgtacacgtactacgaccgatcgagcagctagctagcacacgggacagcatgcaggaccagtacgtgtatacatcgggtaaatcaggtggtggtcaaattaaaagtgtctaggttaattcaagtttcatcattgacagtaaaaagcttcagaaattcgatcggatataacatctaagagcacccgcaataataaagtaagatgatatctataatacatgtacatctagcaatagactagattaatagtaaatcatgttaatagtatatctatatgggtatctatagctctctaatacattgtctcgtttttctctataaactatctccaggttagtagatacctttgctctctctcttcatttaatctcttccaagtaagaaaatatgctgacatggatctcttatagagagcctatagataactattgcgggtgccctaagagcaagtttaatagtatagcccactactaactccaaatcatctatagccaatataatagccaattcatacaatagttgcttactatactattaatatatggtcccacctgtcatacacacattacgtcttgcagtccgtgttgcagctggctacagatctgtagcccgctgctcttctctctcttcttttatctctttaaaggtggtgtttgggaaggagggactaaagtttagtccctctcacaaaagcataattccctctctcccaaacacccctaaaatatgtttatagctggcttatagcctgatattgtacccgctctaatgtaaaacaataattaaacatatttttttaaccgattggggccacatgcatgaccgggggaggcatgtgccgtgcgtgggcgcgcgtggtcgcatgcaggaggcgagtgagcgtcgacaatatctcgacgcatggaggggcgtgtgtggttcatttcgtcgcgttgatttaccgccgcggagcggagaaaatagaaatcggttcggggtaaacaagccgccgggggctgatggatctaggttgcctgccgccgtcgcgagaggtctaatctattactctctccatttctaaatatttattaccgtttatcttttaaatatgtttgtccgtttattttgttcaaaaaatttaagtatttattgattcttttcctatcatttgattcattgttaaatatacttatatgtatacatatagttttgcacatttcacaaaaaattttaataagataaatggtataaaacatgtgctaaaaaaccaacggtgttaaatatttagaaacggagggagtaacttaataactaaaaaaaatccctcgcgtttactctcaccgtctcacgacctaggaagtttcacattaagcgaaagaagaggaagaatgaaagatagaagggtattaggattgggttttgtgtaaacggaaaaataacaagaaaaaaaagaagggtactatgattgagtgtggtgtaaaccgaaaaaaaaagtgaacacggacaagaaaaataggaaaaaaaagagaaataatgtggaaagtccaacaagaaatataatttaaaatagagtctagaaatacaattttaaatttttgaaaacttggataaaaataaataaaattttaaaagaatacatacagtatgaataaccttactaataatcaaccaggattggactttgcaagaggggatcaatcaaattgccatgcactgatctcctctaagagaaagggtgaaacctactaggatccgccgaggcaaacaatcaatgataggattgaaaataatcacattgattaaattgctcaagttagtaaaaaaaaattaaaattattttaccattttaatatatcttaataataaatatataagaatataaaaatctatgatattatgtgataaaaatataacgatactagagttaaaaaaaaacaagagaacaatcgctgtatgattaattgagttttgattagtataaactttaaaagtaaatttatctgatattttaaaataacttttatatacaaagtttttcacaaaatatatcttttagcagtttaaaaaatatgttaataaaagttatgataaagtctttattttaattagtaaagaactccagttgtcacttgccattgggccgctactgttaacgtacgttgccacatttctatgtgccgaaagcctctgatgattctgcctttttctgctcctctaaaacccgatcgccacttccagaggggagggaagagacgtgttccaagctactaaggctgtgtttgatacttggggttgggaacccaactccaccgcacggaaaacggagcggtccattagcgtgtgaataattaagtattagttaatttttttaaaaaaatggattaatttgtttttttaaagcaactttcgtatagaaactttttgaaaaaaacacaccatttagcagtttaaaaagcgtgcacgcggaaaacgagagaaaggggttgggaaacttgtggaaagaacgcagcctaagagcacccgcaatggtaaagtaaggtgctatctataaaacatgtacatctcagcaatagactagattaatagtaaaccatctcaatagtatgtctacatgggtatctatagctctctaatacattgcctcgtttttctctatagactatctacaggttagtagatagctttgctctctctcttcatttaatctcttccaagtaggaaaatatgctgacatggatctcttatagagagcctatagataaccattgtgggtaccctaagaagatcaaattaaaagatcccactttaaagggttagaccatttaacttttcaggccacacagtgcaccaagaggctaataattgaagcttgttctcggggagcgtatcctatacacacaggctctcgcgtgttcacaccatgtacaccaactaaaaattatcataaaaaattctaggaaaattcatacatgtactttcaatagtattacatctacgtgcaaagtcgcatcttcaaattcattctacatagagaataacaaaaaaagataaaattctgacaaaattgcaaccttaaaactggtcagattttttgttttttttgttacagctaaaatataatgaatttgacgttatacaattgaaagtatgtgtatgattttttctagatattttggtgatattttttagttagtatgcacgtatgtacacatgaggacctgtatgcataggataatatgttgcttgttctcgagggttaactgctagcgataataaaggccataggtagagaaaactgagcgatggattatttgtttagttaattgtacaccctctgtgatataaggtgtgttttgttgtggttagaatgccaacaaagatatatttattttttaaagaacaaaaattaaagcttatgcttatcccgcttcgttaagggggtttttttatggtgttgaaattcatgtcaagcttatacctgcccccttttttatctgaataagcaacaattcatattaaaacagggtcgaaatttatgcctgaatgcttcatgtcaaaacatgtgcgaaatcattaagtctttgaaaagtaggagtaaatatgtaaggacatatatgaaaagtaggagtaagtctttggaacgaatacaaactttagataaaaaaaggggaaaaaatcctaaatttataaaagtttggggtgtggggtaaaaattacaatcgagtatgaaaactaggataagaacacattcgtctctaataactttgtttggtgcaactattttagacatggttcagggcaaccacaatgtataaaaaagataaccttaaaacaataattattcttataaagtgagatatatacattatggaaagtattttttttggataaagggagtagtatgtttcaaatt

SEQ ID NO: 61279 - DNA, 11735 bp, Oryza sativa
attcctgcagcccgatgctaatgtaggtttaattaattcaaactagaatgcagtcatccccgaaagatggaagtattgaacaatcgggaaaagatgtgtgtgtaccatttccattttccttttgacctttcatactataaacaatctacgtagcaagtttgaactgggccaacagactgtagagtatcatgggctcatggcgataaataaaccgaacattattagacaaagtgtatattggtggtgtcataaatcctggtgctcacaattcgacagcaattttaaatacaaatcattaccatcctctagataggagagacagtattaaagggcacagctatactggtctgtccgtgcagtctctcgtgtgatgaaaaggtcttaacacgtttaaattgctaaacattatatttagtacgaaaacattttatacagaagttacttgaaaataaaaatctatttgtcttaagttttaataattaatactttattaattatatattaatcgttttttttacgtgcgagctaataagctctttcctaccgtagcttacaaatctaacttgcggggtaaaagcaagtagaggaatagagacgttgtgctcggtagtttgagttgaaaactaatatcttacacacgtaaaacagagcaattcattagcgcatgattaattaggtattaatttttttaaaaaaatatattaatattattttctaaaacttctttcgtataaaaagagttttgtaaaaatcacacattcagtagtttagaaaacgtgcacgtgaaaaacgagtaagaagagcttccgaccacagccttagagtaggtacaataacagactataaattagctataacacatttcgaggagataaaagagtatagagaagagtaatgggatacaaattttagtagccagttgtagcacggactccttcaagatacatgtgtgtatgataggtgagaaatcagatattaattatgtagtatatgtttgtaagtaattaatctataaattggttatagataatttggagtgagtagtccatccatcctgaaaaaacaattttaggactggatgtgacatattttagtacaacgaatatggacagagatacgtctagatttgtagtatgtgtcacctcctgtactaggttgatttttttataggactgatgaagtagttggctatagttgctcctagagagtgtcagatcaggaggaggcgcacagccggatgcacctggatgcagtttgatctcgatcgatctggttgactggttgtccgcatgcacgcacctggcccccgtgtacagagcgccgcatgcggcacgcaccttccacgttgcggatcggagtcgccacaaggaccgtacgcgcgcggacccgtgaggccgtgacccccgtcccaagcgagtcctcctacgggtctgtttggcacatctcaggctctaactccacctcttctggagctgaaacttagccaagcagttttagctccactaaaactgagagtggaattggatagagctctctcacaaaatgtactagagttatgaaactggatttagacagctccagaacttcactctagactcaactcctgaagttaaatttagaagttgtagctgtaccaaacatgccctgctccaccaactcctcctccttgcggtgccaagggtcatcagctcatcatccaagcaaggacgtcatcccagacgcgatgcatgcaagccacggcgaaattcagcgcgaccggattttgactgattaatcagctgcagttcgtagcatatgcgtgtagtatgtgcgtgtgctccgcgctaaactcatgcatttctgctttcacgtgacggtagactcctcctggcatcctgggccctggcctgtccgtcagccgtcagctttgaattgaaacagaaatggtagtagagagaccttctacagtctatacaaagtccccctgatgttattaattagatgaggatttttaccgtccagcaactaggtgtggtaccgttacggtaccgtttgctggccgttcgatcctggccgatctaacggctgatattagtcgggactgaccggtactaactcagcccttgattttgtaccgcacggtggagaagggtggaggggtaagattgtattttcgcgtgccatggtcggaagaggcatgcagaaaaccctagaataggattcgatgtcgtttcctggagggttcccgacttcggcggcggtggcaaagtcgatggcgacggcagagtggctccctgatggccgagtcgttccccccgcagcgacggtgatgcggccaaggtggtgggcatcaatttcgttttccggtggcgacggagtcgttcccgacggcggaggctgcaacggtgatggtggagtcgctggcggcggtggagtggctccctagtgacggcagatgagggcgacaagcttttctctctcgctaacataatccgattcccatcgtaacctccgtgtaatcaacggctagatttcatctggtaccacccggtacatttcgctggacagaaacaaagctctaattagattagttggatccaaatcattacaaatatattatgtttttaaaaaataacattattattcatttatatgtatccatattatacgaacatgcatataactaaaaccatgtcagtcgcatcacgttttatgtcatcatatagactaaaacacccatggacgtgggacctacattccatcttcttcctccttcctttactctttttccttctccatctctctacaccttgttgagccgaaaacatcgggttgtgaggagggtgccgacgagagagaggcaaatggggaggcaacagcgaaccactagctcccgttcacccgttggcctgcgaaggatggagggaatttagcgtcaccccgcttgagcttgctgccacttgccccgagctcctcccgacaatgaagaagactgttctcgctagatctaggttgatgctctccctgtcaccacaagctccgccatcctcattgcgtcattttctttgtggctgccgacagaaggatatggagccccaaacttaatgcctgagatttagtggcgcacgtacgacgggtgatttagccgccggtttctcgggattgccatcggagttgtgcagccagagctacgtgtatgaagcacccgccaccactatcgttgctaggcgccaccgtcatatgctctatggtgggagagagagagaggggggctagagatgtggggtggccggccagcaaaagaggaaagaaggcagatggaatcgttagtaataaataagtagtaattatttttttaaaatgacacatttataatgatatggatccaattaactttattagtttgtctaaacacgaagaaatttaacgttgaaaaccttacgaaccatacagctggttgttttggctcattgttttcattgatcgttactccaaaccaaagacgtgatttcaaaaaaaaaaaaccaaagacgtcaaaggctcaaagcttagcacacgacacatgcacaaaaacccatgtacgttcatctgcatcctcctcatcccatataatactcctagtccgtaacgacccatatgacacatgcatcggacaaattccgttgccgccgctcgatcgcgcgagagagatttgttgtatgcgcgtacgtacgtgtcctctatctcgtatgatctcacgctaaaacaacaaaaaaaccaaacagcttccgcgagtagagtagcggccaaggccatccatgtcgacgccgcaagccgcatcatcgccatgcctgtccagcagcggccgcagtcagcacacacatgcagcggcatgggcgacgtctggatttcctccgctcaccagttaactccaactcccccccatcccctcgctgaatcggacgatgactttgctttccccgatgcgcagtgcaacacaaccccaaaaatacttttattttttcgttgtcatcgagattcagaatagaccacacacggcgtgtgtaatgtaatgttaaagctagattgatttacacactgtggcctaaagttacagccactgtgatctgcacatctgaggttcggaagagctgatagctcccgaaagcgaatatccgtcttttcttatcgttttaagcttttgaatgaaataatagcctattatatgttatcaatgatgaagcattcctgatcaggcacggaactaaattggcagcacatatatcggtgcatgcaacgtgtgcaacgatgccagcaatatagcagacctagtagcctaaacctagatgtaatctgaaagaaattaagaagtggagacaaacatatgaattacatgtatgacattagtgaaagactgaaacgactgcgaaattgtttgggcttccatggctacgtcagagaaacaaactgaaccgctagccgcagatagaaaaggagaagattgcattgctcgccacgaatttggccaaaaaaaaaagtctatggctgctttgctttgcttctttcttgcagccactgcttgcgttgctcacttgctcatcaatcatcattacgcgcgttaattccgttgcgatacgggacaatatgtagctgatatatgtagttctcctgatcatcaatacgggaaattaaattggatggttagaagttgcagcagggggcatagaagaaaacagaacttcatctgaactttatactactccttttgttaatgtcactgtgtgaaggtcagatccttaaaaatcaattgatcaggttgatcacctgctggtcatacagatgtatactactggttggattattggcaacgtttgggtggtttcatcttttctgtttctggtttaattgagcacattgtaatgaccctttcaagccacttctttattttttttctgaaagtttggcgaaaaggtgtcccagttgactgagatcaggatttggcctccccattcgtctctgccgtctgctttcgaaacacatgtatcttatgggtctcatcacctgtttaggataagtaattgttggcgcatgcagcatacataaataatggcatgcctatccttgggtttgacaagaaagaaaaacaaagtgttaacgatgtgaggaggagatcaggttgattaattcagtggtactcgtccttgcactgtagctacgtcaggtgttgagtaataatccaatatataatctgggctatatggctaggagtaaagtagctggtgactgatcaggtgagctgatggtgtagctaacagcgctgtcttagttaacacggctgtttttttgtttttttttcttcgtccagatagcggatgtgtcatgtcggagagtctttgtcaatgttaattcgatcgtgggaaaagaaatgcagagagaatgattccaattgcaaccgttgatggctgtccgtgggttccaaaagtgctgtgacgtattggacatttgggcgctctcactctcatcatacagtatatatgctgcagctagctcctgcaagcaactcggtgctttgattaatcgcaacgtttatgccttgaagaacaattttgaagctaatgtgtatgattaattgaaatcgcaggacttggtctgtttggaatctaattaaccatcgtttgtgagcatctcgcctagctgatctgagctccaggtgactaaactaaatactaataaggctttatttggcatagctctatatccaagctttcattgagttagatactcctggctccacaaatctatagatatagatatagacctacaattacgttaataataattgcaagaatcattttgttcttagtttagatgaaatataaaattttaaatgcaatttagcatacaaacttcaaatccattatgaatctggagctatggcaaatagggactgaatttaacattaaatcatcatcgtattgcaaagtgagcgtagctcaaccgattagattccttgtgttggagacagtccacccagattcaaattttagattttacacacggatgctcgcatttacttcagaagggtttgcatgtgtgttcacaggatgctcacatttacttcataagggtgtgcgtgtgtgttcacaggggataagtatgcacgtattgtggacatctgcgtttgcaccgtgtttataaaaaaaattatcatctcctgccagtgggcgtacgtgtgcttgtgcacggtagcacgcacgcacgcaggcgatcgacgatccgaccgaagcatgtgcgcgcgcgcgcgcctaacacacctaactcgaaccgatgggttgtcgacctaacacgtacgtgattcgctggtgcaacctaacctcgtgtgcaaaattaaccgcgacgccgcgcgcgcgcgcggcgtacgtggagaattacgacgcgccgatgcgtccgctcgtgcgccggagcggccgccgcgcgaggcgagacgcatcgccggcgattggcgtttgcattgccatgcgtggaaggaagagagacggggtgaggtgactcgatcgatcggtgagcgaaatgccaaattactgtgcatccttgagcgtatacccagttaccaccgcggcatctcgtggtgtgtgtggcgaaagatcagatttttttttgttttgttttgttttttttttcgcgtgcgattcgatctagaacatggatcttacagtacataccacaacgtgtgggctggctcgacgatggagctcagctgaggcttgtcaccagctaggttgtttcgttgggccgcggaatatcgcgttcccgtaatccaagcccatctttgtctgccgtaaatccaagcccatcttctcaccagctagaaacacccgcgcgccggcctagctagtaaaacgaggatgcgcaatgtggaaaaagtatatatgagggcaatgtggaaaaagtatatatgagatccctcatcttgttatccaattacaaaataatccctcaatcataaaactagatatatgaaatccctcgacatacaaaaccgggttactctgggtccttaggtagtattgatcccggtcttgtctgacgtcgtggctgagtcagcgtgggacacacgtaggccccatatgtcagcatgtccctcaatcctctcttcataactaggatcgacttctccgacgtggcgtggacccggcggcaccgaggacaaggcggtgagcggaggtgcgtgcccaggtgatggatgcgctcacaacccactgttggttcgatgcgcactacccgcagttcacttcggagattcgcgctagcctatttgacaatgccgttcggccgctcttcacgctcccgtcgacaccaagcaccgcaactactatggacccaagaagcccttccacagctacatcgacagcctctcgggccttgatgcctataagagcctctcaatcattgacgacctcaagcctaagaacatcggcgccttcgctgaccttgtcgctggcctgggcttcctctcccgctgcatcttcggtcgctgtaatgccaccagttcatccaccaccacctctctcctcgatggcttcctcttcctccgctaggagaagggcgacgatcggcggagaggtggtgggcggcggcaccgagctcgaatgctgtggggaggtccagggacctccgctcctatcgctcctcctccgctaccacgtctccctccgccgaccaacgctgtggcctcgacagccattcctaccccgcgtcgctcctgcgccccctgacaacgggcagtggctagcagggagaagggcggcgcagaggagctaggcagcagcggcaccggcggagcacgagcgtggtgatagcatcgagcaaggtaccgaggtggcggaggacggcacagcaatggcgacgcccatggagcgagccaacgagatggagagtcgtgcggccaaaaagcggtggagggattgattcgttggcagcggtgatgctggagaccggcacagagcttcctccactctctctcttccctcaaactcttcccgttgccgctaggccgtcgacgttccttggagccacctaccaccggctgccactccgatccttagcgccaccgcagccggggccacctcccgccgccgtcgaggtcgccgacagccgacggagccacgccctctcctctgcgcttcctccctacatggtgcaagaaagagaggaagaagagagaaaaggaagaagatggggatctaagccgtgggcccaactttttattattttattactttttcggatcaaactgtcacgtaagcgtcatgtatatgtcacgtggaacgaagacctagtcaaaggagccacgtaaacgccacgtcagtcaaaaccgaggacaataacaccgagagacctcgtttgcagtggttttagaaattggaggatacgttttatttgattttttttgattcagggacgattttgtaactcggtaacaaggtaagggacctcaggtatacttttgcctgcacttgttgctgggtcgggctgtaacttaggtaagggatctcgtttgcagtggttttagaaattggaggatacgttttatctgatttttttggttcagggacgattttgtaactcggtaagacggtaacaaggtaagggacctcaggtatactttttcctgcactctgttgctgggtcgggctgtaacttaggtggagcttggagccgggggcctcttccgcgtttgggcctgaggcaacagcatatctccgcgtccgggtgcaacaagcccttgccggggggccatccgttcactcgtgtcaagcataaccctcttcttgatgaaataaagggttttattttcacaccgaatttggaagtagattgttaatttgttacactatatatgttgatgtgacctcacatgatcgatgtcttcgcctcctgttggttacatcatgtctacatgcgtgtagtacattagtgtttatatgtctagatttcaaataataagatttgtttaattttatattagattgttatatttcatgacgaaacatgttatgtgttaccttttcaccaactcaatattgaaaaacgatttctgtgaaaacatcaccttttttaggcggactaaaagaaagcccatatgtaaaaggattcgaaaaactcccaatatagacccgtttataaaaatccattttcacaggtggacgtcttaagaggcatgcctgtgaatatttgcacccgaccggctccatctcttttctttctcctgttaagtcttttcctctcctctctactccatagccctctcccccattttctctcctctcatccatcgactctccttgacgaccgacgatgggagcgaccagcaggcggcaacgcgaggggcagtccaccattggaggcctgcgggaggagagcgttgctgatgggcaccagtgagtgccagtgccataatgggcggattcgccgttgatgactaggtggtggtagtggtgcctcatctggcgtggcggggaggggcaagcacgacaatagcggcggccataggtatcatgaaaaaaaatgtcagttttgcttctagctaggcaatatttttttaacctaattttatgtcttacatctgtgttttcaatttctcagggattggtagctcagtgattatagataaaaagcatttttcttagcaatgtatgatgccattttctttgtacaaacagggggcggacaaagacttattatataatagaagtcattttccttcccaggttttttcttattaaagggacatatgttttcaagtctgtacatgttttggacctcatggttcatgtattgtttaattctagttaaatttagtaaaatatataagtcaagaatgtttgttgattactcgaatagagcatatttttattttacaacgtcagctttgtgcaaacctattgtaaacagttgctttctatactgcagacaagtacgagtctaagcacgaggttttactcctcatgtttgttgattggcaactattttttttttcaattttaaaatagtgccagcgtgtgcaaatctagtcaaatggataaaaatatagtttttatgacgtatgagaaaagtataatttctcagcctttttttcataaaattgattgaattccaaagggaaataaaaaaataaagcctataaagatggcttttttgcgccaaattttgtgcactttcattgtgaatagcaggccgggaatatttgaaaaattgtttgcatttcaaaaatgttttggaagttttaagctaatacgaatgaaagttcatttattatatttaaaaaaaaaaactttccacgtctcggacaaaatatttacgtattttcaaaagaaagttatacttctatataatctccctatccaaattttatgcctaccataccccatccctgaaaaataaatggatagagaacaaacaatctttttttattgccaggatgttctttttgggggacgcagattcagtgacattcccccgtgacattttgagtcactgacatgtggaacccacatgtgctgggcccacatgggtcccacacgtcagtgactcattgtcacagggtatgtcaccagagcaatgtcaccgaatcccaatccctttttgggccgggtataaagagaaaatcaatgagtcttcttttttggctgggacgtgtgtatgaaaggaaaagaaaaggtgcacacacactccgccgccgcaactagcgcaagaacgagagagagatgtgtggatagggttcagtggatggataggtttcctaaggggtattatgggtattatgaatattagttacattctttttgtattttaaatcaaaatttaacgggttagtggaagcagggtcagacggaagcttcattttggaaaaggagggtcaaataagcaaacttaaaaaaatatagacaaattagcagttagggttcaaaacgggatcatataagcaattgtcccaataattaataacccatatatattcacctttcttaatatataaatggagtacctagctaatacgcacgattgtgaaccatttattatgtgcgatataaaatttattaattctaggctgtcctttttctttttgcccttaattaatatccccgacctgtgctagctgattgaacgtatcaatgggcaatgcatacaaaattcatcagagaacgtgcaaactgtggaattaaatgttgaacatattgtgggggcaacttcctttttctttcgagggtacgtagaggagattttattattattattattattattattattattattattattattattattattattattattattattattattattattattattattattattatgcagcttgattaaacatcgttcgatgtagtccagaacctcgatcagctactggctagctagctagtaatgtgccaagcgtaaataccatgcatattttgagcagctcatggcctatactttattagtatgatctctcttaaccttttgcgacatcgatccttacatataaattaaagctgacaactgacaatatctcgcaaacacaaaaaaacttgtagtaataattagtgtagcaaattaagccaaatcgatcggccaaatgtgtgtatacatatatattcgtgttacatcacctttgcaggcgcacattgagcagggtttgagacacactaatgcaacaacagtgtacaacacggttacacggccacacaatcattaataatgccccggtcatt

SEQ ID NO: 61280 - DNA, 962 bp, Oryza sativa
gggggggtcctacggacggggtgagctggataaacagaggggatcggaggagtccagaggaacgcatcaatggcgcgccatgcatggcggtggtggttgtattatttgttcttcaacagcttcctctgatgatgatttttatgacagtctcattgcaaaatatcgatagaaccatcaccactaatagcgagtacaataacggaaaacaagagagaaggaatgcagcacggacattatgtgtgtatgagaggttggatatatatcaatgttgtagtatatatatacttatactccctctgtcccataatagatgacgtttttgactttttatttgtaacgtttgaccattcgtttttttaaaaaattagtgcaaatataaaaaaagataagtcatatgtaaagtacttttaataataaagcaaatgataaacaaaataaataataattccaaatttttttaaataagacgaatgatcaaacattgacaaacaaaaactcaaaaagacaagtaatatgggacggaggtagtaggtaataactattgtatgaatgagctattagattggctatagatgatttggagttagtagttggctatactattaaacttattaaacttgctctaatgaccgcatcgaggtttctctgacggccaaaggtggcgccaagcgaccaatgtctactgaaaatacgtttgttttgctggcggtaatcgaccgcaggggtgaaaccgttttcgttgctggacaaatatagcccagtcacctgcgaaaatattcttcacgcgtgtccagctaatgatgtgcgccagcgaaaatgtttttcaatttctaccgatgattttttggtgacagtctcattgcaaagtatcgatagaccatcactactaatggccacatcgagttttctccgacggctaaaggtggcgccaagcgacctgtgcccaatgaaaataggggcaa

SEQ ID NO: 61281 - DNA, 13721 bp, Oryza sativa
aatcgtaggggtaaaaccattttccttgacgggcgacgtagcccagtcacctccaaaactcaacatggccccattcgtgtagaaggtaagattttaccagcactggtggagaaacgtttttttactcccggtttgcaaccccctatagtcccggttttctaaccgggactacgaatctgggactaaagatcgctatctttagtcccggttcaaatacccgggactaaaaatcgatctttagtcccggttggtaacaccaacaccaaccgggactaaagatggagccatttttaaccccggttggtattaccaaccgggactaaaaataaagccagatccggttagtattttcttttttcttttattgttttttactttgaatattgatttcaccatatccccaaatcatccctaaaatcacagaacaaaagatcatctccaaatcccaaatcgatcgtctacaaatccaccatatccaaatacatcacaaataatcaaaacaaatacatcacaaattctaaaaagaaacatcacaaatacatcacatatttacatcgcacagatcaaatacaccacaaattctcaaaagcaaattcatcgcttcaccgctgtcacttggccgccgccctccgccaggccacacggccgccgccgcggccgcttctgccacacgcgccgcctgcaccgccgccgccctccgccgggcggcagaagcgccgccgcggctgcatccgccgctcgccgcgcgcggccgggcctgcgtcggggagggatctgccacggccgcaggggagggggaggagaggggaaggggaggaagagggaagaagacaagaaggagatgagaagatgagaagggaggagaagatgggagaagataagggagaggaggagagatgagtggatgagaggataaggctgttggtcctctcgaggaggcgcggcgcgatttttttttcgtttttcttttgtctcggttgttataagcaaccgggattaaaattggatctaccaaccgggactaaagatcatagaggggtctaacacatcttgccttctttcgaaccgggactaaaaatgatctttagtcccggttagtgttaccaaccgggactaaagatcaaaaagtgacgtcagctttttcaaccgggactaaagatcatttttagtcccggtttttatttaaaccggaattattatggattttgggcaaccgaccaaagatggtttctctaccagtgcagttttcccaaaaaaaaaaaaggaaaaaagaatgtagagctgctgtgagttggtaagaggaatgcatgcatcgctcagcttggaaaggatgtatgtgtacccaactacccatcggtatacacatccactggccctcctcccctccctgatcaccttcccactgcaccaaccatgccaatcatcctgaattcctgattggtatatccttccattaatttgatcgattcacgtgtagctagcttatagttagcccagccagctcgatcaacggcgcctacggtcatacagggccaccactccacagtccacaccaattgaggcagaggacccggctatactcgagctatagctagacttgggacatattctgtgatgatatttgacggcatcaggttcactatagcttttctctccgtggacatcgatggggcggattaggcctgtttggttcccaaaattttttcaaaaaacatcacatcgaatatttaaacacatacatagaacattaaatatagattaaaaaaactaattgcacagttagggaggaaatcgtgagacgaatctttttagtctaattagtctataattagccataagtgctacattaattcacatatgctaatgacggcttaattaggctcaaaagattcgtctcgcggtttccaggcgagttatgaaattagtttttcattcgtgtccgaaaacctctttcaatatccggtcaaatatccgatgtgacactcaaaaattttattttcggcttttcgcgaattaaacatgcccttattttggccccaaggaatcaagcaattcagcggccagcgaccagcggcagcagccgcggtcattccaccgcgctagaattgctgcaactaatacattatatcatcatgcgctcgatggatgggtccgtacgcctggacatatcatcttcgttttctcgacccactgactgtatcatcgcatgcatgcgcgttttttttttttgttttttcagacagaggacgctgacaagcggaaggccatcagataagggggggaccgggtcggccgggcatgaattattgctacactgtattaggccatcaccaatgcgtaaccccaggtcatccccctatccccctccgtccgtcgccgattgctttatcgttggcatcatctcccatgatggaacgcgtccctctgttggggggacgtgtccctcgctcgcttttggcaggggaacacagccgaggggggcgcgttgggcacgagcgtggcctgtggacacctttcctaccgaaaaatttccccttccactcctcgtggccgccggcgacgggagagagagggggagagagagaggccagcggcagcggcgagggagagaggtgtgagtcggcggcgagaaggagagggagacgagcggcggagacgatgccagcgacgacctacgcaacctcctccgccggcgtcgcggcctcctcctcgatgcgacgcggccgaagccgctccatcccgatctggccacgagggggccagatccacgcacgacggcgccggatctgccgtctccggctgccggcggcgccggaaccgaggtcggcgacggtgccggggtgaggcggcgacgagcgggggttttgccgcctccggccggcgacggcgtcggcctaggtcgtgaacccgacccagcgacgaccgcgcgatggagacgaccccgccggcgccgcttgccatcggccaccgcaagggagagagaggcaacgacgagagagggagagagaggcggcgacgagagagagagagagagagagaggggatccggcgccggcgaggtagaaggggagggcggaggaaacggagcggcgggggagagagcggaggaaaaatcggtggagaagagtagagaaagagataggagcggctgtagggaggggtattttcggattttttcagttgaggctacaggggccaggacactcattgtgagcttgagtatcttcatccagttagctcatattttagggagcacatctagagcgtcctcaattgtgagatgagttcctcggagagtgccctcagttagtgagggcatccatagagtgtccctgattatagatacccttactactactactgggaccgtgaaggtgtacccctcggtctcaaaaagaattcaatcctaactacaaagtaggatttgctttttttttaatggagtagtacgtaccaaatggtaatcggctttattttgtgatttcccttcaaatttcctagctagggttataaaatagccattaattggggatgaaaacattcagaaaatggtagcctctacgggaacggttctcggttggtcaagaatcagccatatttatcaatttatttaactatttagtgtcggtttgcaatataatgcttaaaagatttagaaaaatataattttttgtatggctggaatcggaaacgtaccacttttactgaaaccatggtcgattagcaatttcagtcaccatttttaacccctccccctactccattccatgtaaatttcaacagaatttaattgtagttgcgcgccagatctgtgatccaaaaagattcatatgaaccttctcccttttgttattctctaagagtgtgttcaggagtacactttcccagctttcactgcgcatgcttcctaatctacttaaaaaaaccttttttaaaaatatatatattggaatattgctttaaatattatattgatttttaatagtacttaattaatacgctaatctgcagctccatttatatgccggggaacccaatccccaaaacgtataacctaaatttgcctatcaggccattcccaacccaagacactagacatagtttctataaactccacattatcaagaaaccaatactagacactactcttcaatataagcacaactattctatacttaaatttaatgctacttatctcacatgatatctcagatgttgtgtagaaaacatatttcatgcaagacatagtttccttctctttcctcatttattcacttgccacatcatttttcatcttatgtggcagcttatttaatgttatggataccatcctattcattgggttaggaatgtcctcatacggagtatcacactattaaaaaacgatttttcatgacgttgccctataatttttgctggtagaaaaatacgaaacagccagcgaaaacataatgaggggtgggggggctacggaccaccatcgaaaaacaatttttactggcggtcacactaagagatccgccataaaaaacaactcaatttttcgaggcgggcctcttaagcaatcgccagcaaaaattggattttcactggcggaggctaaatgtaccgcttgtaaataaatatacgccttatttaatcttctccactttgccattctcttcttctccactttacccattctcttcttctctgctcgcgagctccactcccttctctcccctcccgagctcctcccttctctccccacacagcagaggtgatgcagacgcggtggcgcggcaaaggttgcggcggcgtgatgggaggaggcctaaccttcccctttccctgacacatcaataagaaacaagctgcagattatctatgttttactgtattattgctaccgggcattatttatatttaagatttaactactattttctcataaataatgttttgaaatcttaaatatatactagtatatagtaccgaagtacgttacgaaagatataatcatgtaacttccatttcataataatttacagttcataataatctaacgatttatagcctcttttggaatagatgacactactacgaaaaccatcttttgtggcggttattttaagtttttgctggtggaatttgaagccgccacaaagcaaaggccagtgacgccagctagcgaaaaaatatctttgctggcagctgtcttaagctagccgctagcaaaaatgaccattttcgctagtggcaccattaggtcaactgccagtgaagagatttttcccaaaaaagaattaaatccacatattcatcatgattttcaaaacaaaaacacctcaacatcattttcaaaacaaaaaaacacatcaacatcaacagattcatcgatagatcagcagattcacatcaacatattcaacaaatcagcagactcacataaaaaaattaacataaacaaatccttcacaggaagcaaatcgatttcacagcagtcagcatgcatcaacaaatcctttacaggaagcaaatcgatctggagagaggcggtcgccgtcctgtcgctgcggtcgctgtcgagccggagagccggagaaaggcgaagggaggtgggaggttggaggcacagagaggagagagccgcgcgccgtcaccgctgccagcacgcgtcgtcaccaccgagacccaccacgcgccatccgctgccgccgagcgtcgtcaccgctgagcgccgtccccttgccactgccgagcccctaccccgtgccgccgccgccgagccccctccccggtctccgccaccacagatctggggggagatggcggatttgggagaggagagggcggatctggactcgtacctatctagcctccgcccatcccgcaccagcaccggcatcctcctcccatcccgcgccgcagcctctgttgtcgccgccgccgcctcccctcccccatccggatttgagagaaggagggtagccgcgcagagaggagagagttgtatgccattggtaggacggaccttctaaaaagagtggcatgctagtggagcattttatagaaaatagtacaaattccagttagatcaaaacgtactacagtacaactttttaacgatgattcttaaaaagcagtcagttgtagagttgtaggtaagattgagcatgcatggcccataccaaatttcaataacagaatcttttgtgcgtagagagagagagggggggagagtagagggagaagatagatctcccctctgccaccccttgttccttctatcgttcaaaacatgagccatatcagactcttgacacggttaatgacattttttttcccttgttccatagcagtatgaaatttgtttctgtatatgtgcattgaaaaaacaattgcagctgtaagcctgaaattatgccttgatcaatttgcaactagtccctttgtttcatatgaaaagatgttttgcctttttataagttaaacttttaactaagtttatagaaaaatatagtaactcttaaaacacaaaattaatttcattaaatatattttgataatatgtttatttaatattgaaaatattgttatgtttttctatgaactgatagtcaaatgacttggaaaaaaaaagttaaaatgttttatagtacgaagcgaaggagtagatatataaagtccggtgaaattattaacacaatatttgtcaggaattggtgacaaatcgatcggtcaccggtgaccgcgcgtcgcacagaaaaacgatcgggcatgcgtgaatggccactggccacgtagctgaattccaaataaaccaaatcttaaccctgttgcctctgggaagtatcgaaaaggatccaactatagacagatcacagatagagttctttccgtttccatctttaccttcgtctttagctataaatctggacacacagttattcaaatttatagctaaaaaatatttatattttggaacgagagagtcctagcggttccatcaagattcaaatcaagacgaagaaaacagaaaacatggaatgattgattttgcattcgtcctaaaacataaacagtagtaccacagtaatttggagtatctcagtagtcactagtcagtacagctttataggtcacgggtgaggaagttcaatctgcaatagttaatcacggaggtgtactcttgattctctccgtacgtgcaggcagatgattaatactattgtgaagcagtgcatagaaattggcaaaacactgtgcaacatctaggaggaagtacgggcaattttggtttcttacaataatatggtagggtaagaaatcaaatgtttggccatcacatttttggtaaaaaaaattgcttttaatcctgactattattgaagttgccaattaattggttgtgcatacttttatcagtccaaaatagctcaagaagtagttaaagcactaattaattaacgagtgtagcttatatttatggcatctatttttttgaatgaaaaatagtaaaatcgtttttacatgtaaattatcacctatttcattgtaattatattgtaaggtttaatatttacattatattttttctaatataccatgtatatagaattagaattaaaagtaatttattatcaactgaaaataggacatagaaggatacttacatatagacgacataggaaagagatgatgaaaaaatgtggcgtcataattttagcaataccgttaataattcatatgtgttactcattacatggtgcatgctcaagtggactatgagttgagtaaaatccatcactggtctctaaacttgtaccgatgtatcatcccggtctctaaactcgcaaatcgaccattcatgtcctcaaacttgtttgactgtgtcatcctggtccctaaacttgcagatcactcgtttaggtcctccaacttattcagttatgtcacccggtccctaaacttggatttgaatatcatctgggtcaaataggacggtataaaaactttatatttaaaaataattcatatttttttcatgtgaactctaatgaaggcaaactttatatcaaatttgtagccctcgacgcgatctacaactttgtagttgaattttttttattgtaagtcattttttgtcccaaaatgtaattttaaaattaaaatttcaaaatctataaatatgcaacaatattttgggaccctaaacagttttaattaaaaaacttttcaactacaaagttgcaggtcacgtcgagggttacaattttgatacaaagtttgtcttcattagagttcacataaaaaagttatgaattattttttgatataaagtttttagaccgtcttgtttagggaccagggtgacacaactgaacaagttggaggacctaaacgagtcatctacaagtttagggaccgggatgatacaggcgaacaagcttgaggacctgaacggtcgatttgcaagtttagggaccgggatgacacagcggtataagtttagggaccggtgatggactttactcttatgagttcatgataacctcactcagtgtaattattcacgtactcgatcggtttggcaaataacttttcttttaatttatttacaaagtgataatatttttgtcaaaaaaaatcatatttttatcccaactaaattagcagggggtaattgttagatacacgatagttagatatacatataacatattctgtcaaaaagaaagtgtgtacatctatacaaaagaacttgcgtttctcgttgccaatgcctcaccaccaaattaaacacacatccatgacaatatgacatatgtcgaggatgaatcgaattcctcactcatttaagttgcacagtatgaggcccatcgatcgagatgcgaattttatatgaaggcccataagtcaatggcgatgacgcccgatgatcatcgggtgggcctctttgatcgtgtaaaccttcagtttctgggcttacctcttgattcctttttgttgggctctgtctgaaactctgaatggatctggccttttcccagctttacacagtacattgaattagaaaaagtacaccgaaggtccctcaacttgtcatcaagttacaaaatcgtcccctaaccgcaaaaccagatatccggtgtcccttaactaatcaaaaccggtcacagcagatccttcggtggctttgacctcgattttatcctacatatcggctgagttagcgtgggacccacatgggccccacatgtcagtgtggccacgtcagcatcctctctctttccctcttctctcccttcctcatatctcactcacttctctgcggcacgacggcatggtgtaggacggcagctcgttcagcggtgcgacgaccctggcgcgggggcagagcggccgtgcaacggcgctgtctggcgaaggatggccgcgtcagcgcagtcgtgcgaatcctgggcggcggtttcggcgtgggctgcccggcagcagccatgtgccgtggcagcgcggcgcggcggccggcgacgcgggggcagcggcaaggacggatgagaatccgaggatacggaggcagcggtgaggagggatggggatccagggacgtaggggcggagaggtagccgtcgagctcggccccggccgagctttgccgccgccaccgctcgctgggcttggtcaagggaggggccggtgagcccgttcggacagtgaggagaaagccatgcccaccttccccttccccacggcgcagatgaatgccgaagaagagatggaatctgagacaggaacgacagcggttggagtgtgctggggcatgagcggcgacaacctgccgccggcgagcaaagtcaccgagatgctccgagagaacggcttcaccgtcgtccgcctctacacgccggacagcgccgctctcgtggcgctcggcagcacaggcatctgcgtcgtcgtcggtgcgcccaactacgacctccccgccctggcgcacggcaggacagccgccacggccgcctggatccgcgagaacatccaggcctacccgacggtgttattccggttcgtcgtcgtgggcaacgaggtctccagcgccgacatgcagctcctcgtcccggccatggagacgtccacgccgcgctcgcggcggctggtttgggacacatcaaggtgacgacgtcgtccgcctgcgccagcctgccgccatgcagctgctcccccgcgcagctgttcccccgctggagcccgtgaagaagagaggagagaggaatagaggtagggaggggaggtgaagaagaggctgatgcgtggggcccacgtggatcccacgctgagtccactgccatgtcggataaaaccggagtcaaaaccgccgagggacctagtttgcactggttttgtaagttgggggatacgttgtatccggttttacggttgggtgacgattttgtaactcgatgacaagttgagggaccttcggtgtacttttttccattgaattcgaaagcaagcattgtgcgatcaggttcaaaatttatgattgaaatacaatttgaatagtgaaaggattatcgagtggtatcttccatgctatggtattgtataaaatacatgattttgacaaaaatatatgtgcagaacagagtattataatgatacaaatagaactcaaacgtcttcctagaaattttctataggattgttcaattctttgtttgaaggtctccctagaaattcccataggattaaaattctttaatttcctatgttttcctacaaatcaaataggtttaaaatagagaattgcaaaatgcataaaaatataggaatgatggcttggttagactgcaggaaaaatataggatggtgaggagagaaaaagactcaaagaaaacttttcatgaaaacatgatgtatggattgaggcatcttatatggatttcatatgatccaatagcgtgcagtcctttatttcaaaggtccgtttaggaaaaaaatgtccattaaaattaaaatcatacaagaccttttgaaacaatcatatagaaaattcacacgatcccataggatatcagagtacctaccgttcatggtaacataaatctaaacgtaaatcccataggattgttcatattcgatcgatctaaattcacacataaatccaaacgtttgcatgaaagcattagtatcattctaacaactgcattagccattttgacgttcgtttcatttcttttctcgctggtctcaccatgttcatgttgttgtcacacattgacttaatttcatatcatccttcttgttcccgggtgaatccggtgaagacagaacttgtcacccggttgaaattagccaaattagccaaatccagtggtggtttgttaccgagaaaaagatttatgagtttgatgacaggagaaaaagatttaaaagaacattcgatgtatagcaccaaaaataacttggtactataagaatttttcttcgaccaaaagcatagactaccagtttttctttaacctatagcacttctgttgtattttgaggtggcgacgttagatcggggtagagaaaattatcctcagtctcatttgccattcgttttccacaccacatacactcatctctttcctgttcctcatctcctctttctcgttccccatctcctcgttctactaagcattatcgcttgaaaaaaagaaatatatgttaaatcctattctggacacaagacaagttctatcttattccatgttctagataagttctactcatgcctttacctagcaggtagctccctttaatccaccgtcgtgagcaagccaccaactgccgctatcgttaagcaagctgccagttgtcgtcgtcaaacaagctgctagctgccatcatcagcggcgtgaccaccgtcgccctttgcccaacgtggaatgccttacaagcaaccgccgccattgccctttctcttccgtggtgtgcgacattacggctctgttcttttggaggggttggtaacccctcctctcttcataaaaaacggagcgatagattaacacacgattaattaagtattagccatagaaaactttaaaaattgattaatatgattttttaaagcaactttcttgtataaactttttgcaaaacgtgtaccgtttagcagtttgaaaagtgtgtatgtggaaaatgagggaaatgggttgggaacccatgagaaagaacacaacctaagtatgatggaacgaacatcagcctaaccatgattgctatgctagacatacatgaccaggggaaaattagtatatctaaaaataagtgctgactcacggctaaacactccaccatatttatggttgtcatggaagtgctatgagtcaaataaaaactggtggtctgtgcttctggtcgaaaacaaaaggttctttttttttgccggattgttttcttcttacgtatcaaattttctccaaattagaggcatcgcccgtccctcaccctctcgaccacatgtcgtcttagatagttgaattgcaggggccatcgttcaacctgaaggtacatgagtgctacaatcaacaagatgagacggaccctcttaacctgtagggagaggccacatcaatagttgccgttgctcttggcactattccctacccctttccttatttcattgtgatatgaagaaaatataagacaatgagcgaaatgatagtgatactgttctttttggttaagatgtagtttctatctcggttttcatcggtacttatttcaaaaccgctaaaacggtgtgttttgtatgaaaactttctatatagaaactgctctaaactatcaaataaatccatttgtaataattaaattttagtaattcatagggcgttaatgcttttcttgttgtacgaatcatcagcttcgaacagaacccacgagcgtcgattttcaatctgacgccgcttgtagatgcattgactgtcctgcagtactgcctggcgagcccaacccccacggccgtgccaagtcgtcgcatcgcaccaggcgatctcgtcgtccctttccttgtcgcaaaccgcgctggcccctctgcaaactcgtctcgtaccgtaccccaaaaaagcccaaatccctcactccacccgcgtgatctcgcaggggcaatccggtaaaactcctccctgcctcctcctcctctcctccgcctcaacgcaacgcgcgtgctgctgcgccgcgccgcgcctcgcctcgcctcgcctgtgtgtctctctctcccccacagtgcgcagcacagcacaggttgtgtgacgcagggaaaggaaagcgggggacgaggagaggggaaaaaaaaggaaggaaggagttactactccccgcaccaaaaaccaggcgccagcagcagcagcaaccagcaagcggagaggagatggagactactactcctcctacttgcaccgcagccgcagccgcagcccaccaccaccgtccgcgcgcgcggctgcctccgcaacgcaacgaggagaagagtcgaggagcccaaccaccacccgagacttgacccccacccgcgactctcattcgatcacgcggcgcccacccacgcttttaccccttcctggtttcctctcccctcctcccccttcccctccccgcgcgatctccccaaaccctagaaacccccctcctccgccgcggcggcgccggcggcggggtgtgacgccgcggtggggggacggggatggagg

SEQ ID NO: 61282 - DNA, 8272 bp, Oryza sativa
ccgccgccgccacggaggaggcagccggtccacgggctgcccatgggcaatgctgccggcgcgcgcaccgcggcggtgagttgggttccgggacgcgttctagttttgggtaaatccacggtgtgcttggtgctgattgattcgtcgtgccttgtgatggtaggagctggtcgggaggggctcggcggggctggttgcctgcagctcggcggcgggggcggcagcggccgcaacctgccatcagtgccggagggtcgctaataccatttgttgtacaagctgcgacagaagggggtactgcaccaactgcatctcgagatggtatgctccggtatatgttgtgctgttatagagtaaattttagttccccataaggatgatttccgagtagattcagaacaggcttgaggactgaccatttgtaactattattagagaattttattttcagcactcagtttttgtgttctaaaagtccctgctaggtgcagggtagccaccgcgattaagcattagatggtggattatgcagctaacctgccttgggggctattctgctgctactttagtgttatatcgtgtatttttatgtaatatgcttgctaattgcttggaattctctggtcgagtttgccctaggcagagcccttgccgacctattagaatctagcatcttcttcaactatgtgtgcagcttatgattagtatatgatcacactgaaagaattattcctcagaagttgttgctagacaattaatgtttgtgatcacactgcggttagtaatggtaattcccaaactatcatcttattgttcacatagaaaacccttgtgtatacaatgttttttttttttaaaaaaaaaactgttttagggcattctattccaatatgcagccaaagcacatggatattttactagttaccttattaatttcagaagtacaatcttcgccttgtcttttaaaggctaatttttccccatcggctcactcaaaatcaccaaatgcaaaggcaatggctatccggacaccacagacctatcatatgaagtactccctccagtcacagaaaaactgtcctcgttggaagtgtgaagccaaactattgaaaattgaccaggacatccttgtgattatttggccagatttcatatatctagccatctggatacttttggatcattacatgcattatgttgtcctacacttttttaatgttaccatgaactgtaggtactctgatatcccaattgatgatgttcgaaaggtttgtccagcatgtcgtggcatttgtaactgcagagtttgcttactaggagataatgtaataaaggtatttaacctttaccaagagtttttcccttctccgttgccatatttatttattatttttatgctgactgatttttcttaaatttattattttcactcttaaatcacaaggcaagggttcaggagatatctgctgtagataagttggaatatcttcatagcattctggcatctgtccttccagtattaaagcagatttattctgatcaatgtttcgaaattggtgttgatacaaaagcttatggtattccagttcccctcttaacattcttttctgttattttcatccgaataatctcatatttctaacactagcgcaccatattctttgtgtaggacttaggacagatataatcagggcgaaggtcaatcctgatgagcaaatgtgctggtactgtctgttgcttatttttcacaagaagattcttatttctatgctttggcttgtagtgatacctcaaattatcctcgcagtgacttctgcaaagtgccagtatttgattatcaccgacactgcccaaggtgtttgtatgacttatgtcttgactgttgtcgagacataaggcgatctaggaccagtgttgcaagaggagaatatgctgaaggtcgtgtggtagatagaagtaaagatacttcgaataaaagagcaagaatggaaccatctgcagaaagtgcaaatgataagtcagtcccacaacgaagggacataaaaaatattgacattagatctttattccctacatggagagtcaataatgatggaagcattacttgtgggcctcatgaggctggtggttgtggctcctcgaagttagtgttaaggcgaatattcaaaataaactggattagtaagcttgtaaaaaattctgaggaaatggtcaatggttgtaaagtacatgttcttgagaatggatgctcatcctgcaatgatggcagaacattagagttaactggtcatcgtaactttggtgtctcaacatgttcaaataatggtggtattgatcggttctgtgtgttctctcctgtattagaggacttgaaatctgaaggtattattcattttcgtaaacactggataaaaggagaacctgtagttatcaggaatgcgtttgagccttctctgtcatcaagctgggacccactaaatatttggcgaggaatccaggaaatcatggatgaagaagtggatgacgatgtcattgtcaaagctgtggattgctcaaaccaagcagaggttagcaggaaattttagttgctaatttgtctttctgaacaaaagttactctttttagatagaggaatagatttatctcgccttctgcataaggcacgcgaacaaaaaagttgcttcctatttgaattcactgtgcctcctgtttgcactatatagattcccaagtgctatgacttctattctgggatgttgccatgctattaacttttagtgctactgctagtctatttgaatatgaattcatgatcatagcacgtattactcatctggcaaatatgtaacatagaagtgatggattggataactttttctagctaccaagtcttagtactatgatcatctgaacaatatatcctgtgttctatttcttttcaggtggatattgagctgaaacagtttatcaaaggttattcagatggtcacaagggggaagatggggaattgatgatgctgaaattgaaagagtggcccccacccagtgtattggaggagtttctgctatgccaaagaccagaatttattgtcaattttccattagttgattttatacattccaggtgggggctcctaaatctttctgctaaattgcccccagacaccctacaacctgaagttggcttgaagctgttaattgcatatggaagacatcaagaagctggtaaaggtgattcagtgacaaatctaatgattaacatggctgatgtggtaagtagggctttctagattcacttcgagtttcttgtgattttgttgcaaagggaggaggcaagaacatgcgattttcttttagatcctgttcgaagattcgtgctgtcaagcaccagagtaaaggtaaagggtggggaggggaaagagaaggttggggaggggaaagagagggtgctccgaggttatggtaggaagccaggctggcgtgtggcactgccctgtgtgccggttgggtgagagcagtgggttgggtcgaggttgggggaaacgaagaacacaagcgtgaatagattggggcagttaaagggcatcaggggatgcccggatgggcaggaagtggattagggagttgtctgatctgttggatatttatccaatggtcagaaaggagaatgcttgagggagaaaaaaaacatttgaattctaaacagataagtgcatgaaataaaagtcatctgatacatgtgctatttattcctcttgtaggtgcatatgctaatgcatacagccaaagggcatgacgtatgtccaaagaggctacaacctgagcgatctgaaaagattgccaatggaatgacaatgcatgtaaatgctcatgcacctgttcaaaatttgaatgtggatatgggggaacaatcacctgaccatgtaagctcaaagtttgatgaaagagcgcatgcgtctgccttgcgattacaagagaagtcttcagatgccaaacttaattgtggtttcgaaggctcttcaactgagttatcttgctcgtcacattcagaggaaccaaaagttaatggttcagaaagaagtcaggctggttctgtttgggatgtgttccgcaggcaggatatttcaaagctgaatgaatatttaactgctaactgggaagaactggcagctagtagtcaggtagcgctctctgtaatgacatcacaattctttatgacggatattgttgacatatccttgagaaagctatttcatgattatctgtttttgttgcaggttaagaatcctatttatgaacaatctatatatctcaacaagtatcataaaaggatactgaaggatcaatatggtaagcacaaagtacggcatggatgattgtcgcttctaaattggcagatgatttagctgtgaacttatcattactgatatgccatagcatctcatttcatgtagttacttcactcactcctcagactttgtgtccatattccaaagaaaacatttcattgcaataccaaagcaaatagacaatagctgtctaaatttccagtaaccaataagactccattggttctttgcttgaagggcaaccaagtgctgcagtctgctttgctaggatctgcttgctgcctgatctctgatttccgtgctacagtacatgcgcttagtgaaccatgcagaatgctaataatatttatgaggataatctcaggctattgaaatttagttctatcttattaatgtggttctaagttactttttgtgagagccttaatttggatcttgttacaggaattgaaccctggacattccaacaacatatcggtgaggctgtatttgttcctgctggctgcccattccaagtgaaaaatctccaggtgtgattcttccgttcctcgtatttgcccttttattgtccttaaatatttttgtttgctttgtaagtgatcatttagaatatgcaacctaaatatgtgaagattttggataaagcataatttttgctccatcaaattcttaccatggtactccaaacactaattatgtgctcatacttcccttctctgtatggtcaaaagctttcttctatgaataaagaatgtgctgatgtgaatgtcgatttgggtaaacaatctctatggcggttaaaaattgggcaaatgaactataaaaaacaaaaaatgcagggttttcatataatcatatgtttaattatctagtgatttggatgtagacataccaaaagaataaatacagatagaaaatagatgctgggaggcatcgatgcttagggagcacatgataattgcacatggtgttgattctctctcactggagagttaaatcttctcttttttcttcaaaatgtttcagtctacggttcaattggctcttgatttcctgtcaccggaaagtttgggggagtcggcccgaatggcccaggagattcgctgcctaccaaatgatcatgatgcaaaactgaagatgctcgaggtacctgactagtactaatctggttataagttgacttcatgcctaactttcttaggttttggagaacctgaaaaaagttttgtccctgtacagattggaaaaatctctttatatgcagctagttctgctgtcagagaaattcagagaataaccctcgatcccaagtaagtggattatttcttggagtattagagaaagtttcacctgttgtgttcatttctttatgcattgcctgccagcttggaattatatcttgagcaccgtcatcaaattattaaaactttgaactataacatctcgaacaactttgctatttacccgtacaaattataatcagtttccttcgcattttctcaggtttaatctagaccttaaattcgaggatcagaatctaactcaggcggtttctgagaacttggctagagtcaccaaacaacggaatgtaccatgcagctgagatactccatttaaattagatatagcaattgtacatgtattacatggtgtcatatgaaaggaacacaatgacacattctaattgttatcagatagcataagccctcacctgtatattggaattggactaggactaacggctgagctcatgtaaacagaataaacgtggagcaattatttagcattagattgtcagaatgagatttactgggttgcttagagactgtcactttgatacaactaattcttctgccgcttctgggagaaattttacatctgttgactgttattaagtaactttgcttaacatgttgaacttgttacagtgagcaatctgtattctggagattggcactgttttatcatggtgaatgtgcattttctcgaaagagaactagtctccttccattgcagatgaactagcttacgaagtactccctccgtcccataatataagggattttgagtttttgcttgtcctgtttgaccactcaccttattaaaaaaatttgtgcaaatataaaaaacgaaaagttgtgcttaaagtactttggataataaagcaagtcacaaaaaaaataaataactctaaaattttttgaataagacgagtgatcaaagagtacagataaaaactcaaaatcccttatattatgggacggagggagtagtgcatttgtgtgactccaaccatcttgttgctagtgataataagttttgaaagaagtgttgttttaagagatactatgtttgttgagtaattttcaacgtaatttctttttagcgttagtttttaagtcgctacgaataaatacgtaaaaaagttatctatattttaattttattctctaataagacattctggcttattagttaatatgggcaaaggctctaaccattggcaaaatttaacatttaaaacttaactttggagataattttatgatgttttcaatgaaatatattttattgtattggcttttaagttgcttaggactcatctctactgttataaaaattgaaggtttttaccggtactttggtacgtcattcgtgtataagtatgttattttgtgttattatgtatgagtcggtttttaatgtcgttcgcttttggaaatatagaagaacacatataagaaatctctttaaataaacttgcatgctaacttgagacgatcaaactcctaactataagtcatgtttttctaaaaatatatatatccaagtgaattcccacagtgaattttaccttaactaaaccataataacaataataagattaccgttgcattgcatgggcatatttttctagtaaatactccctccgtcagattttggagtaatgtgatactataacctaatacaacgaatctggataggctcatcgtctagattcatagtactaagttatgtcatatccctctaaaaccccttatattatgagacggagggaatataaattaaattgtttttgtcctaataatttgtgtagcttgtaatcacctcatggccaatcgatgattgttaagtctcgtggtaatttcagacacaagtttgaacggttttgctattttacttgtgacatatttttaggctcttgtctttcactttttagttcataggatcttgcatcttgtatatctttttaattacacatggttacagagttatattgtacttatattgagttgtagtgcacttgcactcaattacagtgcacaaaaaatagatgttggaattaatgtttttctctaaatttatgatttttttgacacgattgtctctttttttaaaaaattcatttaaaacaggctatatcccttggttgaaaattttgcaagattcaaaactataaatttgtccaaaaatcattagttaattccagtttgatttgtaaaatcatgtttttcagcgatgaacttcttcttgttctactactacattttttattattacgatggacatggcgtgaaatcttgtaaaattttatgaaaaaggtacaagtagtgtccacaagtgaaaagaaatcgttgaaactgagaaaaatttcgtcaatattttgaaattctgctatatttttttctaaaaaaaagtttgaccagttaacctagcggttcaaaattttgaaattttgtgaaaaatgtaatagtactagcaatttaggcaattgacgaagcttgggacaggagcagggtttacattactggttgaccactaaatttcgagcactattagtatcgcggtttccaataaatttcgatcagatttcgataaattttgattgaatttcaatcaaatctactgtttaaccctcaaaa

SEQ ID NO: 61283 - DNA, 1741 bp, Oryza sativa
attgtgcgttgcctgagccctgatgacaaatcggtgctccttttcggcttgatttttttttttggtgctgattgcgcagggtttttttgagatgtgcaggtgctgagcggggtggctctgctgtcgtacaaggcggccaaggctcccagagacaaggagcatccgtatggtcagtctcccaattctcttctactctgtgatcctcgtttgtatacggatgtgattcttggctatggtggcaggactgatacttaggtaaatgtcatgcattgttctaagctcgtggcaaaccgagggtccaatagatactaattatctaattattgactgatatactaattaatatgatgtaaattaactagaattgaataatctacctggggacctctgaccccaggaattactatgtagtaacgccacttctaagaggcatctgtctaccaatttatgggagttttgcaattagttaactgatatactgactgacaagacgacaatctcctgttcccacttcctttgttgacataggcagtttacttgcattcataatggaattgcagaaacttagctccactagaacataggctgttactagggtcatgttttatgtgttaaaactgttaagaatagtcaaggctcatatatgatgattagcctactttttgaaagaaaaaaaaaagaatatgaagggagctgaaatccgtcagttgtttacagtatggaagctattactacatgtgcttgtgcgttattgcagccacatgcatgttcatgtgtgcaacaagatataaatgctagaaaagttagtaagggcattttcttactgattctcatgttttttctaagctacctgaattgcttgcgttataataattattaaagtctacatagaacagcctccatgcctatttgatttattgtcttgtttgattgcgctaaaagtgttgaagattccatgtcttattttgcttcccttccaggtcatggaaagtttgagagtttaggagctcttggaatttcaagtatgttattagttactgcaggtgggattgcctggcatgcttttgacgttcttcaggtctattactactcaatgtcacaatgtcaagaacactaaatttatgtttttcagtgatgttgtccttttttcttatataatttctgtttttgtaaattagtgtttggtccctgatgacatatactcccatcatacataattacacatggacttcacatgttgaagtttgtttatttcagggagttatgtcttctgctccagatattattggcaatgtatcgcatgctcatcatagccatggtagcagtgggcatcaccatggaatagatttggaacatccaatccttgcattgagtgtgacagcttttgcaatatctgtcaaagaagggtaagtgagtgttttctactgtactcatgctgcgaaaactgtgtaagtttttcttttgttgttctaccagattttacaatcttatcttatgtggtgtacttcttgctgttttcagctactaagtgttattcgctacccttcttgatattatttttgcctaccatgattttaaattttatggtctcctgtaatataatgcttgtaattcaatggcagaagtgtttctttgttaactttgttgatagtagaatatatgtagctctgaacacctgacattatgtttctatgttttggctaatgattatttttctatccgtttatatccatagcaggta

SEQ ID NO: 61284 - DNA, 1044 bp, Oryza sativa
aaaacccacagcaggaatatttatgaagtacatgcattgtagatccttcatattcagtggaatccaacatggaccaaaaagggatttgggagaatatagagagaagaaactcagatgctatcccacgacaacaaacggcagaagccattgtgtcttgtataatttcctcccatttctcaaaggtaaatcttttcacagtccatgacaatgcgaacacctccctcctgcatctactgaaaccatgatttggtgcagaaaatgtcacttgaacacctaatgctgcattacttgcaaggacgagtgttacttcaggtcgaagtttcaatgtctccagaaattatgatccggtaaattagctcttccatttctatcccaaatcttcaccttacaagtttctaaccctgtgttttttttttctccaattgctcgacccaaagggatgcaatggacattgcaaagcaagcggaagaggagatactgaaggctgattccagcataagccaagtaagcgtacagctaagattgggccagcaaattaagcaacttaagctgccaggaggcaaaaatagagcgaagaatcaacaggcacaaatgcagtagcgtcagctacactgtcacggttgattaggctgttttttttttcttttttttttcaaacattattcgatcgacttcgcttgctgctgagtgctgaggcagtagactagttctagcttcgtacagagtgatcttagcctgttcaggcttcagagatactactatggagcagtatatatatatatatatatatatatatatatataggacactcatatggggcaccatggtgcccgggcaccatggtatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagt

SEQ ID NO: 61285 - DNA, 20540 bp, Oryza sativa
tatcgcgggaacacttgttatttcgatgaaaatttgagtaatctaccaactatactaccatacgaggctgcattcatattttgatctatattgcacacaagttggcatgtttttttgcacccagactgacaaaaccatgcatgcaactggccagatgcgctaggttgcacctcggtcctgttcaggattatggattactgtgacatgctttttataagcttctaaaactctcttcatcagcatatcttagagagcttgaaatcaacttaattatcgactttctaattcattcgttttgtgttattatggaacaataataatcattgtaaaaccagcttcagacacatcgacctcgtcattggcatcccgatcatgtggggtatgatagtctaaccatcatgtagggtctactcgtacgcacggacggggtggtggtctggtggcgtcggcaaccacccacacagacggacacaggctgcctccaatatccatctcgtccctcatcacttcatcagccggacggagctcctccgacgtcaaaaaatgattgttccaattttccgttaatgggtcggtccagcaatggcaaggatgccctagacgagtttgttatcgttcgacttctgagctttgctgttgcttgcttgcttagcgttgccgagttgttgctttctcgactatggagctcggctcgggatgatcggcgacgtgcagagactgtgtggtggattacgcgtgctagtagctagtagtacgcacgtgtaggaagctgctccaactgcctagtacaagtgtaggaggttcctctaacgtacgagagatttgggtcacacctgtcaattctaaaccggtcagaaactttttatattcattgatttaactatagtaacgataattagaaaaataaataaatttggtactcctatttgactagaaatagaaagtcacacaaatagtcagaatcaaaatcaataccacttgtacgaaaaccatacttaagtcagtcgggaatttccttccccgttttcatcccaccccacaaaacgatagcaccgggacaggagaggagaaatgaataaaagaaggtatcgcaccgagaccaccattgcatgcaggtgacacaactcacaaactgtcgcataacaacattgcattgcatggtaagttaaaggacggtaaaatggatacagccacttgctgctcctactatcatcatcaagctaagctaacatatccaccatggatgatcagtgcatcatcaacgagaacattaaaaaaagaaaaccctgttgttaatcacagaatgaatttctctaaaagtacggtgtactgcctctctcgttcttttcctctcccggtacaagagccgcacctacgcaaagccttcacatggcagcaacacgcaactccctctaaactacagcagctcacctttgcatatctccctatctgcataaaccgtcgcttccaacaatgtcacctgatgttcttcttccttcggcaaggctggtgtcgatcgatcactctcacaatgccgaaatgggtgtcttcctcgtttgtcatctgcgggcaccagacaggcaaaagctcattgccgagctccagagtgcatgctcgacttctcggtgtcgctgctggtggacacggaagctgcctccttggtggacttgcgagctcgctgacgaggcctgctcgagccagtggggtcagccttgcgcttcccgcttccgaggaggccaaaggcgaccgcttcaagggctcttgccgtgggaggcctgactctggttccttgcctccgaggattcattgcctgcgaagaagcctgaagatcaggctgagggttggcaggtcctcctcttgttgcctccggggcatcatgagcgatctcggtgtttgaactggaagtagtctccttattcttgaggatgctaccatggttgtctgatgaaggggcgtgcgcaattgtgacagtcttatcatcctgcggtgtttctagtttaacctgattagccaccaaatcactagactgagctactcctttggcaggttttgtatcctcaacggcggtcttcgaatgaacagaagccagtgtatctaccttatgcccagatggcttctcctttggccttgccacattcatcttctcatttgatctgtcattggcatgagagtttgatgcatcctttatctgctgacatggcttctccttgccagaacagctcgcaagtgatttggattgaaaactaccaccaacatcaatagcagttggttttgatgaagttgatggcagcttgactttctctttttctaaaccggggccttttgagaaagaaaagctgcgtcgactggtctggtcattgctacagctagttagtcttctgcgcttcgtcactggggataagtacttgcgcttttcaattttagttttctggggaaagaagcttgtcgcaccaattgtgtcaccattgccattagaagaatggccattaactggaaaaactgagcatgatgtagcagccatatttcgaaaagagtccacttggctttcattgtctgcattcttggatgaaaccatttcagtgccattctcatcagctgtaactcctgcgtagccttccttgtaatctgatgatctgtcatctgtgtcatgttcgtctgaggaactatcactcaccatattatgtgtatgacgcaaagggccaaaactaatatttgcatcagcaggcaagttcctcagctccctcacttgcgagggctcttccccttggaccaagctagtatcgattattgtaaactttggaagctcgtgatagccatcgaaaggaacatcttggttcagtttcatggctgtgtcaaagccatttttctcagcattaacaccattgcccattccatcaacctctatctcaagaagaacagggtctgctaccactttcttgaggacatcactaacagaatcaaaataatgagtgccttttgtaagttcacttcttgaaaacctttgaataccaggcacaatgaatacaaggcaattcttcgttgtgctgacatcatttggcttctctgagtgccaccctcttgcaagcaaacgaggccagacagcttcccaaaaaagatcatttgatcttgtcttgcttcttctgaaatcacccgttaagaatttgattatatcttctgaagcaagagaggaacaatctttgcctgcaggcatgccgggctgaacagaaaggacttggtttggtttggatgggtccaaaacaaaaccagtcaaatcatccttccctttaccgatcgcaaccgcctcaacaaaagcttctattccaacaacagatttcagatgaaaaacaaaatccattaatgatgtttggctgtcgttgaaagatttgaacatctgcaacatgaaaaaaacaatgcaactcatatagcactgattgatagaaaaacattatctattaatatccataaatttgaaataacttagttctgtgaaattaaactacgtaaagttccttggaccattgcaaattgaactccttgtgtgtactcatacttggagagcactagggttttttgtctttttggaacagctctaccttaaaaagtgcaaagagaatacaattcacaaaaaaggtagatcaagacacagaaaatcccaacataatagccaaatgaagtgtactgtgcacttgcttcaattttcaggtgtaacatctatatttataactgaaatcctatagtaatagttgcaatagagtagttattacactctgatgcaagatcagccaaaacacatgccatgacacttggatagctctccatatgattaagtcaagataactttgttcattctatttatatggcatatgatgaggtgagacttatacctacgaaaataggtaagagattaatctggttgacataacttggcaagaatctaaaaagagaatctggcttgaaactaaaacttcaaagaatggaagtgttttccattataacaagaaatgctatgagaaaaaaaaaaacagtgatggaactggcgttcagactaacagaacctcatttaatcatgagaatagtatcatgatgaggcatctcaatgtttaattactcggtgcatagatagaaatagaagagccgaataggtgatcaaagtatgagtgataattgtgacgtacctcatccaacagatcatgagcttctttagggattttagatttaaggcgagatataagctcctgccttcgccaacctataaaaatgcgttccccaagaatgcatctccttatttttgcttttctgcaggctgaccatcttttatatgcttctcctttgtagaactttccataatagtaggaaagcacatccccaacagtcttactacctacaaatctgctcaacacatgcagatttttgccaaaaatatagaggccaaggagcaataattctgcttcctgatcactccaaatggaagtggatgaattaggcactggaataaactgttcaatttctccttgatctgccatggccttatcagtgaagtttagaccttcttgagtggaacatggagccaatttatcatcgtgtgcttgatgactgtcagatactatctgatcaggtagctctggatgcggatcctgagatgttgaacactgtccacttgtgttattactggttgggcaaattgaggtcgtttggctatccccatctctgctattttctatagccttggtttctgaagaatgctgcttttgtatttcctcttccttcttattgaattcacttggtaatgtccacataattggtatagggcaatcataaccaagtgccatgcaactatcagttgtgttgctcatgtactgacgacgctcatcctctgtggcaagattagggatctctgcttggtacgcttttccagtgcatatacgtggtggtaagtcgtcatctgtagcatctgattggtgtccatcaccgtcttctggctcaagtgactccatctattaaaattacaaaaaaaaagaacatttgtaaaacatttcacattgatacaaaaaaaagtgcattatcacttcaccatcagcacaaataattaaattgtcaatgtactttcgaattatgaatcagaaggatgcatcatcaacacagctcttctttgttaacacatggaaaaacaaaaacagctaactgcagtaagttcaacgcatgtaaaatcttcttcctttttaagcccaagtctaatctcctagaactcttatatacttacatttttccctatgatgcaccatcttttggcatctaaaatatactgtatgcaacagaaaatgaccaagtactaatttatgaacttggcagttagaaactgaagcagaaacatagtctacatggcatcaataatgtactatacctaactgtatctacagttctacaaagtccctgaagttacccattctcatgaaagattgataatagaaaacaatgctttataaaaaggggttaaattttcccagcaaccacaactcatttggaaaaaccttgctactctcacaattgcagcaaagttcccctgtaatgcaaacatccataatgcattcaaaatgccgcatagcagacgaccaccaaacttactttccgagccccaaagctttcggagactcgtgcgcatattcgcatcgtattgccggcagcaatatggcttgcaggaagcaaaccaacacaatgtctgtcatgtataaccactggctgagtagggttcatcgttggacataacccacaggcagaatgattgacgaaaagaaaagaaattttaccagccacccaacagattgaattactcgacatcaacacaaattgctcactggcaacattgcatcaaagagtgcaccatggctagaacctatcaagattgctcgcggcatcggcgagggtctcgtggcacacagctacaacccaaaacacgagtaaaattcgagccatgttggtagatacagggtcaacaattgcattccgcgaaatctaaggcccgggcacggtggcaacacaccaccacccgcgaccaacccacccaatcccacctcccgcggcggccgcatcccgtcgagcacgagatacccaggcgagccacgcccacgcgcgaccacgacacggagcagcaacgggggcctaatccatggcgctccaagaacccgcacgaacgactagcacggacctaaaagaaaatctcggggggaagggatgacgtgatcacggaaggaaaccacccacccacggtcaaagcaagaacacgggcggacaagcaaagcagcagcagcaggcgaggcgagctaaagattggagggagggaacaagagcgaggcgaggagaggagaggagagaatcaccttagccgcctccatgtccatgtccatgcacgcacgcgaagccgccaccgccgccgacgccgccctcctcccgagctcccccccccaatctcccctcgcgccaaccgccaagaaccccacgcctccccccctcccccgcggagcagacggcagaatctggaccacgcgcacggacaggagagagcccccacagccaccacccccgcgcggcgtgattccggacgcgcagggacgaggcagcgccgccccacgcgacgttgacgacgacgacctcgagacgcggtggtggtggtggtggtggtggtggttcggggcggaggcggaggcggagacggggaggctttaaagaggaggaggagcaaagagagaagaggagacgagacgggggccgaggcgagagaggaagagagaaacggtgacagcgagcgactgctgcgagagagattggtggtggtcacgccgcgcacacaccccccgccccctcgtgggccgctcgctgctggtgggctgggcttgggaggctgggccgtcctccgcgcggagagcgtgacgaacgtggtgggtggggtgccgcgcgtggacgaccgggaacccgcggacggacggacgctgggccgcccttcccgtgtgccgtccgcgtgcggatgcgggcgtgtacgccacgctatagctgcagccgcccagcggttgaacaaggggcggatcccgggggaaatgtgtgtggtgtgtgtgtgtggggggtggtggggggggggggtgttggacactttcaccacaggttatgtgagtttacgtgaaaaaagaaatgtattcgacataaacgatgaaatctcgatagaattttctttaccttgtgtttcttccataggttatgtattacgtgaaaataaaaggcattacaatcaaacggtgaaaacttgatagaattttctaacattgtgttttggagctttcttcttcattgcttggacgatggttgatgctggtggacgctaccgccgaaccaccggcttacgagttacgacaggtgctcgtcggggcttggagggaggcatcggttgctgcgggctccgtctccatgtggggtggtggccgccagtggtcttctggtccatagtgaatccgcggcgtggtggcggcactagtacgagccttggttgacggatctatgcggaggtaagaggcccttgcaggtgggtcttttttcctcacaagtaagaagaatgttgtcttagatggggatggtggaggttaggtagaacttagtttatatagagatgaaggggatcggctaggcgtggtgtttagcagatctacaaagtgacaagaagcccttgcgaatacgcctcgatcctttgttcttgagtgagaatgatggcgccttcgatggagatggagataaggtatctacaaatgagtttatatagagatgaaaaggatcagctggttgattggatctacatcaaatggctatccaaagagattaaatttagcatcaaataaatgggcatatgacatccaagaatggccgtcaacattcattttattttccagctctaccgtttctcgagaaaaagtatggttgtggaaatgattgatgttggtttccaaccaatatcacacctacatgtgggcgaggggtagtggtgttggccaccaacagtctttgggtccatgatgaacccacgggtgaggcggaggtgctatgaccaccgtcttactggttaagactaataaccaccttcggaccaacaacttacaggttacggccggtgtttgttgagcttagagagaagcgttggttgttgcggtctccgtttccatatgaggtggtggccattgacgatattttggtccacaatgaacccgttgcatggtggaggttctagtaggtgttgtggtcgacatatatgtgtggtggtaagaggctcttactggtggaccttatttcctcctaagtaagaataatgacgtcttaggtagggatggtggagatttggtagaagtgtgttcatatataaatgaagggaattggttaggcgtcatggttagggatctacacggcaacgagagtaccttgcaggcaggcccacagccactccacacgtgatcccccctccctcgtccggatggagcagcgtcctcgatggcaacgacaccaccctcgatgtggtggtggtggtggtggttcgaagaatcagagttgaggtggagacgggggctgaggcggagtcaagagaggctttaaagacgcgaggagcaaagaagaggagatgagatgggggctaggcgaggcgaggcgagagaaagagagagaacagtgacagtgactacgagagagattggtggtggtcatgccacgcacatatgccctcgtgggcctctcgctcctgggataggccgtccgcgtgcagagcatgacgacatcgtgccgcgcgtgcacgacctcgaacctgcaaatgggcgttggctgcggctgccttcccatgtgccgtctacatgcggatgcggtcgtggacaccacgctagttgttgcagccacctgatggttatggcttcgaataggcgacggattcgagggcaaatgtgggttcaacacttccatgggttatcagctatttgggtttacttgataaaaatgtatttgacacaaatggtgagatcttgacaaaaaaattttgacctgtgtcttggggctttcttctccatctcttggatgatggttgatgccggtagccattgtcgccagacagcggcttaccggtcaagaccgataacagctgccgaaccaccagcttacgggttacggctaatgtttgttgagacttgtagggaggcactagttgttgtgggctccatttccctattgagttgttgccgctgaaagtctttggttccataataaacccacaatatagtaggcactagtaggtgtcgtgttcaacggatctgcaaggtggcgagcttttgcgagtggtccttctttcctcccaaagtacgaagaatggtgtcttaggtagggatggtagatattgggtagaagtgagtttatatagagatgaaggggattggctagccgttgtggtcaatggatctacacgataatgagaggctgttgcaagtgggcctcctttgctctcaagtaagaataatgacgtcttaggtggagatggtatagattaggtctagaagtgaatttatatagaaatgaaggtgaccggcaagacgattggatctacatcaaatgactatcgaaagagattaaatctagaatcaattaaatggacatatctatctaaaaatgcccaacatcactcattttacttataaaaaccccttagctttcacatggtggtggttggtcgagtccatggtaactcgacgatacggaaaggtgcaagaacaccatagcctccatgtacgtgagcaaccttcaccctctattcaaggccccatagatcgaagcccctacctaactccctcccttgtggcctttttttaaccgattgaaccatttgggaatggtaaaccatcagaaatagaaaacaaaaggataaaccattgaaaacataaatggtaaaaaaaacaaaaatgtttgtgttgtactaccaaatgttttcttggtttatcatattttttacatagattattatgcttctaaatactcccaataaccatggcccatgtctccatttggctcgtaggccaacaggccatcaactctcattcatgttaagttccacatgtgattttacattcaatgttttcaacttgaatttccattctttgatcgatacaacatgttctaccctaacaaatttgtttctggcattttttccattttcggctctaccgctttctgagaaaaaaatgatagaggttgtttttcaaccattttcaggcctacacgtggaagaggggtagtgatggtggttgctgacgatcttggtccatgatgaacccacggtgaggtggaagggtagtggtggtgtccgctagcggtctttgggtctataatgaacccacaatgaggtggaggtgataggattgtgcagtgatgagaggcccttgaaggtgggcctcctttgctctcaagtgagaatgacaacgccttaggtggggatggcaaagattaagtgtagaataagtttacacagtgatgaagggaatcaactaggtgtcgtgattaatggatctgcctgagaggcacttgcaggtgggcctacttgccctcaagtgagaataacgattccttgggtggtaatggcggagattaggtctaaaagtgagtttgtatagagatgaagaggaacggctagacggttggatctacagcaaatgacaattgaaagagaatcaatttgttagcaaataaatggacacacaccatccaaaagtgcccaacaacatttattttttacttctaaaagccatgcatatgtgccatccaaaagtgccttaaaaacatgcattttgcttctaaaagccaagtggcttatcccatggtggttcttagcatggttgcattgttggttcggagcagaagcggtgggtggagttacacctttaaagacaacacgtggagcaaagagagaatgaggcggacgagagataagatggagagagagaatggtgacaacaagcaagagaaagaggcttgtggttaggacagacggtcttgtaggttgttgggctaccattgggccgataacatcgtgggttgggccggaaaaggtggtggaggtgatgcatgtgggaggtaacagggttgtgtggacaatgaatggacattggcctttattggtgttaacggcaaaatttggcaatttttgttagtcaaggttgagtcaaagatggtattcacgccataattttagttgatttggttagcaagattatccacatttttgtaatgtacttccatgataaggaatatttttaagtttctatttctatagatagaattctgggccaacggagtcatattaagatcgggctcagataagtttttcttttagtttagctgattagagtcgtgtctgaattggagttgtattagtagtttccttaattagagatagagtccttagttgatccgatcgtaatagagtcggacttagtataacctatgggtataaatatgtacacacaaggtctttataaattaacgacagttcaatatataacttttggcacatcgtcaaccctagttttactttcgacgagttcttgttttcaagtttaggctgcatcaattttgatctcccgcgagaaagtaagttccatcaacttcgcttgtatcggaggaattaatactttctcagttaagtccgatatactagttaagctttgcttgcattgcctattggatatatcatgtctttctttgattgttcatgccattattattagggtttttatatcaatcactatcaaaagtatcaatcaattaggttagatctaccaaacttgttattgatctagaactatcttggttaagtccaatcttctaggttataatctgttagttagatttgttcaagtcaataaatacttgatatagtttaatcgaaatattagccgatgagttatctatttattataaattaatctactgtatcgaataatgcataaattttgccataatcggttaagttgttatttttattagtttcaatcttatactgtctcggttaggcccgatctatcaagattgtgattaataaatttagattgctaacaattataagctgggatagcctatattagtttgtctacttaatgagtaatgataggttttaattgatattatggtacatcagcctatatttagggacaaatataattgtcaaagtgcttattttatcactttcaatattatactgcctcggttgagtccgatctatcaagattaattgtaataaagttagaatatttacaagcatatacatacatacatacatacatgcatacatacatacatacatacatacatatatatatatatacacacacacacacacacacatatacctagactccggccgatgtcattttaatccttcatttttttttcatccattggttatagccgatcgatccgaaattccatgggcattggttgggcactcaatactatatcagccctatggctgatcggccccacgatctaatcttttttgtttttcttattaattgcagaatcaaactaattagcacgctctgaacccaatttgataggacatgcactatagtaaaataaatctctcaagccttcatatgtgcgacgaatttcacgtcaacaactgcatgtcatccgcatgtagatgtgtattctatcctagtgcaaccgaggattatagcttcgagctgggggtgggtttctctactaatgtaaaagcgaagttgtcgtgttgcaattccctcccagaatgcacaacacccacgtacgcgtgtgtaactctcggatcgaatgccttatcctcaatcacactcttagcccatccctaattatatgggcctggcccgctacaacatatggtatgttactagtaagggaaaaagtgggacaactaggtgtgtgcttcccactttcgcgggttatgtgtgatgcattaaaaaaatgtatttgacacaaacaatagagtatcgacatgattttctaacctcttgattgtgggtctttcttcttcattgcttgcaagatggttgatgttggtggccgcctccaccagaccaccaccttaccaatcaagactgatagccgccatcagaccatcggacaaacaatgtgtgggctccatttccgttggaaaagtgggagaaccgggtgtgtgctccacacttccgcaggttatgtgtgttacataaaaaaatattttggacacaaatggtaaaatctcaatagaattttctaacctcttgattgtgggcttccttcttcatcgcacagacgacgattactactggtggctgctaccgccataccaccaacttgctggtcaagactgataaccaccgctagaccaccagcttacatgttacgcccagtgctcgtcggggcttggagggaggcattggttggtatgggccccattttagtaaacctgcagcatgatggagacactagtaggtgccatggtcgatggatccacacgacgatgggaggctcttgtaggtgggccttctttcctcccaagtaagaataatggcatcttaggtagggatggtggagactaggtagaagtaagtttatatagagatgaacgggattggctaggtgttatggttaacgaatgcacatggctatgagagtccctttcatgtgggcctccctttctctaaaatgagaataaggttgtcctagatgaggatggtggagattaggtctagaagtgagtttatacagagatgaaggggatcggcttgacggttggatctatatcaaatgactattgaaagatattaaatttagtatcaaataaataaacatatgccatccaaaaatgtccaacaacattcattttatttccaaaatccaagcaatctatcccatagctttgcaagccctacttttgtacggggtgatgactggtctttgagtccatgatgggtcaacgatgtggtggaggtgcaagaacatcatagcctccatgcacgtgagcatccaccaccctctacacgaggcctcccacctcaaaacctcaacccaactctgtcccttacgcacatgttaagattgaaaagcgccggtaagtcttcattgagtagctattgctccccctttttttcacctattggaccttagggaatggtaaccgtaaaaaatggaaaacataagggtaaaacatttgcaaatggaagtattaaaagactcgttagcttcctcacttgcaaggcttctttcccttggaccatgttagtatcaattactgtgaactttggaagctcgtggtatccatccaaaggaacatcttggttcagttttatgtctgtatcaaagccttttttcttagcattaacaccattgcccatttcatcaacctctagcttaagacaaacaagatctgctactactttcttgaggtcatcactggcaaaatcaaaataatgagtgccttttgtaagttcacttcttgaaaacctttgaataccaggcgcaatgaatagacaaggcaattcttagtggtgctgacatcatttggcttctctgagtgccaccctcttgcaagcaaacgaggccagacagcttccccaaaaagattatttgatcttgtcttgcttcttttgaaatcacccgttaagattcgattatatctcttgaagcaagagaggaacaatctttgcctgcaggtatgccaggctgaatagaaaggacttggtttggtttggatgtgtccaaaacaaaaccagtcaaatcatccttccctttaccgattgcaaccgcctcaacaaaagcttctattccaacaacagatttcaaataaaaacaaaatccattagcgatgtttggccgtcgttgaaagatttgaacatctgcaacatgaaaaaggcaatgaaactttcgatcactagggtttggaggaagatgttggttgctatgggcttcattgtcgcgtagagtggtgactggtcttcgagtccatgattggttgcagatgttacggagatgttaggaggtgttgtggtgaacgggtctatattacgatgagaggccctggtgggtgcgcctcctttgctcccaagggagaatactggtgtcctaaaatgaaattagctctaggagggagtttatatagagatcaaagttatcagcttgacggttggatctatctcaaatggctatcaaaagtgagtaaaatttagcaattaataaatgggcacataccgtccataaatacccaatttcatataatttatacttctaaaagctaagtagcttaccatgtagctttgtatcccgcgactcttatacaaggcggtgtccaatctttaggtataatacgatggaggtccaagagtatcacaacctccattcattttctatgccttgcctaactcaatgtttagtgacatatctataacaaatttaagtaccatataattcacacatatctattacgtttgagtccgcgtatttaatcgatgacatctttttacaaaagttaatcagcttagcagagtgtatttgatttgtgatcatcctttatgtgtatcacggaaacctacgctagtgctatatatatgtcacatacacaattattttgttttgagttggactagtcacacaaattaccgtgcttcatcaacgacactttaatacgcaaacttaacacaaaccccctcggcgaccggccgcccacacgcatctcccaactcgactcgacccaacgtcccaacccaagccggtcgagttcgcgttcgcgtcgcaccgcgtcacgtgacgaacccgatatcaaaacccccgccgcgcccgctcccgaaccaaaaccctcgaacccgacgagtatcccgaccaccactctctctctctctctactctccctcctcgccgcgccgcgccgccgccgccgccatgagcgcgggctggaggacgctgctgctgcggatcggcgacaggtgcccggagtacgggggctccgccgaccacaaggagcacatcgtgagcgccccccccccccgtttccctcccctccccgctcgttttgttctctcccccccgggggggcctcccgcgcccgaaccctaggttttcggcgtccggatttggggggcgtgcttgcgttggttcgtgcttgagtgggcgtcgttcctggttgcctgcggtagggggagtgaggcggtagtggtggagctggggagctcaaaaccctagccacctgttaacaattgctgggcgcttggggtttgggtgtgtggagcggagccgtgacggtcttgtccggatgatggagatgaggagagtagtaacaacaggaaggacagaacgacgtgttttgataatttgttctgcataatttctaccatttgaatattggaaaatgtgtgtgtgtgtgtgtgttttaatgatgaaaacagttcaaggtagagagatcaaaattgaaccctgctaaagtacttcacagatgtagtcacaaggcaatgcacatttggaagactgtagtctgtaaatgcacagcaatcttgatgtgctttaagtgttgttattacactatgttccagcttctagttgaaaaggctctttttttagtgaaattgtggcgctatgcatggtagcatggaaggtggtgctgtaatgtgttgatgcaattctgaactttttactcttttatatgctatatgtgttgatggcatgtttatttgagaaccagtgcaaccaatggacaaatattctagtcaactaatttgaccttgttacattcatgaatcctctgaagattagctcagagcacagcatcaccaccatcaactcttttaagtagtataaattaatatttttattttatgatccttctacacttgttttgaccaagcgttttctttgtaggaaacttgttatggtgtgctttgtcgagaatacgaacactccaaagatgcaatgtttgaggtcagcacccaatattctatcatgtgccttttcacatagtattgtctaaattcacaattaattcggtcttttgtttttatagcaagctatatattgtcttagtcctatgaagaaatatcgatgcctaaaattggcatatttccaactgcagtcagtttccccttctagaaaaaaaaaactatagtccattggctaagccaatcttagtattccctactttctcaaatataagcatttctaggattcgaattttgtacacaatataagcattcctgtagtactacttgtcccatcaacctctcattcaaaagttccccatctttatccgcaaccaccctcccattcccaaccacccctcatttattttcaaaccttattccttaatctctactaaacaacctacaaatacttatatttggaatggaggtagtatttgtaaagaattctaaagccaagatgtctatttatcttgtcaacttttctgcagtgaaggcagaaaataaagatatcaatggagagatagtatatcttatattctgcatcttgtgaatgaattgatatgatactaactgaacatactttttttttgagcagtttctcctccaatgtgcagatcaattgcctcacaagattcctttctttggagtattggtgtgcacctacttgaaccttataaaactacatgctattttatggccttataacttggttattgctatttgtgagcattttattttttttgtcacaatataatgatatgctactgtgccctcttaatcctttgttatccccagaaggtgaatgcacaacaaattcaaccactattagtgtagtactaaaaaaaatctagtactcatatgccttttgaatttatgaagcctttgaagtttttatttttcgagaacaagccttgagaagttagattagctcttaaaggtggttgcaagccacaaacacactgcataattgtgagtgctgattaacatgattgatgaaactattgtgtgagaggaatccgaagttgacatacgctttgcttcatattttgttttgcttggtcctgttatttcttgagctgttgcatatgactatgctctgttcttttaaatatagttttttttcctgaagctgttattgttcattattctgccgcctatgcgtgtttgactgttcactatgtatcctctatggaacttggattgtcaatttcgttccaaacattacctatatcttgttttaagtttatttttacacaatattggtgtaagaacaagacatggcaatttagtttttattatttgacctaggcattaaactaagtccgtaagatggctctttttttgtttctaatttcagataggtttgataaacttggaaaatgaagatttttccaagggtattgtcgatacaacacatgccaatttacaggtacatgtagatgtttttcttatgccccagcagtattaggtctatgtagatgtttttctttcggtgctgaatactaagtcgaaatcacattatggttctccttcttaaagattatcttaggttataaatgatgtcttaattgcaggatgccttgcataatgaaaatcgtgacagaatcaggatattgctgcgatttctctgtggcctggtaagttttgtatttggttgatttgatttgattttgttgttgacattattgtgcttgttgctttcctaatcttaattggtgatgcctgaaatgtgtctaactgacgtactatcatagtgttatgtttcatacaaacaacacatctttgcgaataattgaatctgtttgtcaacattcccaagtatgcaaggctattagttcttgtctttcaaccttactaacttgagcgcttatgaatcatgcaacagtgcatttgcatgacacaacatagcaaactcacaggcatttataactagtgattcataaaatttgcatttggttagcataatctttacttttggtctgcattctaaaagttagtgctaggcgctgggtagccattccgattaggcattagatggtcaatcaggcagctaactatccgtggcgactcttgtgctactattttagtgttcatttatctaacttctctgtcatatacttgctaattgcttttaattgactaattatgttggacctaggtgccacctaggcggtgtgcaggcaccgaccctgcccgatcctctagcacctagagccttcttgagccatgtttttagttctgattctccaaattgccacctaggactgagttgacaagttataaactgtgaatgctttaggtctcctctccaaaagagcagagtgacttctttctacactcttcaattcttcatatgtcgtgacaaacattttaattaattgcacactatatggatatgattgagctgtttgtggtgcaacatagttttgttttttcttttctccattcttttcataactatttaatgtttgccttgtagatgtgcagcaaagttgtcctgccaaattctattattgaaacatttgaggcactattatcatctgctgcaacaatattagatgaggaaaccggaaatccttcgtggcaaccacgtgctgatttctatgtttattgtatcttggcttcccttccatggggtggctcagaattgtttgaggtaacttgaactgctgttctttactgctgatgtgaacatatgcagttcagcatgactgtatcactgtatctaaattagttgtgcatgtgaatactatttcatgtacatttctgttttatcatttttcttagttttatttcctatatgagcagctagagggaaagctgaagcgtcaacaattttttgaaacatgtgaaactatatgaaaatacaatacatttccactttaggagcacccgttgttcaattattcttttaccttgggatccatgacatgctaccttcgtttttgaagccattttgaaattgtatactagaaaattctgcagataatccagtggtataatacactaatgatatgtaacatgcagcaagttccagatgaatttgagagagttctggttggtatacagtcttatataagcattagaaggcattttgatgatattgctttctcagtctttgaaacagatgaaggcaactctcccaacaaaaaggtgaacatacactgtttctccttatcaactcagactccactagtgatatctagatcaatgttattaaagttagtccttgcaggatttcatcgaagatttatgggagcgtattcaagttctttctcgcaatgggtggaaggttaagagtggtatgcgatagtccatatgatttcttaatgaacaaatgttgttgaccttcagttgcaattgcatatgatatgtgacaattatacagagttatatcacaatatgtttcaaaaaccctatatgcatccaatagttacattcagaacacctttttcttatattaaattgggctggtggtattccaaaatcttagacatgcttgtgtctaattggtttctgcactctattttacttccttggcagttccaaaaccttacctgt

SEQ ID NO: 61286 - DNA, 3264 bp, Oryza sativa
ttatcacgttttcaagtttataccactttgttatacactacaaagtcattttgttatataactcttctttaaataatacattgcaatatttcactctgagtttgctcaatttgttgccagctgtgttcctatatgcttcatgctgtcccagtatgtacaacccagagtctaaaattaaattttatttcataaagacgcaattacacagatactgttattagatagaagcaaataatatctgaacattggaccaatatgttccttaatacctgactttgtgtgaaatggaattaaaataatctgttacttttaatgattcgaatattattaattaattccttgtagctgttccatttgtcagacaaaaatagtcacacaggcagacatctcttgtcgtatatgactagtcatgtgaaaatggtatgattagatttgtcctggaaaatatttttatattatataatgattgaacgaacagctgctaacacattcatataacaagtagcggtcaaagttgaatcttgaataccaaggtgatgtcaaacatgtcatattaattgcatgcagttacaccagaaactactgtgcacatcagcttcagtaacagtaacaattccatcatttcttggtttgattcatttctcatatgtactttttgcaactaatgtactgtatcaatatgtatgacaactgtattccatgtcctttatgtctaaccatctagttttggctgcagaacatgcaacctgtagatcgttttgttgttgaagaatgcatattggatgtgctacttttcttcaatggatggtcagtagttcaatttttccaagattatcaacacctttatatttttcacagtagttgagactggagggtatcacctacatacctgctaatatttcatggaaggcatagttgaccatcaagtcacaagatttgcttgtcagtctttatgctaaacatgcactaccatattcttattgctcttgtgtcttgcttctcttacaaacaaaaattggtcatatttagcccccatacttttgtcttattgtctattgctatgttttgctcggatgtagccagtgaggagttttaacttggttttacctaacaagacttactcttctcaaaataagttgtggagagcctatgctttaagatttggagtttcttcttcttcttctttcctttttggtgctggcactgttttggttctgatcatacttgcattataacactacctccgttctcaaaatgatgtcattttggacacattgacatactacctccgtcccaaaaaacttgacgttctaccgcctagccgatgtcccaaaaaacaagtcgttttggatatttaatcagagaaagtggggcccatgtttctgtttttttttcttccggtcgatggaatcctcgcgtaacagcacagaaaccttatcctctcgccgtctcgcgtcctgaaaccttatctcttctgttctctcacctcctctgtcgctcctcatcctcctcacctctcctctcctctgcactaccggcgttggtgacggtgaggcgggcacgctccgagtcgcggctacggaggtcgcggcgcagccggtacgcatcgattcgctggccggcgtagcggctgtggaggtcacggcgcagcgaacacgcgctgagtcgctggtcgtatacggagccgcaggcgcgctgagtcgacgggtatcacggctgcggaggtcacggcgcggcccgcacccgccgagtcgccggtcgtcgcggctgcggaggtcacggcatggcgggcacaccgagtcgtcgccggtcatggcgtggcggccagggccggacgcatgtgtagggtggcggaaacggaccttcactcaccgcaggcaactggaggaaggcgaagaggatgcaggcggcatggtgatgggggctcagcgtcgaatcaaatcctagggacaatttggtcattttaccctgatactaattttggctgtcaaccttaaaacgtcaacttttttgggacggaggaagtagtctctaatgcaaatgttctatcattactttctcaaactatatatttataaaaaaatattaacaatataactacatgaaagagtttttcatgacaaatctactaatataatttttcatattttaaatcctaataatttttcatattttaagtcataatctactaatacaagaagtagcatctattaatgatttaagattttgaggtttgattgcacgcattctaggatttcatcttttcaagtttcaagaacggaggtagtactatatctttatatattgagcattcttgcgagagctttattggtagcaaaagatatcagcaaattgttttgacacgatttaatgtttgcctactgattagtgaaatttcaacttgtttactgattctatctttgttatgtttttctttgaaagacagtcgcaaagaatgtgcattttatctggtcagcttacctgtgcctttccgttatgaatacctgatggctgagaccatattttcacaggtactttttaatcttcagtgtttgatttttgattttagttgatttagtagtgtagtttgtatagagaacttcactatgaaaaacaacccttcatgcaacgcattctaaccagcttcaatgtgacatagttttggtttaaaaacccaaaaaatcttggactaagttatattccactctatgcaaactggctcaaatcagtatatgcgcatagctaggatactacctgctaacggtatttatgcatgttgcacattaactagtcaagaaaagcatatgtttttgtgtgtttaatcatgtattatattgatattttgcagctactgttattgccgaatccccctttcaggccaatttactataccttggttattatcgacctttgcaaggtactattttcatgcttttgatcttgtgagctaacactgtttgttgtgactgcgttactgtgtgataccaatatattgttgagactaatatgccccccttagcaatatgttgtctagatcatggctgttttgatggtttactcaacttgccaaacttctatgccacaagtgtggcttgccacagttttgtggtgccaaaaaagctagctacacttgtggcaaattttggcttgcaagtgagtctgacttgtggggcataagaatagtgaagtgtggcacaccataactttggcttgcaaccaaacgcttgcctcaaaaagtcaaacttccctaacttgaggtgacag

SEQ ID NO: 61287 - DNA, 5935 bp, Oryza sativa
ttggtaaacaaccagcttctgtgaaaaaatgttagtagcattgtgttgtacatctctgaactatattcaagaacagctgttgatacaaaaatgtagcatattggcctaatgtaagattgttttggtgagctgaggttatcagaaaaaaacaatcagttctctgtactgttgcaaagctaattcgacctatattgatctttcatgaacttctggatacggggaacgcatgctgccgttttttttttaacttctgggtattcaattaaaagcattctttgggtattcaattatgcttttaatgcataagtacaacgcccaaagaataattcagcttctggcacttttagtattctttgggatgatacactgagttaattgtctaaattccaggcattgccaggtgcatttccttcagttgtggtaggagcagtacatgctctttttgacagaattagcaacatggatatggagtgccgcacccgacttatcctatggttttcacatcacttgtaagttgattgttctactgtttactgtctgacctgctatacatattttttctgttgtttactatctatacgtctttttcttgggaatttcttgtggaccattacatgagatattccaaaacctttaaaaaaatcgtcgccttctttctcatatcaccctcaagacaaacttcaagtcttattgctgccaaattgtgatcgatattgttctgctttggcaggtcaaattttcagttcatttggccttggcaggagtgggcttacgtcaaggaccttccaaaatgggctccacagcgtgtttttgtccaagaagtattagaaagggaaattcgcttgtcctactttgacaaaattaagcaggttagtgatatgcaaggaagcatattccttctcactgtttctactgatggaccaacagtcatttgaattggatcttgtctcttatttctttcccagagcatagaggatgctgttgaattggaagaactgttacccccaaaagctgggcctaacttcagatatcatagtgatgaaggcaaagaaagcactgatggccacagactctccaaggaacttgttgccatggttagaggaaggaagacacaaggtgatattatttcatgggtagacgaaaaaataattcctgtaaatggtgccaaatttgcacttgatgtagttagccagacacttctggacattggctcaaaaagtttcacccatcttatcactgttttggagagatatggtcaaataatatcaaagctgtgcccgaatgaagaaatgcagttattgttgatggatgaagtcagtgcttattggaagaacagtacccagatgattgccatagctattgataggatgatgggttatcgcctactttccaatctggctatagtcaaatgggttttttctcctgctaatgttgatcaatttcatgtttcagatcgtccatgggaggtacatcctttatcctcatcgaataaccaaacctattctgcatttaaaacaaacctatactgcttgtgagtgatggcgcactgtaggagctttctgctttcagtgctttgtgcatgcatgtttagttacttttattgaatggtgaaatactcaagccatctagaactgccaagacaatccttcattaattttctgtattataatatagctcaatattttaattaaatctttctgatctacattcccttatgcagattcttagaaatgctgttagtaaaacatacaatcggatttttgacctccggaaagaaattcagacactcaggaaaggtcttcaagctgctaaagaggccagtgaaaaggccgccagagagttggaggaggctaaatctattattgagattgtagatggccaacctgtgccatctgaaaatccaggaaggctaagacgacttcaagcgcgtgctgacaaagcgaaagaaggagaagtaaccactgaagaatctttagaagcaaaggaggccctccttgctcgagggcttgaagaaagcaaggtgctccgttgcttttattatcaccttaattttgtactgttgcttggtactttgccccataataatagagttgagcatcctttcttcatgtggttttgcaggaattgcttaggttactattcaagagctttgttgaagtgctaactgaacgtttgccacctatttctgctgatggagatgttcctaatttacgtgctggagacccgaatgtaaattcttcagcccgtgaccctgaagcaacaaccatggaaatagacaatgaaaatggaggagataacgataggtcagtttattattttgtttgcaatgctattactaggataactacttttacaggatggacaactatttttcatgggcggttcattctgaaacgagctttttgtggaaagcttgcatgaactctagtagactaggattttgtattagtcctgcatatatctataagagtaatttactcttaaaatgtagaaaaaaaattcagtagagattgctagataccagtcaagacaaacaggttcttggatggattaatatcagctgaccatgatttaattgcagtattcacctatgtcttgaagtgccaggaacccatatttactgttcagtataaatatgttcgtgcctgcattaggggcttggctgtcattattcggctgctaacttgtcttcatgctttagcagtcagctgaatggtcaaaacaagaaaatcagtcacaatgttggagagcttgagcaatggtgtctctgcacattgggctatctcaagtcgttttctcgtcaatatgctactgaggtgaggacctgtggggagttagagttatcatgctgtaatatggatacctgttagatcaaattcctttttataaatgattaggccaaactggatttctccagtgtagttaaactatctgtctgacaatttctgtatactctctttgattccaaatgtaaatcattttatacttgtgcaccgtagttaagaaaaaagctcaaatgattctgttacccttaatttacactgttctggaaaaaagaatagtcatttatttgtgagaggtgtagtagtatttatttttttcaagggcaaacatgaaagaaaagaaacaaatggcctagaagttccaaacagcttacagtcaggagaaagttgagaagcctaatgtgttagcatttgaaatatccaggctacggtgtactagagccaaatatcacaggctgcatgttaaaattgttttattattacaaaagaactcaaggtcttagtaaatgactgatttttctgcagtacgttttaagtagttttcttttccatggcctccatagcttctactaattggatattacacatattttgcagatctggtcccatattgccatgttggatcaggagattttcgttgggaatattcaccctcttatccggaaagctgctttctccggtttgtgcagacctaccagtgaagggtctcacctttgattttgacccttccagtgagttggagtttacctgtattatacgcgacaaatttttcatcatgcttcactaactggacatgcccaaaagtactctgatgtgtactcaggaactccatcgattctcctgtaatcctggccccgaggaacacccttggtggaaagcactgtaacgactttaggtgattaaattatcagttaggtttatttgaattgtagtggactaattttcttgggtgagtaattgctatggtctagctttcttaattccctctgcctgtgttaggacaacgccgtgtttattgataagctgatctgaagccgtcattactttacatgttgagctgtcgcattggtgggtttgttacttggtccaaattccaatggaacttgcttgcaacactggtccttgcaacgtcttctgagcttctactgagcatgcactgtcaaagctgtttttttacctgccatggagtctggagctgccataacgaaaatcttggtaatgctatgctttgtacactagcgactattttatctctgggttagggtagatcggaaaaaggatcacgagctaggtccaagaggggtctcttcacgctttcctgtctttaatttgttgtttctatgcaattgcaaagaatcattacggagtaaaacggaagattctgtgccacaaacaaaacagcatagctactacaactggaatgggacgtttaccaactgaagccgaactatacttcttgtttatccctaggatgcaacggaatatttattcactaatcaggtggatgaaaattaaggcgcttgatttgaaaaatgacagatgaatcatccagcgaaaaatggacggtttttttagggtgccgaagtcaccaattagtgtgttaaacaagggcaacaaaacgaatgtttcggataatgattatactcatttgatcgggcacataattagtgcgtaaaatatttacgcggcaaagcgtactcagcctaatccttacatatcataatccataaactatgtttaggagctgacaaaaattgcaagcaaataatatctacaggtttatggctttgttttgcagagaaacacgtggaaaaaatctctttggtttcgggtaaatgacaatgcgcaggtgctggttctgtttactgtaatgaacaaacaggttaatctctactgtacatgagatttacagggttatagaattcattgcccaccatgcttccaaaccgttccatttcgtaagacctggaaacaaacaatccataatcagcaggagatttcgtataagtacaaaaacttcaccattttaatgcatttattcaacacagtgaatttcagaagctatgcgcatgtaaggggcaattcatgactactccctctgtctcaaaatataagaatctgtgtccagataagacatcctaatactatgattctggacaagactcaattctagaatcttatattttgggggagggagtaattaataggtggagtatcaccattttccagtatgctcaatagggtttcacacttcgtggcaaatgcgaagcaggacaaatcaatcaagtataaggttggctaaagcttgttagaggatttctgttatgagccaagttcaatcttaacctgtactaagaaaactgtactagggggaggcttccaagaggtaggtctacataagtgcaattcagcaccaattaatgagcatagatacctttttatattattttatctgcaggcatatgttgctcacaaataagtggaaattcaggcagcatctccaaacagggaaaatagttagctttcaaataacgggtcagtctacgatagttttgtgggcaattataaggtcggaatgaaatgaaaaatatatgctttgcttaaagcaggagacatgaactgatgatgataatattgtaattgctaattcaaaaataccaatacctgcttgaggagacggagaatacttatcttggttagcacagctcatttctctcatcccccctgctcaagactgtaccaaatgtcatggaaagacgagaaggactaaccatttagccttcagaattttatactcaggtggaacttaccaattaccaattacaaaattgttcttgagtgctggcacatcatcagtgccccacagtaacaccaataaaaggtattatgctgcttcgaagttagtataagtaagcgtcagtcaaagattcacctaatctatagaaccatggcaggggaatgcttgatatggagcccatatgttcccgataaaacacatttgcctacctacagcagaatggttgccagagttcaaaccatcacgcatgaaaatccggttctacctcagctggatccgttcacacagtaattgcgtaccaactgccaagaagatgctctaaactgtacaatatgcttccaaaagggctgcagga

SEQ ID NO: 61288 - DNA, 7666 bp, Oryza sativa
  unsure (1)..(7666): unsure at all n locations
ccaattatcaccaaaccaaaagtaattgtggtagacatttgaccaaactatcatttacattttctatggtcaaagtgtagacaactcctgtcatcaaagcggatgctgttatatgattggattaagtgcaaagttgatggtatttatggtttgactaataacgaaaattagggatgttggtgggtaagcggtgaattaggttataggtcaaaataagggagttggnggcttatttgatctataagtggattcgcgggtagccacttacaccttacccaaaatgttaatgagttaaatgccattttgaccattgataatgtaatttcaatttagctattgagaactgcctgattttaggccctgtttggcaatgcagtgacttttcaaaagcactcattatctatatttttttattaaaatattagttgatttttttagctttaacagcaaagccttactggaatcactaaagatttccctcactaaatagattccaaagcacaggatagcagtagcaccatagcacaaataaccactactgcctgtactaattgagctaaagaaaatgttactgcatcaaactcctactaattcatttccaatttgaagggtatagtcgttaatatacattgttcaaatccccaaaagagattatgtattaaattgcaattggttctgcctgtacgaaacaagcctccacagcacagagacataaaccatagactagaaacagttcacaatggaacagcttgcatatccatatctataaacatgttttcatgaagggacagatgaaggaacctagtaataaaaagattgtaccaggctaaaggtaaatagcttgattgaaagtaacaattaattgggacatgtgcaataaggtacttacataggcaagtaacctcaataagtgtgcttggttacgaacggccagtggcaaatggttgccagccacttggggtgagtttccacccttggttgaaagggcctttgacaatccatggctatttaaattatcgatatctgaggcagacgatgatggagattcacctatataaagataagaaataatatacacataaagctccatacactgccataaaatacttaatacaaataaaattttcagagtatactatgaagtctgagaattgataacaatgcaatagtatagaaaacaaaattggtagaaaccagattacatcatgaaaaaaaaactaagtacctatcaattttcaaatggttagattgcagaatgcaccaagcataatttgattactccctccagttctatattaaggtggtgtttgaatctccttaagatgaagatgaagatgaagattaagttttttacgcaaaacgagatggtattaacgtgtgattaattgagttttaattatttcaaacttattttagaacaaatttcatatagaaagttttcgtacgaaacacaccgtttagcagtttgaaaagcgtgccactttaatccaaaacttcatccaagttttgttggacattcgaacacggcctaactggcgttatgggttaatgctgtttggatggcaaaaactgacgttttagctttctccacaactctctcccttttatttctccagaatacccctcatgcatgcatgcaaacagtaaatgctgttgcttcgtctccatccagcggaaaaggctatatgggtatttaataagggtataacaggaaatatggtgactaattaataagtcattggtatttgcaatgctgtccaaaatgtcagttaatatagaattggagggagtacagtttatagtgaccagatagccatatcagcaaaatggatttaccaagaatcgtataaaccaaattagatattcggtaatgccaggtcaatataatccatatatccacatgcaggcatgcggcactctctaggccaacaaatccattactagtatatgcctgtaactgtattttttgtataatttggtttatctagtaaaccatttgtagttacataatacaaaactatgattactatgattacataaatacaagttgcatagccatttgtgatgtgatgaaggaaggatgcaaactgttggagaaaactgtcgtgcacttctttggtaaagatcgatggaacatgagaaagcggttaagggggtaatgtggtcgttggtttgtttggaaggtctttttcgctttgaaaggctttggagtctttgtgctcttttagttttatgtaaggtgcttgagcctctgtgctccttttgtttgtaaacttgtgtaagaactgagcttgttcactcggaatttctgtggctgtatacacccctgttggtgtagaagccgggttttataaattcccattatctaaaaaaaatagctgagccctgtgcctggacttccaaaattctacccattcttgatgcacaacataggaaaacgacgaacaatttggtcccacaacttacattcaaatcttactttagtctgtgagcttttaaaatagtcaatttcgtccatcaacttatacatttggatcaaatggtccttttactgatgtggcgtacaagtagcactgacttgggatttagatgactcagaatgccatgagaagacaaaatataccattcccttacatatcacacacacaatcaatgttctctttcaacaaagaatgcaattcattattctctatgaataccaaatccagtccctacatgtttggatgcacacagacctcgcataaacaagtcaagaagcagcaagcggttattttcatcttaatcatttagtgtaaggcaactgaattgatggtcaaaattggtccttttgatgagctaagtgagaaagttggggaccaaattgctcatcatcctaaataaataaattggtaatactcgaactccagtgagtgacacagtgcggaacaaaggatagtagaagcagcctccaactcccagaaaagctcagcaggaataaaaaggattcaaatatttcaaattaaagtttacaagctagaacaaacatttttttagacatcaattacctggagctatctgtacaaccgactgtagttcttgtcgatccttgcttgcactagggtgtttgtaatacgctgctttgaggtaagccacttctacacatttatatnnnnnnnnnnnnnnnnnnnnnnnattgcatcgttcataggcatgagcacaaaagctggacagtcaaataaaaaaaaaagcattttagtatactgcatttaaaaagcttagttcatatagtttcaaagttagacatagctaaccatacgtgaagaaaactctgatcaatttaatatggatgagtattcactacgtgattagatgcaaccatccaattcgtcatcattcagtgtagtttaattaaaacagccagatttatcttcaatttgtttgaaaaaaagtccactttactacctcaaactattttcacagtccaacctaccctctaaacattatttaggctcacttaatcccttagtttatttgtgcagacatatgtttgcaccctaacctggtactaggtggtattgccagtgtcgagtagtttttaccggtaaacctagccacgccacacatatgtgctgaggtggagtataagggtcatggcaggcgccaggcggagcaaaggtaggatagatcatgacattcatgcttcgcgtggctttctgatttctgcttccagatagttgcatttgctcacgtggcgaggctgtggtcaaggttcctgcccaccgtcaaccgtctccaattctccatcctagcgatcgcagccactaccgcatccttagtaactaataatccattgcagcaacatcagatacagaagatggatgttaaatccagttttaaagaatagtcagatcagatggatgttgctgcgtaacagaattttggttgccatagctgcaccagcgctgtgcgatgcagccgatgctgtgggcctgttactgtgacatcatccatcctacacttttcggcatgctgccaactgtccctctaaattacaggtgaccacaaccacgacgaagtccaagtgagaaaccaacaggcaacagctcattgaagaagacgcagttgctgcccttcaagcttcaaccacagcaaggacatagccaggctgcgtctggcgcacaagacgtgacttgactgatcaaaaccactccacgctggcaataccacctaacaaaactgggttagggtgctaagtgggctggtattaatagattagggggttaagtgagcctacaatgagggcacactatggtgtatggcgggagcttctaacctccaagagctgttggccaaggcaatacttgtgccctaggagggggcgaatgtgggtgggtcttttttgtgttttcagcgggtgtgatggcgtgtttttgttttgtaagtccgaccttttattccttgcttaatgaaatgatacacagatctcctgcgtgtttgggaaaaaaaagtgagcctacaatatgtttagggggtgaagtggacttatgaaatagtttgaggtagtaaagtggactttttcgtatttttaaatacctagactgttttcatcccttggtgaatcgtggtgtgtctttcttttgtacctatgacaactttatataaacttttgctgaaacgaagtatataaactttatagacttattcaatggacatcacaggtagctcacctgcagagttttgcagtttcagaatacatcttcattgactgagcaacatcgcctgatctcgaattgtccagattaggagtttcccaaagagatgcaacatgcagaaacttcaaagccgcttcaaagtacaggcccatactttcaagttcaagtcctttttcctgcagggaaaattgtcattagatacttccaagcaaaattgacagcacaattatgctgcctgagacaacatttaacacaattggtgtcaccaaccttcaaatgattagccttgtgttttagatcccgagcttccttgagtgcaaatgcaatcatattaccatccctcctaattggactcgcagaatctccattttcaacattggaccttaattgtgtgtggttttttgaagcacctggttttactctagtggtgtgaacctctgatttgccttctttcatatgagaatgattatcttgaccaatagacttttgcatatcttgattatcaatactaggacgtaatttctcttttctggatgacatctctatctgcttatttccctctgaatcaagttactggatccatttctaccttggcgtgaaggagcactatttttacttttatgtccagtggaatcagctgtagccctcgggttaaaacaatcctgctgatcaggttgtagtgtagggccatgcatatccaagatctttttatcaccagggtacaattgattatctactctccccataccggagttatttgtagaaccacgcagaatggcttcacccacagcttgctgcccagtatgtagtaaaccaacttcgtgggttggatatttcattggggtatgcaagatgcttgaatcagcattcaattctccatcttttccagttttcctggccttagaaatcttatcagtgtttgaatttttcagtggtgatgaagatactgattcaacgggagagccctttgcttctcgagaatttttgtttctccgagagcttgagacctttgaagagcttgaagttgcaaccgtagaagactgaagacaggcaacatccctcctagtgggttccgccaagttcaagacctgtctgggaggttgattatcccatagttctgatggaccttctttacaagtaacaaatttgttgtcagcaactagctcattatcttgacgccttccagcagaagaaaataatgcatttgcatcctgaacttcttcaggcctagcttcggacttctttatctttgataatctctcgttcaaattctcattatcgccccctttgcttgtgtggtccattgaactgagccggttatcctcccattccttcactgtcttctttttgccagacaaatctaatgtttctatgcctgcacgatgttctttcatcttctcatgaaaggccacatcatcatcattaattctctttgttttttccaaaatatcaaaccttgaagctttttccttgcgtaaagaaaactcatcttgttcacatgagtcctttgacatttttgcttttgcagataaagctttggtttcatcacgaactttgttgccagctaaatcgtattcatttttccaatctttgttaaagtaatgtcgatcctctttttttgtcttcttagatgttttgtgctcatctcgatcaattcctctcctgttttttgattttgaatgcttcttcgatttttctgtaagatctcctgtatttaaataggaattatatgtcagtaaacaatttaaataactaaacacagtatttactgaaaaatatcagaagataatacatatcagctaaatataagcaataaacatgaaagagagcagaacctccatctgagtggctactgcgactcttgtgcttagacttatgcctttcagaagctgatttgctctgtggcaccagatcatgtgtgcttacaggatctctgtcattagtataatgttcactatcaacaacttctctattttttgcaggggcttgttgattgctcgtgagagtcatttttgcaggggcttgttgatcatgctcgtaacagttttcgtctttcagagcatttttccttttcctacttgtcccagttgtccacttatattgtaggtgctagatgctgctacacttgcatgcgcagtgtgagggccacctgaagaaacaccagcggcagggatttgagtgacataaagtgcatttagagcatttgttgtttcatcctcactaatgtcgcatttgttcatcccaggtctgcaaagacaaatttggattgtatttttcagtaatggaattttttcttccccaattgtcagaccactcagagaaagaaaactgcatgacccttgaattagagtgctacctcaatgttgaatttgcacagcttatggaccacttaaaaatacttttttttttgtttaaggcggggtggatgggtgttcggggggagatatcagaatctagtcaaattacctgtctaatcagaaatcgtttaaggtgtacaaagaaattccagatcaaataactatatttaacaacgtttaaccatgtactaaggacaacttaacatatgtaaggtgccaattgaagcaagcatgtatggtgaggcataacactggataaatgcaattctaatcaaactgaactagaacttacagccagtcaagcatgctgcatatccacttttttggaagcatggaagtgtttgtcccgtaggggaggagacgccatttatgacacatgtcacagcatacccaattatcctctatcaaaacaggtgcaggaagagaagctgcatttgcaggtccaggtataatcccgccatttgacggcatatgcaactgctgttcctctgaacctggaaatgtgccatgctttacactggaagggatctccttttttgctggcccagttatatgaagttccttctcattatcactgttcatcatcttctctttccgttgaccctgaacacttacact

SEQ ID NO: 61289 - DNA, 4589 bp, Oryza sativa
attcctgcagcccagctttgtgttccttctgcattcgtttgacctccgttctagagttatcttccacagttctctcactggcaaaggtttctttaccatgaattgtcttcaaatcatctgatgacccagcaccccagtccttgtccacattgccttcaaaatcatccatggcaggctcaaatgttctcataggttttactttgctttctttcttcctatcatacggagaaaatttgtgactacttatattcatgtcttctgaagtcctgtccactttactcgccttaagttttactttcccccgtggtgctaaacaaccatttcctgaactgtcaaaactactgttttcttctatatgctttgttacttctgttttgactgcttcgcttttaactgttcccaggtcattgcagcccatctgttgtttcggtcgagcatctttagttgattcttctgtgaattgacttacaccttttaactctgtggttggggcgccagaagaacaggttatatcatgtgtgtctgataaaatcactcggctgccaggtatttctacattagcctccttgcccaatattgcactagtattatttgcatcttttctagtctttgtatctatggacttctttttcttgccatcaggcttcattttcttagccacatgggctttgacatgcccagacgaaagagaaagttctgaatggccatcaactgctctaggtacattttttaagtccagattagtttcccatttgttaaccaatggggtgaccttattcgtcaatttcagaatgtttccatgcagaggtgacagcaagaatcctccaggaactgaaaagtacgtcatgatctgattgatcatgcagataaaaatataagctattataaccattgtttgactatgcttaatgacatagaagtgataattcagtggttataaagcatttatacctgcaggatggtccgaggagattcatatggcacattactacacactggagattgaccctcatgaccatcaggacttccttccatggatgaagaagaagaaatatcaaggcccaggccactgtagatagatgcattctttcttgccaaagtattagtggaaccaactttgatccgaactttgagtgtcttctggtcactaccattaaatgagctgtccaaggaatcagaacaagcaacagagtccttctcaccgtttgtgcttgagcatatttctcttttacataaatcaccagatgacggtgcagtggaaccattatttcgggagatagattcatttgccacagttgaagggtattgacccatgctctgcatttgtaatcatgacacatgaacatacgccagaatatacattggttaacagcacaaggaaaactaaaaagcacctcagcagattgttgataaggtgatcttgaagtgccaacgtttgcaaccttgggtgggcttctgctttgaggcaaaggtggaggtgagcgctggtatgtgggcaaaaacgaaccatatccaccgtattttgatcctgtcaaaaagtttttcccacttaatatgactgaaatgcaatgaacaaaagcgacaagtacagcaactactagctctttacctaggttatctgcggatactcctccttcaaagtctttctgaaaatgtccaagaacatgttgaatcttttcatcctgagaaaaaaaaaacatggaaagcaattaatgaggaccagagataaatgctttgatcacagaaacggacatatcacacacaagcaaacataaaggtttctgggtttcctcaaaataaatgctctcagttcgtttttacttgtaatttacgacatcaacacagtctccaattcatatgttttatcattgccttctccaaccatacatttattaaaagaaatttgaaatataacaatatgaaagcaccattcgttacaaatctagtaataacatttttacatttcaaatcttagtatgtttgcaaattagggtttatgttttcaagatttcattgcacgcattccataacggcatctatttgtgaatggagggagtaactggtctcggaggcaataactgcagcaatcacctaaaaacactaaaaagaccatgtgtgtgtgtgtgtgtgtgtgcctgcctttaacagaatttcaacatcttttagttagggtgtccaagcaaaccaaacacccttttgaccataagtcagaactttggataccagatggggtcaatcaacaagaaatgaatgccccaaaaatggataacaattcttataagtcggtaaagacttgcgcatttaattaaaagggaattattacaatttaatgtttattaatgggtcgtttagtcagttggcttttaccgcacaccaaaagtggattagtagtaaactcaacacatcacagataaccgaaacaacgaggcaagctagcatcgcttcacttgtgaggacagcgcaatgaaagaagcttgcactaaattgatgttgcgcttacacgaatcacctaaacgagcagagttcaccattcatcctccaaataattcgaatggaacgaaggcgcttcctcaccctaccgagacaaagacgaaactgagatgttgatggtaaccacttaatttaactaaaccaacatcctgcctaccaatcaacgaactgcgaaatcgtgcaaaagctgccgcgcatctcctcccaaaaccataccgatccagcagtcccccgcgctgaacggcgccgaaatcaacacattcattcgttcattcattcatttccgcgaggccacgcgagagagagggaggcaacaaggatgggtgggggcgctcacgatgtaggagaaggcgacttcgggatcgaggcagagcgcgccgccgccgccgtcgtcgtcggggaaggcctccccctcctccagctcgacgtcgccgtggcccatcacacggaacccctcctcctgccgcccccgcaccgacagcatccgccgccgccgccgccgccacccagctccaaatcgcccgctccctcgctagggtttgaaggggatcacgcgattcggcggctccccgtcgacgctggctgtggccgccccgcccccctcctccggcttcgacctcgccgcagatattttttaccgcggggcccctccgattatctctatttctgtttctatccctctccctcctgtctctctctcaggctcagcttagctagagctactcctagtactaggctactactactagctgtgtatgtgcgtgttgcgtttggttggttggatggttggttggttgggttgggttgggtggcggcgcgtgaccgggtcgtttcgtttccttgtgtggccgccgacttggggcccatcacctgacacctgcgggtcggtttggtttgagatatgcggacccatcgtttatttacggaaaaaaaagtaatttatgattaatatatatatatatatatgtatatatatatatatatatatattattagcgattaaaagacttaaaaataaaatttgataaagaaaacttcaaatcagctttaaatttaatgttgaaaattcaaattttatctaagggtgtgtttaatttttttggtgtaaagtttttgaaatacacggacacacatttgaagtattaaacgtgcactaataacaaaagaaattacatattccacatgtaaattacgagacgaatttattaagcctaattaatctttcattagcaaatgtttacttataacatcacattgtcaaatcatggcgtagttaggttcaagagattcgtctcgtaatttacatgcaaactgtgtaattgttttttttatatatttagtatcatatgtatgtgtccaaatatttgatgtgatatttttattcaaaattttttgatctaaacccggcctgataagcataaacgaaaaaagatgtgacccgttatgcgatgcgtttcggttccgacacgggagcgggcaggccgggggtcacgccaacggtgtttgcgttgtgggcgtcacgtccgcggtacgcggcctcgttcgatctcctgtgggcctttcttcgtgggcctccgccacagccacaccctacagcagtatagcccgataggcgagagcgcgtgaagtgaattgattgtcttgggtgcaacgggagcacccacaacaacatcagagtggcgcagcggaagcgtggtgggcccataacccacaggtcccaggatcgaaacctggctctgatacacgattttttttcatctcaattactactctccaattaatttttattttctcttactactctcgaattactctccaattaatttttattttctcttattactctcgatttttttaatgtcttctcaattactactctccaattaatttttattttattttgtattttgtcatctcaattactgctctccaattaatttttattttattttgtattttctcttctcagttagtactactcttgaattttcttctcaattactccctcaaactcctaatataagctccaattaatttttattttctcttactactctcgaattactctccaattaatttttattttctcttattactct

SEQ ID NO: 61290 - DNA, 1535 bp, Oryza sativa
  unsure (1)..(1535): unsure at all n locations
atataagagattttactttcactgtttgaccattcgttttattcaaaaaaatttggaattattattatttttgacttaatttattatccaaagtattttaagcataacttttcattttttatatttacacaaattttttaaataagatgagtggtcaaacaatgcaagcaaaatgtcaaaattccttatattatagtacggagggagtaccactctcaatttttaattctattttattttgtattttgtcttcttaattagtagtactactcttgaatttttcttctcaattactactctccaattaatgtttatttggtcttaccactgtcgatttttttcttattttgtcttctcaattactacactctccaattaatttttattttattttttcttatcagttagtactactcttggattttattctcaattgctactctcgattttgttatgttgacttctcaattactactcttgatttttttttagtctcctcttttatttctttttgttttctgaattactactattgatgtgcgacagatatcgtcatcagggatgcatgactgccaatttttttcaatctattaaacttcatatgttttgcctttcatcttgctaacgatcatgccgtatatcaccggtcgaacgatgcttccccgattcatctgcatgccaatgccattttgcctccgcccgaccggcgacgccaaaactgaccagttcaagaagatatcaaagcaacaaattctactgtacggtaaataatcgaactcgatcgaatcaatagtcaatctaatctggaaaacacaagtttacatgcatactaagcttaacgagcagtactaaaggacagagctcctctgacataaagtcagagggacgtgaatatccctaacaggtaggtcctatctttatggacacacgtgtcagtgatcatgtctctttacgtcagagaagcctcttccgtattaagaaagtggtagttacacagagcacattagtaattactccgtaaatttcccaaaataaattactccgtaaaatcgaagagacgaaacaattgatacatgggcttttattgattggagagcagtacagtgtctagctagtaccataaactgagatgccacgtactagcatgcagatgcagtacacgtgtccccaatcatacacgtacggcgatacacgcatcgaccagcagctgatagatgatcatgtgcatacatgtacttagcccactagcaaaattctaatcatcctacaactcagaataaagaacgcggcaacagatacatacagtcacatatatatcgcgacttaattaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn
